United States Patent 11,098,302 (IDENTIFICATION OF POLYNUCLEOTIDES ASSOCIATED WITH A SAMPLE) - sequence listing, part 64

SEQ ID NO: 219782 - DNA, 711 bp, Homo sapiens
  misc_feature: GYAE6OF02JW8SY.24.87.H10.1.454.CMB.1.raw
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagccatcaccggagaattgtgttgacgcagtctccaggcaccctgtctttgtctccgaggggagagacgcccaccctctcctgacgacgggccagtcagagtgtagcagcagctactacgcctggtaccagcaagaacctggcctggcctccgagctcnactctagtggcnccgtccacggaccggccacgtcgggaccgtcgacggacgtacggttcgaggtcggcgtacgggttgggtccgtttaggggaactacggttacctttccggaaccttccttaccgtattaccgtacgtacccgaaacgtaacggtcggtaccgggaacgtaccccggtaaagttacgttttagacgttaggttaactttacgtttactacgttacgtacggtacgttttacggtttccgttacccgttcccttttcccgttaccttaacgtttaccgtttaacctttacggttttaccgggtaccgttaccgggtttccggtacgtacgggttcggtaacgtcggttaacctaagggttccgtaacggttcggtaccggtacgtacgtacccgtacttaccgg

SEQ ID NO: 219783 - DNA, 579 bp, Homo sapiens
  misc_feature: GYAE6OF02F6JZT.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttgcagcaacttagcctggtaccagcagaacctggccaggctcccaggcctcctcctctatgctgtcctccaccgacgggcccctggtcgtccccagccctaggttcgtggcggtgggtctgggacagatttcactctcaccatcagcgcctccagtctgaagtatttgcttactttatttctgtactaactacttatggtagtacgtcggtcctaccgtacttaccgttttcggaccgtacggggtaacctaaacgtacggaagtacgtacaaccgtaacgttggtacggtacgttacgacctaacctagtccgtgttccttctacttcccttacccgtaccc

SEQ ID NO: 219784 - DNA, 572 bp, Homo sapiens
  misc_feature: GYAE6OF02FMYQV.24.87.H10.1.454.CMB.1.raw
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (549)..(549): a, c, t, g, unknown or other
  misc_feature (549)..(549): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagacaacttagcctggtaccagcaacgaaaccgtggccaggcctcccgaggcctccctcctctatgctgtcctcccaccgacgggtcccccgtggtccgtcccacgccgtacggtttcggttcggcggttggggtcgtgggacgtagtactttcacttctccacctatccgacgccggcctccgtagtcgtagtaagtattttcgacttacttttatttcttcgtactaactacttagtcgtgtactcgccttccgtactcgtttcgcgacgggtacaacgngananacagacgtgtgctgccacgtntctgtccttctcttctcccgtac

SEQ ID NO: 219785 - DNA, 593 bp, Homo sapiens
  misc_feature: GYAE6OF02HLL9B.24.87.H10.1.454.CMB.1.raw
  modified_base (204)..(204): a, c, t, g, unknown or other
  misc_feature (204)..(204): n is a, c, g, or t
  modified_base (383)..(383): a, c, t, g, unknown or other
  misc_feature (383)..(383): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccacctctcctgcagggccagtgagatgttggcagcaacttgcctggtaccagcagaaacctggaccaggctcccgaggcctcctcctctatgctgtcctccaccgacgggcccctggtcgtcccagccgtaggttcgtggcggtgggtcgtgggactagtactttcacttctcaccntcagccggtcctcgacgtcgtagtagtattttgacttactttacttctcgtactaacgtacttagttggtagtactcggtacccttcgttacgttaccgttttcggaccgtaacggggtaacctaaacggtcggtaagactaacgaacgtaacgtggtcggtacgtcgacaccgtacttcgttcgtccttcgtacttccgttcccgtacc

SEQ ID NO: 219786 - DNA, 646 bp, Homo sapiens
  misc_feature: GYAE6OF02GDQS1.24.87.H10.1.454.CMB.1.raw
  modified_base (201)..(201): a, c, t, g, unknown or other
  misc_feature (201)..(201): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagacattgtgttgacacagtctccagccaccctgtctttgtctccaggggaangccacctctcctgcagggccagtgacaatgttaggagttgtagcctggtatcaacacaaacatcggccaggcctccccggctcctcatctatgatcgcactccaagtacgggccacgtggacacgtccccaagacgtagggttcaggttgggcagggttcggggtctaggggacagtactttcgacttctccaccatcgagctagtgtacgacgccgtagtaagtattttgacgttagttttaacttacgttgtaccgtagtccgtaccggtcgtaacctaacgttccggtaccccttaccggtttcccgggtaccccgtacgggaacccgtacggtaccgtaccggtacctaacgtaacccgaaaccggtaaccgttcggtacggtccgttacggacccgtacccgttacgttcccggtttacgttacccttaccgttaccccg

SEQ ID NO: 219787 - DNA, 864 bp, Homo sapiens
  misc_feature: GYAE6OF02IF8WB.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaagggggaaanacgcccacccgtctccgtgacgaggggtccaggtgaaggtaattggttggcagactaacgttagcctaggtaccagacaacgaaaccgtggaccaggccctacccgaggtcccttacccgtcctcgttactcggaccgttgtccctacccgaccgtaccggggtcccccttgggtacccgtccccgaacggtccccgttaaggggttttccgggttacgggggtccggggtttcggggtacgtacggggggtaaacctacgggtttaactttttacccgacccttaccgtacccgtaaacccgtacgttaccggaacgggtccccgggtaccccttacccgaacgggtttaccgtaaggttaaacgtttacgttttttcggtaacccttttaacgtttttaaccgtttttccgttacgttaaccctaaacgtttaacgttacggtttacgggttaccgtacggttacccgggttaccccttaccggttaaccgttaaccggttttccggggaaccggtaacggggtaaaccctaaagggttacggaacgtaaacgtaaccggaaacggttaaccggttggtaccgggttactcggaacctaaccgttacgttccggttacgttacctttaccgtaacgtttccccgttaccccgtacg

SEQ ID NO: 219788 - DNA, 761 bp, Homo sapiens
  misc_feature: GYAE6OF02IH9IK.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccacctctcctgcagggccagtgagaatgttggcagcaacttagcctggtaccagcagaaccgtgccaggctcccaggctcctcctctactgctcgtcctccaccgcgggtcccctggtcgtcccacgccgtaggttcggttcgggcggttcgggtcgtcgggacgtagtactttcgaccgttctaccgtaacctacttaccgacggcccggtacccttacccgtacgttccgttacggtaaacgttacgtttttacggtacctttaccgtttttaacgttttccgtttacgttaaccttaaaccgtaaccgtttaaggtttaccgggttacggtaacccgttccgggtacccgtttacccgtttaaccgtttaccgttttttaccggggacccggtaaccgggggtaaacccttaaaaccgggttacggaaccggttaacgttaaccgtaaaaccggtaaccgttacgggtacggtaccgttcgtaacccgtaacccgtacgtttaccgttacggttacctttacccgttacctttccccgttaccccgtaacccg

SEQ ID NO: 219789 - DNA, 631 bp, Homo sapiens
  misc_feature: GYAE6OF02JFWLR.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctntcctgcagggccagtgagaatgttggcagcaacttagcctggtaccagcagaacctggccaggctccaggcctcctcctctatgctgtcctccaccncgggcccctggtcgtcccgagcctaggttcgtggcggtgggtcgngggacagtactttcacgttcctccgaccactgacgccggtcctccgtacgtcgtagaacgtattttcgcttacgtttatttcgtcgttactaaacgtacttagttggtagtaccgtcggttacccgtccgttaccgttaccgttttaggcccgtaagggggtaaccctaaacggttcgggacgtaacgttaccgaaacgtaacgttggtacggcgttacggacctaaccgtacttccgttgttacccgtttactaccgttacccgttacccgtaccc

SEQ ID NO: 219790 - DNA, 665 bp, Homo sapiens
  misc_feature: GYAE6OF02IFU58.24.87.H10.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (384)..(384): a, c, t, g, unknown or other
  misc_feature (384)..(384): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggagaagtagtcatgacgcagtctccagccaccctgtctgtgtcnccgaagggaaancgcccacctctcctgcgagggccaggtganaagtgtggcagctaacgttgccgttaggaccagcgacgaaaccgtggaccaggcctacccgaggtcctccctccttctagtgccttcgtcctacgaacgcggttcacgtcgccgtcccgcgtagttcaggtcggctaggtcggttacngggactcgtacgttcaccttcgtaccgaccgtcaacgtccgacgttccgaaggtcgtaaccgtaggtaaacgtttcttttcggtaccggtttaactcgtacgttcgacgtcgacgtcgttccgccggttcgtccgtacggtttaccggttccggggaacggggtaccgtaggggttacgaggaacgggtagtaaccggtacggttcggtcgggcctacggacccgtacttacgttacgttcggttacctacggttacctcccggttcccgtacggttaacc

SEQ ID NO: 219791 - DNA, 667 bp, Homo sapiens
  misc_feature: GYAE6OF02IGRF8.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctcgaggggaanacgccaccctctcctgcagggccagtgagatgtgcagcactgctggtaccagcagaacctggccaggctccaggctcctcctctatcgctcgtcctcaccgacgggtcccctggtcgtcccacgtccgtaggtttcggtcgggcggttcgggtcgtcggggactaggtatttccgacgtcgtaccaccgtactcgacggcccggtacccttcccgtacgttccgtaggtaacgtttattttggtaccttacttttacgttttcttacggtttaccaaacgttaccgttagttcgggtcgttaccgtcggtcccgtttacccgttacgttacccgttttggacccggtaacggggtaacctaaacggtggacgtaactaaccgaacgtaccggttagtcgggtacttcgacccgttaaccgtacgtttcgtacgttccttcgtacttaccccgttcccgttaaccg

SEQ ID NO: 219792 - DNA, 812 bp, Homo sapiens
  misc_feature: GYAE6OF02ICQ1N.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctgtctccagataccactggagaagtagtcatgacgcagtctccagccaccctgtctgtgtctccgaggggaaagagccaccctctcctgcgacgggccagtgagaatggttaggcagacaacttagcctaggtaccagacaagaaacctggccaggcctccgaggcctcctctctatgctgtcctccgaccgacgggcccacgtcggcgtcggcggtacgtacggttcgaaggtggcgtaggtcgggtcgttttagggactacggtaccttacacgttcctactacttcgtaacgtacgaacgtacggtacggtacgggaccgtaacccgggtaaagttacgttttacggacgttaaggtttacggtttaacgttttacgttacggttaccgtacggtttaccggttttaccggggtttttccgggtttaccccctttacgtttcccccgtttaacccgttttaacggtttacccggtttttaacccgttttacccggttttttccggggtaaccccgggttttaacgggggttttcccggtaaccggggtttacccggtttagggggtaaaccggttaacgtttaaccgggtaaaccgggttaacccggttaaccgggtttacggggttaccgggttacccgttaaccgggtacccgttaaccccggttacgtttaccccgg

SEQ ID NO: 219793 - DNA, 629 bp, Homo sapiens
  misc_feature: GYAE6OF02FHFHH.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgccagggcccagtgacgaatgttggcagccaacttagcctgtaccagcagaacctggccaggctcccaggcctccctccgtctatgcctgtcctcccaccgacgggtccccctaggtcgttccccagcccgtaggtttccggttgggccggttggggtcctggggactagatttcactctacaccatccagccgcctcctagtctgaagtacgtttgactacgtttatttctgttacctaacgtacttagtgtgtaccgtcggtcccttaccgtacgtacgttttcggaccgtaacggggtaaccaaaccgttggaacgacgttaccgaaaccgaacgtaggtcgggtacctcggacctaacccacgttccgttcgttacctttccaaccgttcccgtttaccccgtaccccg

SEQ ID NO: 219794 - DNA, 682 bp, Homo sapiens
  misc_feature: GYAE6OF02HS0C1.24.87.H10.1.454.CMB.1.raw
  modified_base (448)..(448): a, c, t, g, unknown or other
  misc_feature (448)..(448): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcaatgacgcagtctccagccaccctgtctgtgtctccgaggggaaagcgccaccctctcctgccgagggccaggtgaagtaagttggttcggacacggactaacgttacgccgttacggtaccagacaacgaaccgtcggaccaggtccctacccgaggtccttcccgtcctactagtcgtctcgtacctccgacccgaccgggtccccgtgggtccgcccgacgtccgtacgggtttccgtggggtcgtggggttccgtagggactggttactttcactcctacaaccntaccggacgtcccggccctcgtacgttcgtacggtagttactttcggtactttacttttatttccgttacgttacaacttacgtgtttacgtcgtacgtcccggtcttaccgttaccttacgggtttaccgggccggtaaccgggtaaacctaaggtcggaactacgtaaacgaacgtacgttacggcgtactcgacctaccgtcttcgttacttctactccttcccaccgtac

SEQ ID NO: 219795 - DNA, 691 bp, Homo sapiens
  misc_feature: GYAE6OF02GT1VN.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagagaccgccgggagaacggtgtcgttgacgcagtctcaggcaccctgtctttgctacgagggagagacgcccacctctcctgcgagggcctagtcaggtagttgtacgcagcagctacttacgctggtaccagcaagaaaccgtggaccgacggcctccgacggcctccgtcctcgtagtcgcttcgtcctaccgaccgtaccgggccccgtgggtcccgtaccccgagtacccgtacgggtttccggttcggtcgggttggggtcgttacgggactacgttactttcgacctttcaccgtacctacgtccgaacggtcccgccttcctacgttcgtacgaacgttctttcgctttactttacgtttacgtcgtacgtaacctacttacgtagttcgacgtcggtcccgttaccgttacttacgtttcggaccggtacgggtaacctaacggtcggtaacgtacgtaaccgtaaccgtacgtcggtacggtcgtaccgtaaccgtacgttacgttcgtcggtttaccttaccgtacgttacccgtcccgtacc

SEQ ID NO: 219796 - DNA, 653 bp, Homo sapiens
  misc_feature: GYAE6OF02ISDMV.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccacctgtctgtgtctccgagggaagagcccacctctcctgcagggccagtgagaatgttggcagctaacttagcctcggtaccagtcaacgaaaccgtggaccaggcctccgaggcctcctcctctatcgctgtctccgaccgtaccgggcccctaggtccgtacccgtacgccgtaggtttccggtcggggtcggtgggtcgtgggactacggtctttcacttcgtaccactatcgagccgtcctacgacgtacctagtaacgtctttcgtctactttactttctcgtacttaactatagttgtcgtactcgtcctaccgttacgttaccgtttcggaccgtaacggggtaacctaaacggtacggaacgtaacgtaaaccgaacggtaacgtcgggttaacggtaccgacggtaccctaaccgttaacgttcggttaccgtttccttacgtaccctttcccgttaccccgtaaccg

SEQ ID NO: 219797 - DNA, 704 bp, Homo sapiens
  misc_feature: GYAE6OF02J13IE.24.87.H10.1.454.CMB.1.raw
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaangccaccctctcctgcagggccagtgagatgttggcagcaacttgcctgtaccngcagaacctggccagctccaggctcctcctcancgctcgtcctccaccgacgggcccctggtcncccgacggtcccgtaggttcgttcggggcggttcggggtcgtgggactacggtactttcgaccttccgtacaccgtattccgacggtccggtccctaccggacgtcctaggtaacgttagttttcggtaccggtttactacgtcggttacgacggttccgtacggtccggtttcccgtcggttcgggccccgttacggttacccggtttaccggggcccgggggtaaccgtgggggtacggtaacgggaacgggtacggaacggttaacgggtcggtcggggtacgttccgggaacccgttaccgttacgtaccggtttacggttccgtttaaccgtaccggtttcccggttacccccggtactacggtttacccgtaaccggg

SEQ ID NO: 219798 - DNA, 635 bp, Homo sapiens
  misc_feature: GYAE6OF02FW4R1.24.87.H10.1.454.CMB.1.raw
  modified_base (204)..(204): a, c, t, g, unknown or other
  misc_feature (204)..(204): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatggttggcagcaacttagcctggtaccagcagaaacctggccaggctcccaggcctcctcctctatcgctcgtcctccaccgtacgggcccctggtcgtcccagtcctaggttcgtggtcggtgggtctgggactagtnttcactctcacatcacgcgcctccagtctagaagtntttcgctactttatttctgttacaactacttagtcggtacgtacgtcggtaccttccgtaacttaccgttttcggaccgtacggggtaaccctaaacggtacggtaacgtacgtaaccgtaaacgtaacgttacggtacgggtaccttacgggaccctaaccgttaaccgttaccgtttccgtttacccgtttaccgtaccgtttaccccgttcccccggtaacccg

SEQ ID NO: 219799 - DNA, 677 bp, Homo sapiens
  misc_feature: GYAE6OF02F1HWH.24.87.H10.1.454.CMB.1.raw
  modified_base (202)..(202): a, c, t, g, unknown or other
  misc_feature (202)..(202): n is a, c, g, or t
  modified_base (406)..(406): a, c, t, g, unknown or other
  misc_feature (406)..(406): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctcagccaccctgtctgtgtctccaggggaagngccaccctctcctgcagggccagtgagaatgttggcagcaacttagcctggtaccagcagaaacctggccaggctcccaggcctcctcctctatgctcgtcctccaccacgggcccctggtcgtcccagccgtaggttcgttgggcggtgggtctgggacagtactttcacgtctcacctatcgagcgcctcagtctagaagtntttgacttactttactttcgtgttacctaactaccttagttacgggttcgtaaccgtttcgggtaccctttacccggttaacgttaccttttttacggggggggacccttaacggggggttaaccctaaaccggttagggtaacggtaacgttaaccgtaaaccggtaacgttaccgggttaacgggtcgttaacgggtaccctaacccgtaacgttccgtttaccggtttaccttacccgttaacccgtttcccgttacccccggtaccc

SEQ ID NO: 219800 - DNA, 704 bp, Homo sapiens
  misc_feature: GYAE6OF02INZYG.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaagacgccaccctctcctgcagggccagtgagaatgttggcagctaacttgcctggtaccagcacgaaacctggccaggcctccgaggcctcctcctctatcgctgtccctccaccgacgggcccctggtccgtcccgagccgtagggttcggttcgggcggtcggggtctggggactagtactttcgacctctacacctatcgacgccgtcctccgtacgtacgtacgaagtacgttttacgccttacgttttactttacgtacgttacctaaaccttacttaacgttcgggttacgtaccgttcgggtacccgttccgttaacccgtttaccgtttttaccggggacccggttaaccggggtaacccttaaaacggtacgggttaaccgtaacgtaaccggtaaaaccgtaacggttacgggtacgggtacctacgggtaccctaaccgtaacgtttccgttcgtttaccttacggttaccttaccccgttaccccgtacccg

SEQ ID NO: 219801 - DNA, 753 bp, Homo sapiens
  misc_feature: GYAE6OF02FVTRB.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaangccaccctctcctgcgagggccagtgagaatgttggcagcaacttgcctgtaccagcagaaacctggccaggcctccgaggcctcctcctctactcgcttcgtcctacccgacccgtacgggtcccccttgggtccgtccccgaacggtccccgttagggtttccgggttcgggggtccgggttcgggggttccgttacgggggaactaagggttacttttaccgaaccgttcctaccgaaccctacgttaccgacgggtcccgggtaccctacccgtaggttaccgttaagggtaaacgtttacgttttttacggaccttttaaaccgtttttagttttacccgttacggtttaccttaaaaccttaacgttaacgtttcgggttacgtaccgtttccgggttcccgttaacccggttaccgtttaccggtttttacggggacccggtaacggggtaaccctaaacggtggtaacgtaacgtaacgaacgtacgtaggtacggtcttcgacctacctacgtcttcgttacctctacttccctaccgtacc

SEQ ID NO: 219802 - DNA, 700 bp, Homo sapiens
  misc_feature: GYAE6OF02H6ZWP.24.87.H10.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (322)..(322): a, c, t, g, unknown or other
  misc_feature (322)..(322): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccaccctgtctgtcgtctaccgaaggggaaacngcccaccctntcccgtgaccagggcctagtcgagaatggtggccagcaacttgcctggtaccagctaagaactcggccaggcctaccccgaggtcctccctcctactagtcncgtcacctcccaaccgcgggtcccctggcgtccccagcccgtagggttccgttgggaccggttgggtaccgttgggacctacggtntttacccagttccctacaacccgatccggnggtcccggccctccgtacgtcgtacgtaagtcgtttagtcctacgtttacttcgtcgtactaactacttagtcgtacgctcggtaccttaccgttaccgtacggttttcggaacccggtaacggggtaacccttaaacgggtacggtaacgtaacgttaacgaaacccggtacgttacgggtaacggtcccgtacggtaccctaaccgtacttccggttaacgttccgtttacccgtaaccgttcccgttaccccgtacccg

SEQ ID NO: 219803 - DNA, 715 bp, Homo sapiens
  misc_feature: GYAE6OF02H1CIO.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagtaagtagtcatgacgcagtctccagccaccctgtctgtgtctccgaggggaacngcccaccctctcctgcagggccagtgagagtgttggcagacaacttagcctggtaccagcagtaacctggaccaggcctcccgaggtcctcctcctacttatcgcctcgtcctcccaccggaccgggtcccctggtccgtcccgagcccgtagggttccggttcgggcgggttcgggtcctaggggactaggtacttttccgaccttctaccgaaccctagtccgacggtcccggtcccgttacccgacgtcgttacggtaagttacgttttacgtacctttaaccttttacgtttaccgttagttaccttaaacctacttacgttcggttacgtacgttccggtcccgttacccgttaccgttaccgtttttacggacccggtacggggtaacccgtaaacggttacggtaacgaacgttaaccgtaaccgtacggtacggtcggtaccgtacggtaccctaccgtacttcgtcgttacctttacgtacctttccccgttacccgtaccc

SEQ ID NO: 219804 - DNA, 541 bp, Homo sapiens
  misc_feature: GYAE6OF02F77R4.24.87.H10.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (398)..(398): a, c, t, g, unknown or other
  misc_feature (398)..(398): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctntcctgcagggccagtgagaatgttggcagcaacttagcctggtaccagcagaaacctggccaggctcccaggctcctcctctatgctgtctccaccacgggcccctggtcgtcccagtccaggttcgttggcggtgggtctgggacagtatttcactctcaccatcagcgcctccagtctgaagtntttgctactttattctgtctaacactatgtgactggtcctccgtactcgtttcggccgtacggggaacctaaacgtcggagactacgaaacgtactcggtggctcgacacctatcgttcgtccttctacttccgttcccgtcc

SEQ ID NO: 219805 - DNA, 649 bp, Homo sapiens
  misc_feature: GYAE6OF02F596W.24.87.H10.1.454.CMB.1.raw
  modified_base (155)..(155): a, c, t, g, unknown or other
  misc_feature (155)..(155): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (607)..(607): a, c, t, g, unknown or other
  misc_feature (607)..(607): n is a, c, g, or t
tcagactactatgtcacgaccggtgctcgatttagcagtactgcggttgggtttgggggaggaactgctcagttaggacccagacggaaccatggaagccccagcgcagcttctcttcctcctgctactctggcttcccagataccactgggtanaagtagtcattgacgcagtctcagccacctgtctgtgtctcgaagggaagcgccacctctcctgcgagggccagtganatgtgcagcaacttgctgaccngcagaacctggaccaggcctaccgaggtcctccctcctacgtactcgtctcggtcctcccgaccgcgggtccccttggtctcccgtagccgttaggttccggttgggccggttgggtcgtacggggacaggtttacgtttccgactccgtaccactagtccagggtcccgtccgtccgtagtaccgtagtaacgtattttcgctttaactttctttcgttagtacctaactacttagttcggtacgtacgtcggtccttaccgttacgtacgtttcgggacgtacgggtaactaacggtgaacgtactaacgaacgtacgttcggtacggtaccgtacggtaccctaacgtnttacgttcgttccttacgtaccgttccgttaccccgtaaccg

SEQ ID NO: 219806 - DNA, 708 bp, Homo sapiens
  misc_feature: GYAE6OF02GRIQW.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaagacgccaccctctccgtgcagggccagtgagatgtggcagcaactagcctggtaccagcagaaacctggaccaggcctcccgaggcctccctcctctacgtcgtcttcgttcctcccacccgtacggggtcccccttagggttaccgtccccgacggtccccgtacgggtttccggttacggggtcgggttcggggttcgtacggggaccgtaggttacgtttccgaacttcctacccgtaccacgttcccgaacggtcccgggtccctaccgtacgttcgttaacggtaaacggttactttttcgtaccttacttttactttccttacgtactaacctacgttagttacggtacgtacgttcggtcccgttacccggttacttaccggttttccggaaccggtaccggggtaaccgtaaagtcggtaagacgtaacgaacgtacgtcggtacgtccgtacgacctacgtacgtcgttacgttccttacgacgttcctcccgtacc

SEQ ID NO: 219807 - DNA, 631 bp, Homo sapiens
  misc_feature: GYAE6OF02FL356.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccacctctcctgcagggccagtgagatgttggcagctaacttgcctggtaccagcagaaacctggaccaggctcccgaggtcctccgtcctctatcgctgtcctaccgaccgacgggtcccctgggtcgtccccgagcccgtagggttcgttcgggcgggttgggtcgttgggactaggtactttcgacttctccacatccgacgccgtccctaccgagtcgtacgtaagtacgttttgacctttacttttatttccttcgttacaaacctacttagtcggttgtaccgtcggccctttccgtaaccgttccgttttcgggaccgtaacggggaacctaacgtggacgtactacgaacgtacgtaggtcggaccgtggtacccactagttccgtcgtttacttcctacgtttcccttcccggtaccc

SEQ ID NO: 219808 - DNA, 595 bp, Homo sapiens
  misc_feature: GYAE6OF02FX2Q0.24.87.H10.1.454.CMB.1.raw
  modified_base (204)..(204): a, c, t, g, unknown or other
  misc_feature (204)..(204): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagatgttggcagcaattgcctggtacagcagaaacctggccaggcctcccaggcctcctcctctatgctgtcctccgaccacgggcccctggtcgtcccagcctaggttcgtggcggtgggtctgggacngatttcactctcacntcgagcgcctcagtctgaagtntttgcttactttatttctacgttacaactacttagtggtgtaccgtcggtccttccgtacgttaccgttttcggacccggtaacggggtaccctaaacgtacgggtaacgtacgtaaccgtaacgtaaccgtaggtacggtactaccggaccaaccgtattccgttacgttcctttacctacttcccgttcccgtaccc

SEQ ID NO: 219809 - DNA, 657 bp, Homo sapiens
  misc_feature: GYAE6OF02GBE8G.24.87.H10.1.454.CMB.1.raw
  modified_base (206)..(206): a, c, t, g, unknown or other
  misc_feature (206)..(206): n is a, c, g, or t
  modified_base (335)..(335): a, c, t, g, unknown or other
  misc_feature (335)..(335): n is a, c, g, or t
  modified_base (387)..(387): a, c, t, g, unknown or other
  misc_feature (387)..(387): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtgtctccgaggggaaagngcctacctctcctgcaggccagtgagaatggttgcagctaacttgcctggtaccagacaacgaaacctcggaccaggcctccgaggtcctcctcctctatcgctcgtcctccgacgcgggccctggtcnccagtccgtaggttcgtggtcggtggtcgtggacagtcttcactctacactntcgacgccgtcctccagtctagtaacgttcgtttcgacctttactttacttcgtacttactaactacttagtcggtacgtaccgtcggtacccctttcggtaacctttaccggttttacggacccggtaacgggggtaaccctaaacggttacgggaacttaacgttaccggaaacttacggtacggttacggtacgtacgggaaccttaaccgtacgtttaccgttccggtttaccttaccctaccggtttcccctaccccgtaacccg

SEQ ID NO: 219810 - DNA, 570 bp, Homo sapiens
  misc_feature: GYAE6OF02FWCIG.24.87.H10.1.454.CMB.1.raw
  modified_base (204)..(204): a, c, t, g, unknown or other
  misc_feature (204)..(204): n is a, c, g, or t
  modified_base (398)..(398): a, c, t, g, unknown or other
  misc_feature (398)..(398): n is a, c, g, or t
  modified_base (437)..(437): a, c, t, g, unknown or other
  misc_feature (437)..(437): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgccagggccagtgagaatgttggcagcaacttgcctggtaccagcagaaacctggccaggctcccaggctcctctctatgctgtcctccacgacgggcccctggtcgtcccagcctaggttcgtggcggtgggtctgggactagatttcactctcacatcagccgcctccagtctgaagtntttcgacttactttattctgtactaactacttagtggtnacgtcgtccttccggtacttcgttttcggccggtaacgggaacctaaacgtcgggaatacgtacgtaacgtacgtaggtacggcgtacgacctaccgtatcgtcgttaccttcgtacttcccttcccgtaccc

SEQ ID NO: 219811 - DNA, 572 bp, Homo sapiens
  misc_feature: GYAE6OF02JV6N2.24.87.H10.1.454.CMB.1.raw
  modified_base (128)..(128): a, c, t, g, unknown or other
  misc_feature (128)..(128): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (541)..(541): a, c, t, g, unknown or other
  misc_feature (541)..(541): n is a, c, g, or t
  modified_base (552)..(552): a, c, t, g, unknown or other
  misc_feature (552)..(552): n is a, c, g, or t
tcagactactatgtcacgaccggtgctcgatttagcagtactgcgttgggtttggggggaggaactgctcagttaggacccagacggaaccatggaagccccagcgcagcttctcttctcctgctacnctggcctccagatccactggagaagtagtcatgacgcagtctccagcccaccctgtcctgtgtctccaggggaaaagcgccacccctntccctnccgaggggcccaagttggacaatggtttgggaccagacctaactttaggccctggtacccagcagaaaacctggccaggctcccngctcctcctctatgctgtctccaaccagggtcccctgggtntccccaagccccgtaggttcggttggcggtgggtcctgggacagactttcactctcaccatcgancggctccagtctgaaantttgcacttntttcgttcaanactngtagcnggtctccgtactacgtttttcggaccaaggggaaccaaaactggagactacaaacggaacnggttcggntcggcctaacncttacgcgttntttcaacttcttccccggcc

SEQ ID NO: 219812 - DNA, 741 bp, Homo sapiens
  misc_feature: GYAE6OF02IH16T.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctcagcccaccctgtctgtgtactccgaaggggaaagcgccacccctctccgagcgagggccaggtgaacgtaattggtaggcaggctaaacgttgccgtaggtaccagacaacggaaaccgcggaccgacggtacctacccggacggccttccctacctcctagtccgtctcgtcctccgaaccgtcgggcccctggtcgtacccacgccggtacggttcggttcggggcggtacgggttcggacgggtacgaggttacgttcgtaacgttccgtacctaccgtacgtacgaccggtccggttcccgtacccgtacgtacgtaggtacggttacgtttacggtacctttaacttttcgtttacttcgttactaaacgtacttacgtacggttacgtacgtccggttccgtttacccgtacgtttccggttttacggaccggttaacgggaaccgtaacgtaggtaaccgtacgtaaccgtaacgtaacggttacggtcgtaccggtacctaacgtacccgtacgttacgttccggttaccttaccttaccgtttaccccgtaccgtacccg

SEQ ID NO: 219813 - DNA, 698 bp, Homo sapiens
  misc_feature: GYAE6OF02ILULD.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaangccaccctctcctgcagggccagtgagaatgttggcagcaacttgcctggtaccagcaagaacctggccaggctccaggctccctcctctatcgctcgtcctccaccgcgggtccccctggtcgtccccaggccctagggtttccggtgggccggttgggtcgtggggaccaggtactttccgacttcctcgacctagtccgacggccggtccctccgtacgtccgttaggtaaacgttactttttacggacctttacgttttaacttttccgttacgttacctaaccgttacgttaacgtttacggttcggtaaccgttcgggtacccgtttaccgttaccgttaccgtttttccggaccgtaacgggggtaacctaaaccggttaggtaacgtaacgttaaccgaacgtaaccgttacggtacggtaccgtacgtaccgtaccgtacttaccgttacgttccttaccgtacgtttcccgttaccccgtacccg

SEQ ID NO: 219814 - DNA, 645 bp, Homo sapiens
  misc_feature: GYAE6OF02F78YO.24.87.H10.1.454.CMB.1.raw
  modified_base (204)..(204): a, c, t, g, unknown or other
  misc_feature (204)..(204): n is a, c, g, or t
  modified_base (377)..(377): a, c, t, g, unknown or other
  misc_feature (377)..(377): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgtggcagcaattagcctggtaccagcaagaaacctggaccaggcctcccgaggcctccctcctctatcgctgtcctccaccgacgggcccctggtcgtcccagtccgtaggttcgttgggccggttgggtcgtgggacaggtntttcactctcaccatcgacgccgtcctccgtagtctagtaagttattttcgaccttactttattcttacgttactaaactacttagttcggttacgtaccgttcggtacccttaccggttacttaccgttttcggaccggtaaccgggtaacctaaacgtaggaacgtacgtaaccgtaaacgtaacgtacgggtcggtaccgtcggtaccctaaccgtacgttccgtacggtttaccttacctaaccgtttcccgttaccccgtacc

SEQ ID NO: 219815 - DNA, 674 bp, Homo sapiens
  misc_feature: GYAE6OF02F0N9M.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaagagccaccctctcctgcagggccagtgagaatgttggcagcaacttagcctggtaccagcagaaaccgtggaccaggcctccccgaggcctcctccctctatcgctgtcctcccaccgacgggccctggtcgtcccagccgtaggttcgtgggcggtgggtctggggacgtagtactttcgactcctccaccgtatcgacgccggtccctccgtacgtccgtagtaacgttagttttcgtacttaacttttacgtttccgtcgttacctaacctacttaagttgggtacgtacgttccggtcccgttacccgttaccgttacgtttttccgggaccggtaacggggtaacccgtaaacgtagggacgtaacgtaccgaaacggtaacgttaccgggtggtaccgtacggtacccaacccgtacgttccgttacgttaccgtttaccgtaccgtttcccttcccccggtaccc

SEQ ID NO: 219816 - DNA, 634 bp, Homo sapiens
  misc_feature: GYAE6OF02I5XV2.24.87.H10.1.454.CMB.1.raw
  modified_base (220)..(220): a, c, t, g, unknown or other
  misc_feature (220)..(220): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (488)..(488): a, c, t, g, unknown or other
  misc_feature (488)..(488): n is a, c, g, or t
  modified_base (585)..(585): a, c, t, g, unknown or other
  misc_feature (585)..(585): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccacgtggagaagttagcatgacgcagtctccagccaccctggtctgtgtctccgaggggaaacgcctaaccctctccngacagggtccagtgagactgttggacatcgaactntccgngtaccngacacgaaaccgtggaccctaggcctcccgaggcctcctccttntacgttcnccgtgttccacccacgccgggtccctgtaccnccgagccgtaggttcgtcgggcgtggtatcgggaatgtnttcncgtctacaccntccggngtcgcccttacgacgtcgttaaacggatttcgtttgtacctttattttacggttcttcgtaaactacttacggtttgngtttacgcgttccggtaactccgttacttccggtttaagcccggaaggtacctaaaggtccgtaaaaggctaacgtaacgtcgtcggttcggaaccncgtaaccgtacttcgttcgttcttaccgttacctcgttcccgtcctaac

SEQ ID NO: 219817 - DNA, 717 bp, Homo sapiens
  misc_feature: GYAE6OF02GN6TS.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccacctctcctgcagggccagtgagatgtgcagcaactgcctggtaccagcagaacctggccagctccgaggctcctcctctatcgcttcgtctccgaccgacgggcccctggtcgtcccagcctaggttcgtggcggtgggtcgtgggactagtactttccgacttctacgacctattccgacggtcccggtccgtcccgtacgtccgtacgtaacgttacgttttcgtaccgttacgttttacttttccgttacgttaccttaaacctacgttaacgttcgggttacgtaccgttacgggttacccgtttacccggtttaaccgttaccggttttttaccgggacccggttaaccgggggtaaacccgtaaaccggttacgggtaacgtaacgttaaccgtaaaccgttaaccgttacggttaacgggtacgttaccggtaccgtaacccgtaacgtttccgttacgtttaccgtttacccgtaacgttttcccgtttaccccgttacccg

SEQ ID NO: 219818 - DNA, 659 bp, Homo sapiens
  misc_feature: GYAE6OF02IYULI.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaangccaccctctcctgcagggccagtgagaatgtggcagcaacttagcctggtaccagcagaaacctggccaggctcccgaggcctcctcctctatgctcgtcctcccgaccgtcgggcccctgggtcgtccccagtcccgtagggttcggtggggcggttgggtcgtggggacaggtctttcactctcacctatccgacggtcccggccctaccgacgtcgtaggtaacgttacttttgtacctttacttttatttcgttcgttacctaaacgttacttagtacggttcgtaccgttcggtcccgttaccgttaccgttaccgttttcgggacccggtaacggggtaaccctaaacggtacggaagtacgtaaccgtaaacgtaacgtcggtacggtccgtagaccctaacgtacttccgttacgttccttaccgtacgtttcccctacccgtaccc

SEQ ID NO: 219819 - DNA, 683 bp, Homo sapiens
  misc_feature: GYAE6OF02I27R0.24.87.H10.1.454.CMB.1.raw
  modified_base (152)..(152): a, c, t, g, unknown or other
  misc_feature (152)..(152): n is a, c, g, or t
  modified_base (207)..(207): a, c, t, g, unknown or other
  misc_feature (207)..(207): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactgganaagtagtcatgacgcagtctccagcccaccctgtctgtgtcctccgaggggaaancgcctaccctctccgtgcgagggccagtagagaattggttggcagacctaacttacggcctaggtacccagccaagaaccgtggccaggcctcccgagcctaccctcctctagtcgtctcgtcctaccctaccgaccgggtccccttggtccggtcccacgtccggaggtttcggtcgggcggttgggtccgtaggggactacggtactttccgacttcctacaccctatcgacgccgctaccngtctagtacgtntttcgcttactttacgttctcgtactacgttaccttagttacggtcgtacgtccggtacctttaccgtaccttacgtttcggaccgtaacggggtaacctaaccggtaggtaactaacgtacccgtaacggtaaccgttacggtaccggtactaccgtaacccgtaccgtaccttacgttaccgttaccgttaccttaccgttccccgttaccccgtacc

SEQ ID NO: 219820 - DNA, 590 bp, Homo sapiens
  misc_feature: GYAE6OF02GK3MZ.24.87.H10.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccaccctctcctgcagggccagtgagaatgttggcagcaacttagcctggtaccagcagaaacctggccaggcctcccgaggctcctcctctatgctgtcctccaccgagggcccctggtcgtcccagcctaggttcgttggcggtgggtctgggacagtctttcgacttctcgaccatcagccggcctccgagtctgaagtntttgctactttattctgtctaactacttagtgtntacgtggccttcgtacctacgttttcgggaccgtaggggtaacctaaacggttggaacgtacgtaccgaaacgtaacgttggtacggcttacggacccgtacctagttccgtacggtttccgtttacacgtttccccgtcccgtacccg

SEQ ID NO: 219821 - DNA, 773 bp, Homo sapiens
  misc_feature: GYAE6OF02JB2AP.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccaccctgtctgtgtctccagggaagagccaccctctcctgcagggcacgtgagaatgttgcagctaacttagcctggtaccagcaacgaaaccgtcggacacggcctcccgaggcctccctcctctacgtgtctcgtcctcccaccgtacgggccccgtggtcctcccgtacgccgtacggttcgttcgggtcggttcggggtcgtacggggtacacgggtactttacgtaccgttccgtacctaccctacgtaccgtacgggtccggtaccccgttacccgacggtttaccggtacgggttaaacggttacgttttttacggacctttaacggttttttaccttttaccgtacggtttaaccaaacctttaccgtttaacgttagggttaccgtaccggtttccggtacccggtttaccgttaccgtttaaccggtttttaccgggcccggaaccgggggttaaacccaaacgggttcgggtaaacgtataaacccggtaaccggtaacgttcggggtacgtaccggtagtaccgtaaccgttagttccggtttacgttaccgttccggtaacctttcccgttaccccgtacccg

SEQ ID NO: 219822 - DNA, 624 bp, Homo sapiens
  misc_feature: GYAE6OF02I9263.24.87.H10.1.454.CMB.1.raw
  modified_base (206)..(206): a, c, t, g, unknown or other
  misc_feature (206)..(206): n is a, c, g, or t
  modified_base (338)..(338): a, c, t, g, unknown or other
  misc_feature (338)..(338): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaancgcccaccctctcctgcagggccagtgagaatgttggcagactaacttagccttggtaccagacagaaacctggaccaggcctcccaggcctccctcctctatgctgtcctccaccgacgggcccctggtcnccgagcctaggttcgtcggcggtgggtcgtggacagtctttcgactctcacctatcacgcgtcctccagtctagaagtactttgacttactttcttctacgtactaactacttagtcggtcgtacgtccggtaccttccgttaccttacggttttcgaccggtaccggggtaacctaaacgtcggaagtacgtaacaaccgtacgttacgggtcggtacctacggtaccctaaccgtacgttaccgttcgttcccgttactcccgttacccgttccccgtaacccg

SEQ ID NO: 219823 - DNA, 268 bp, Homo sapiens
  misc_feature: GYAE6OF02GRNJ5.24.87.H10.1.454.CMB.1.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (255)..(268): a, c, t, g, unknown or other
  misc_feature (255)..(268): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtgactggcctccgtacacttttggccagggggaccaaactggagatcaaacgaactgtggctgcaccatctgtcttcatcttcccgcatctgaacatagtagtctgagcggntggcaaggcncatagnnnnnnnnnnnnnn

SEQ ID NO: 219824 - DNA, 645 bp, Homo sapiens
  misc_feature: GYAE6OF02HNKYE.24.87.H10.1.454.CMB.1.raw
  modified_base (202)..(202): a, c, t, g, unknown or other
  misc_feature (202)..(202): n is a, c, g, or t
  modified_base (382)..(382): a, c, t, g, unknown or other
  misc_feature (382)..(382): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaangccaccctctcctgcagggccagtgagaatgtggcagcaattagcctggtaccagcagaacctggccaggtctcccgaaggcctcctcctctacgtgctgtcctcccaccgacgggcccctggtcgtcccagcccgtaggttcgttggcggtggtccgtagggactgtacttcacgttcncgacatcgacgtcgccctcgtagtcctagtaagtagttttcgtcttaacttttatttccttacggtacctaactacttagtggttacgtccgttacggtcccgttacccgtaccgtttaccgtttacgggtacccgtaacgggggtaaccctaaacggtaggtacggaacttaaccgaaaccggtacgttaccggtacggcctacggaccgtacccgtacgttcgttacgttccgtttacctaccgtttcccgtcccgtaccc

SEQ ID NO: 219825 - DNA, 726 bp, Homo sapiens
  misc_feature: GYAE6OF02HYU1N.24.87.H10.1.454.CMB.1.raw
tcagactactatgtcacgaccggtgctcgatttagcagtactgcgttgggtttgggggaggaactgctcagttaggacccagacggaaccagtaggaagccccagcgcagcttctcttctcctgctactctggcctccagactaccactggagaagtagtcatgacgcagtctccagccacctgtctgtgtctccgagggaaacgcgaccaccctctccgtgcgagggcccagtgacgtaatgttggacagctaacgttgccgtacggttaaccgagacgaaggaaccgtcggacctaggcctacccgagcctccctcctcttagtcgcgtcgtctcccaccgcgggtccccgtggtccgtacccgacgtcccgtagggttccgtcgggtcggttcgggtcgtcggggaactacggttacgtttccgaaccgttcgtaccaacgtacgttccgacggtcccggtacccttaccgacgttacgtagtaaacgtagttttcgactttaacgtttacgttccgtagttaacctaaacgttactacggttagggttaacgtccggtaccggtcccttacccggttaaccgtttaccggttttacggaacccggtaagggtaacctaaacgggtgaacgtaccgtaacgaaacgttacgtacggttacggtcctacgtacctaaccgtcgttacgttcgttacccgttactccgttccgttaccccgtacg

SEQ ID NO: 219826 - DNA, 715 bp, Homo sapiens
  misc_feature: GYAE6OF02GYU13.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggagaagtagtcatgacgcagtctccagcccaccctgtctgtgtctaccgaggggaagacgcccaccctctcctgcgacgggccagtgagaattgtggcagctaacttgcctaggtaccagacaacgaaaccgtcggccgaggccctacccgaggccttccctcctctactcgtctcgtccctacccgaccgaccgggtccccgtggtccgtacccaccggtccgtacgggtttccggtacggggtcgggttacggggtcgtacggggacgtacgttacgtttacaccgttctaccgacctacgtcgaccggtccggtccctaccgtacgttccgtaagttaacggtttactttttacgacctttaacgtttttactttccgttacgttaacctaaacgttacttaggttcggttacgttaccgtccgggtccttacccgttacgttaccgtttcggaaccggtaacgggtaaccctaacggtggaaacgtactaacgtaaacgtccgtaggtcgtactcgacctacgtgttcccgtggttaccttacgactttacccgtcccgtac

SEQ ID NO: 219827 - DNA, 702 bp, Homo sapiens
  misc_feature: GYAE6OF02GXH1I.24.87.H10.1.454.CMB.1.raw
  modified_base (211)..(211): a, c, t, g, unknown or other
  misc_feature (211)..(211): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactgggacgaaggtacgtcatgacgcagtcctccagcccaccctgtctgtggtcctccgagggaaanacggcccaccctctcctgcgacgggccaggtagagaatcggtaggctaggccaacttagcctaggtaccagacaggaaacctggacctacggcctacccaaggtcccctaccgtccctctactcgtactcggtcctacccaccgacgggcccctgggtcctcccgaggtccctaggtttccgtggtccggtgggtcctcgggactagtacgtttccaactctacacctacttccgacggtcccgacctccacgttcgtaacggtaacgttacgtttcgtacgtttacgtttactttccgtacgttacctaaaccgtacttacgttaggtacgtaccgtcggtcccgttaccgttaccgttaccgttttcggaccggtaccgggtaacctaaacggtgtaacgtaccgtacgaacgtacgtacggtacggtccgtacggtacctaccgtacgtacgttccgttacgttacctacccgttccgtcccgtaccg

SEQ ID NO: 219828 - DNA, 529 bp, Homo sapiens
  misc_feature: GYAE6OF02F56NA.24.87.H10.1.454.CMB.1.raw
  modified_base (398)..(398): a, c, t, g, unknown or other
  misc_feature (398)..(398): n is a, c, g, or t
  modified_base (514)..(514): a, c, t, g, unknown or other
  misc_feature (514)..(514): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggcctcctcctctatgctgtctccaccagggcccctggtcgtcccagccaggttcgtggcggtgggtcgtgggacagtattcactctcaccatcacgcggcctccagtctgaatnttttgctactttattctgttcaactactatgtgactggtcctcgtactcgtttggcctacggggacctaacgtggatacgtacaacgactaggcgctgaccactatcgtgtccttncttccttcccgtacc

SEQ ID NO: 219829 - DNA, 653 bp, Homo sapiens
  misc_feature: GYAE6OF02FYTVJ.24.87.H10.1.454.CMB.1.raw
  modified_base (205)..(205): a, c, t, g, unknown or other
  misc_feature (205)..(205): n is a, c, g, or t
  modified_base (480)..(480): a, c, t, g, unknown or other
  misc_feature (480)..(480): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggggaaancgccaccctctcctgcagggccagtgagaatgttaggcagcaacttgcctggtaccagcagaaacctggccaggctcccaggcctcctcctctatcgcttcgtctccgacccgacgggcccctaggtccgtcccaggcccgtaggttccggtgggccggtggggtccgtgggggacagtactttcgaactcctacgaccatcgacgccggcctccagtctagaacgtatttcgcttactttatttctacgttactaacctacgttagtcgggttntaccgttcggacccgtttccgttaaccgttacgtttttaccgggaccgttaacgggggtaaccctaaacgtacgggacgtaactacccggaaacgtaccgttagggtcggtaccgtcgaccgtaacctacgttacgttaccgttccgttacgtacccttccgttccctacccg

SEQ ID NO: 219830 - DNA, 567 bp, Homo sapiens
  misc_feature: GYAE6OF02ID4EI.24.87.H10.1.454.CMB.1.raw
  modified_base (188)..(188): a, c, t, g, unknown or other
  misc_feature (188)..(188): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (518)..(518): a, c, t, g, unknown or other
  misc_feature (518)..(518): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccatggagaagtagtcatgacgcagtcctcagccacctgtctgtntcacgagggaaagcgccaccctctcctgccgaggccagtgagatcgtggcagactaacttatccgtggtaccagacaagaaacctggccaggctcccgagctccncatctaagtcgaatcgtcacacgaggttcaacgtgcctcccgcacggttanacgtggnacggtggtctagggactaagtactaccgtactccgtctattacataccgagtacacgtaggaccacgtaagtatttcggatagtagttatactgttacacgtgtcgtttcgcccttctctactatacgttacttcttacggcgtaacgggtcaggtacgtacggganaagttccgaacgtacgtaggtctacgggccttaggcctaacctgtaccg

SEQ ID NO: 219831 - DNA, 725 bp, Homo sapiens
  misc_feature: GYAE6OF02GXLT1.24.87.H10.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (411)..(411): a, c, t, g, unknown or other
  misc_feature (411)..(411): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctccagagaccaccggagaacttgtgttgacacagtctccaggcacctgtcttgctcgaggganagcnccacctntctgcaggccagccgagtgtagtaagtactggctgtaccaanacgaaactgacaggcaccgagctcncgatctatgattnacctcgaacgnggttacacgtcgtcccgtacccgcacggttcaacggtgggtaccgtggttcgggtatcgggaaccacggtacctacaccgttcaccgtccgtaacgacgcgaacgtcgaacgngtacccgtaggaaacgttcgttttacgtaccggtttacttaacgtcgttaccaaaggtcccgtaacggttcctttacccgggacccgttcgggacccgttaacctttaaacccggggtttcggggggtaacccggggggtaaccctaaggggggttgggaacgggttaaaccggggtaacgaccgggttaaacccgttggttaccggggacgttcggtaccaaccggtaccgttcgttaccgttccgtttaccggtaacgttcccgttaccccgtcgttaaccgtcctttaaccggtaccgttaagttaacggg

SEQ ID NO: 219832 - DNA, 694 bp, Homo sapiens
  misc_feature: GYAE6OF02I17BW.24.87.H10.1.454.CMB.1.raw
  modified_base (207)..(207): a, c, t, g, unknown or other
  misc_feature (207)..(207): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatcgaccaccggagactattgtgtgacactagtcctaccagccacctgtctttagctaccgagggaancgccaccctctacctgcgaggccagtgacaatgttaggagttgtacgccgtagtataccaacgaacaaacagtacggaccacggcctacccccggcttacctacctattactacgtgtactcgactactaccgaacggtacgggaccacgtacggactaccgtaccgagtacgtaggtacgngtacgganacgggtggttccgagggactagtaccttacacgtctaccctacgtacacgagtactaggtagtacgacgtacgtagtaacggttatttacggagttacttttagtattcgttacgacgttaacctacggtaacgaatacggtacccgttacccggttaccggtttccgggacccgttagggtacctacgacgttacccgaacgtaacgtaaccggtaaaccgtcggtacgggtaaccgtccgtaccggtacccgaacttaacccggttcgttaaccgttttacctaccttaaccccg

SEQ ID NO: 219833 - DNA, 889 bp, Homo sapiens
  misc_feature: GYAE6OF02F2I8V.24.87.H10.1.454.CMB.1.raw
  modified_base (330)..(330): a, c, t, g, unknown or other
  misc_feature (330)..(330): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccaccctgtctgtgtctcgaggggaagacgccaccctctcctgcgacgggccaggtgagaatgtggcagacctaactgccgttggtaccagcaacgaaaccgtcggccgaggtcctcccgaggtcctcccgtcctctagtcgtctcgttcccncccgaaccgtaccggggtccccttagggtccgtacccccgacggtaccccgttaggggtttccgggtttgggggtaccgggggtttcgggttaccggggttacgggggaacccgttaagggtttacttttaaccggtacccttacccgttaacccgtaaccctaacgttaccgggaacccggtccgggttacccccgttacccggtaacggttacccgttaacgggtaaaccggtttaacgttttttacggtacccttttaaacgttttttaccgttttacgttaccgggtttaaccttaaacccgttaacgtttacgtttacgggttacgtaccggtttacgggttccctttacccggttaccgtttaccgtttttcgggaacccggttaaccggggtaaacccgttaaccggtacgggtaacctaaccggttaaccgtaaaccgttaacggtaccgggtttaacgggccgttaaccggttaccgtaacccgttagttacccggtttaccgtttacccgttaccgtttacccgtttacccgtaccccccgtttacccg

SEQ ID NO: 219834 - DNA, 737 bp, Homo sapiens
  misc_feature: GYAE6OF02FFCPM.24.87.H10.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagactactatgtcacgaccggtgctcgatttagcagtactgcgttgggtttggggaggaactgctcagttaggacccagacggaaccatggaagccccagcgcagcttctcttcctcctgctactctggctcccagataccactgganaagtagtcatgacgcagtctccagccaccctgtctgtgtctccaggggaangccacctntcctgccagggccagtnagatgttgcagcaattgcctggtaccagcagaacctgccaggctcccaggctcctcctctatgctgtctccaccagggccccctggtgtccccagtccctaggttcgttggcggttgggtctgggtacctaggactttcgacgttcctccgaacccgtaagtccgaagtcccgggtacccgttacccctaacggttccttcggtaaacgtaacgttttttcgggaccttaaccgtttttaacgtttccgtacggttacctaaaccgtacccgtttaagttcggttacgtacgtttccgggtacctttacccggtaacttacccgttttttacgggacccttaaggggggtaaccccgtaaaacgttcggggtaacgtaaccggtttaccgtaaaaccgggttaaccttacgggttacgggtacccgttacggtacccgtaacccggtaagttacccgttacggtttacccgttttaccgtaaccgttcccgtttaccccccggtaaccccg

SEQ ID NO: 219835 - DNA, 573 bp, Homo sapiens
  misc_feature: GYAE6OF02F0WJX.24.87.H10.1.454.CMB.1.raw
  modified_base (204)..(204): a, c, t, g, unknown or other
  misc_feature (204)..(204): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagngccaccctctcctgcagggccagtgagaatggttggcagcaacttagctggtaccagcagaaacctggccaggctcccaggcctcctcctctatgctgtcctccaccacgggcccctggtcgtcccagcctaggttcgtggcgggtggggtcgtcggggactaggtactttcaccgtctaccaccatcgacgccggcctccgagtctgaagtntttgactactttnttctgtcaactacttagtcggtntacgtcggtcccttccgtacttacgtttggccgtacggggaacctaagtcggaagtactaccgaacgtagtcggtacggctgaccactacgtcttcgtcttcacttcccgtacccgtccc

SEQ ID NO: 219836 - DNA, 810 bp, Homo sapiens
  misc_feature: GYAE6OF02H1HL3.24.87.H10.1.454.CMB.1.raw
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (316)..(316): a, c, t, g, unknown or other
  misc_feature (316)..(316): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggagaagtagtctatgacgcagttctccagccacctgtctgtgtcgtcggggaaanagccacctctcctgcagggccagtgagatgtgcagcattgctggtaccagcagaactggcagctccagctcctctntatgctgtcnccaccgacggcccctggtcgtcccngtccgtaggttcgtgggtacggtggtcgtggggactaggttactttacacgttctaccaacctagttaccgacggtccggtacccttaccgtacggttacctacggtaaacgtttacgtttttacggtacctttaaccgtttttaacgtttacccgttacggtttaacctaaaaccgttaaccgtttaacgttcgggtttaaccgtaaccggtttaccggtaccccgtttaaccggttaacccgtttaacccggttttttaccgggaaccccgggttaaaccgggggtaaaccccgttaaaaacgggttccggggtaaaaccggttaaccgtttaaaccggtaaaaacccggttaacccggttacgggtttacccgggtaacccggttaccggtacccggtaaaccccttaacggttccccgttttacgggttacccttttacccgtttaacccggttttcccccgtttacccccggtaccccgtttaaacccg

SEQ ID NO: 219837 - DNA, 805 bp, Homo sapiens
  misc_feature: GYAE6OF02HRIMR.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccaccctgtctgtgtctccgaggggaaagagccaccctctcctgcaggccagtgagatgtggacagctaacttagcctggtaacccagaccgaagaaaacccgttcgggacccgacgggccctcccccgaagggtccccttccccgtcccgttaccttaacgttcgtcccgttacggttccccttaccccgaaccccggtaccggggtccccccttggggttccccgttaccccggaaccggtcccggttaacggggttttcggtttcggggaccgggtttcggggtcgtacgggaaccgtaggtttactttccgaccttcctccgtaaaccctactaccgacgggtccggtccccttacgtaccggttcgttaggtaacgttagttttcgtactttaacttttcttttcgttacgtaacctaaacgttacgttagtttcggttcgtaacgttccgggttacccttaacccgtttaacgtttacccggttttcgggacccgtaaggggtaaacccctaaaggtaggaacgtaactaaccggaaaccgtacgttacgggtcgtaccgttacggaccctacgttacttccgttacgttttaccttacgttaccttcccggttacccctacg

SEQ ID NO: 219838 - DNA, 595 bp, Homo sapiens
  misc_feature: GYAE6OF02GA3NK.24.87.H10.1.454.CMB.1.raw
  modified_base (412)..(412): a, c, t, g, unknown or other
  misc_feature (412)..(412): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagaatgttggcagcaacttgcctggtaccagcagaaacctggccaggcctcccaggcctcctcctctatgctgtcctccaccgacgggtcccctggtcgtcccagccaggttcgttggcggttgggtctgggactagtactttcactctcacctatcgacgcggtcctcctagtctagagtntttgcttactttatttcgtgtacctaactacttagttggttcgtactcggtcccttccgtaccttacgttttcgggcccgtacggggtaacccaaacggttcggaagtaactaccgaaacgtacgtaggtcggtactcggaccaccgtagttcctcgttccttcgactttcccgtccctaccc

SEQ ID NO: 219839 - DNA, 692 bp, Homo sapiens
  misc_feature: GYAE6OF02JF84U.24.87.H10.1.454.CMB.1.raw
  modified_base (203)..(203): a, c, t, g, unknown or other
  misc_feature (203)..(203): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcagggccaggtgagatgttggacagcaacttgcctggtaccagcagaaacctggccaggcctcccagggcctccctcctcgtaactcgtctcgtacctccaaccgtccgggcccctggtcctccgacgtccgtagggttccgtgggccgggttgggtactgggacagtagtttcncgtctccaacnctcgacggccggccctaccgtacgtcgtacgtaagtttactttgtccttacttttattccgttacgtacctaacttacttaagttcggttacgtacgtccggttccgttacccgttacgttacccggtttttcggacccggttaacggggaaccctaaacggttcggtaaacgtacgtaacccgtaaacggttacgtacgggttcgggtaccttacggtaccctaaccgttacgtttaccgttacggtttacctttacccgtaacttttccccgttaccccgtaacccc

SEQ ID NO: 219840 - DNA, 542 bp, Homo sapiens
  misc_feature: GYAE6OF02FVYPW.24.87.H10.1.454.CMB.1.raw
  modified_base (252)..(253): a, c, t, g, unknown or other
  misc_feature (252)..(253): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (376)..(376): a, c, t, g, unknown or other
  misc_feature (376)..(376): n is a, c, g, or t
tcagactactatgtcacgaccggtgctcgatttagcagtactgcgttgggtttgggacagatttcactctcaccatcagcggctccagtctgaagatttgcactttatttctgtcaacactatggtgactggcctcgtacacttttggccaggggaccaaactggagatcaaacgaactgtggctgcacatctgtctcatcttccgccatctagacatagtagtctgagcgggctaggcaaggcgcagtagnngcntnacngtcagtctnagcntacgngatncgcngtnctgtacngtctacncacgtcnctgatctacncgtntcgacacgtctcgtacgcgcgtctcgtacgtacgtacgtacgtacgtacgngtacgtacgtacgactacgtcgtacgtacgtacgtacgtcgtacgtacgttacgtacgtacgtacgtacgtacgttacgtcgtacgtacgttacgtacgtacgtacgtacgtacgtaccgtacgtacgtacgtcgtcgtacgtacgtacgtcgtcggtacggtacg

SEQ ID NO: 219841 - DNA, 737 bp, Homo sapiens
  misc_feature: GYAE6OF02IDCPA.24.87.H10.1.454.CMB.1.raw
  modified_base (312)..(312): a, c, t, g, unknown or other
  misc_feature (312)..(312): n is a, c, g, or t
tcagactactatgtcacgaccggtgctcgatttagcagtactgcgttgggtttgggggagaactgctcagttaggacccagacggaaccatggaagccccagcgcagcttctcttcctcctgctactctggctcccagactaccactggagaagtagtcatgacgcagtctccagccacctgtctgtcgtctaccgaggggtaaacagttccaccccgtctcctcggcgaggggcctaggtcgaagaattggttggcacgctaacgttgccgtggtaccgagaccgaacgaaccgtggaccaggcctaccgnggtcctcctctctacgtcgtctagtcctaccaccgtacggtcccctggtcgtacccgtacgtccgtacgggttcgtcgggcggttcgggtacgtacggacgtacgtacttacgaccttcgtaccgtacctacgtaccggacgtcccggtaccttacgtacgttacgtaagttaacgttacgtttacgtactttactttagttcgtacgtaaccttaacgttacgttaggttacggtacgttaccggtaccgtaccggtttaccgttaaccgtttccgtaacgggtacccggtaaccgggtaaccgtaacgttacggaacgttaaccgtaaccgtaaaccgtacggttacggtccggtaccgtcgtaaccctaccgtagttcccgttaccgttactttacccgaccgtttccccgtaccgtaaccg

SEQ ID NO: 219842 - DNA, 598 bp, Homo sapiens
  misc_feature: GYAE6OF02HQ1CY.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgtgcagcaacttagcctggtaccagacaagaaacctgaccaggcctacccaggcctcctcctctatcgctcgtctccaccgacgggccctggtcgtcccacgtcctaggttcgtgggcggttgggtcgtgggactagtattcactctacacatcgagccgctacgagtcgtagtaacgtatttgtacttactttattctgtacaactatagtgtagacgtcgtcctaccgtacttacgtttcggaccgtaacgggacctaaacggtgaagtacgtaacgtaaacgtacgtacggtacggtaccgtgaccctaaccgtattccgttacgttcctttaccgtacgtttcccgttccccggtaaccc

SEQ ID NO: 219843 - DNA, 647 bp, Homo sapiens
  misc_feature: GYAE6OF02HWXNS.24.87.H10.1.454.CMB.1.raw
  modified_base (205)..(205): a, c, t, g, unknown or other
  misc_feature (205)..(205): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagcccacctgtctgtgtctccgaggggaaancgcccacccttctccgtgccgagggccaggtgagagttggttggcagcaacgttgcctggtaccagcaagaacctggccaggcctccgaggcctccgtctctagtgtctcgtcctcccacccgtacgggccccttggtccgtccccgagcccgttaggtttcggtcgggtcggttcgggtcgtgggactagtactttcacgtctacacatcgacgccggtcctcgacgtctacggtaagttcttttcgactttacgtttntttccgngttaacctaactactgttggtcgtactcgggtccttaccgtacttacggtttacggaccggtaaggaccttaacggtaggaagtaaccgtaacgaaccgtagtacgggttcggaccttacggaccctaccgtacttaccgttcgttcccttacgtacctttccccgtccgtaccc

SEQ ID NO: 219844 - DNA, 682 bp, Homo sapiens
  misc_feature: GYAE6OF02FJVGH.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangccaccctctcctgcagggccagtgagaatgttggcagacaacttgcctggaccagcaagaacctggccaggctcccgaggcctcctcatctatgatgcataccaagtcgggcctacgtcggcactccgagacgtaggttcaggtcggacgtaggtcgggtcgtacggggaactacggtacctttcgaaccgttccgtacacccgtacgtacgacgacgtaggtacggtaacggacgtaccgtagggtaacgtttagttttacggacgttttaagttttacgttaccgttgtaccgtacgtacccgtaaccgttacgtaaacccgtaccggttccggttaacccccttacggtttccccgggaccccgttacggggacccgtacggtaaccgtacggtaaccgtaccgttaacccgtaaaccggtacgttacgggtccggtaccgttaccgcccgtaaccgtacgttcccgttaccg

SEQ ID NO: 219845 - DNA, 715 bp, Homo sapiens
  misc_feature: GYAE6OF02ISN95.24.87.H10.1.454.CMB.1.raw
  modified_base (192)..(192): a, c, t, g, unknown or other
  misc_feature (192)..(192): n is a, c, g, or t
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggctcccagataccactggagaagtagtcatgacgcagtcctccagcccacctgtctgtcncctaccgaggggaacacgcccaccctctcctgcaggccagtgagtaacgtggttcggcngctaactcgcctggtaccagcacgtaaccgtggccacggcctaccgnggccctacccgtcctgtactcgtctcgtcctacccacccgtcgggtaccccttggtccgtacccgtacgtcccggtaggttttccgggttcggggtccgggttcggggttaccgtacggggtaacctaggttaccgttttaccgtaaccgttccttacgaacccgtcgtccgtaacgggccccgtaccgttaccgtacgtttacgtaacggtacgttacgttttcggtactttacgtttacttcgtacgtacgtaactcgtacgtgtacgtcgtcgtcctaccgttaccttccggttcgtaccggtacgggtaaccttacggtcggtaaccgtataccgacgtacggtcggtacggttacctaccgtacccgtaacgtcttacggttctacgttccgtacgttacccgtcccgtacg

SEQ ID NO: 219846 - DNA, 786 bp, Homo sapiens
  misc_feature: GYAE6OF02GDKOM.24.87.H10.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctcagccaccctgtctgtgtctcgaaggggaangcccacctctccngcgagggccagtgagaatgttggcagcaacgttagcctggtaccagcaacgaaacctggaccacggcctcccgaggtcctcctcctctatgtctcgtccnccgaccgtacggcccctggtcgtcccgngccgtacggtttcggtcggtcggttcgggtcgtcgggactagtactttcgaccttctaccacctcgtaccgacggccggtcccttaccgacgttcgtaggtaaacgtttcgttttaccgacgtttaacctttttacgtttaccgttacggttaccttaaaccgtttacgtttaacggttaggttaccgtaccggttccgggtttaacccctttaccgggtttaaacctttaccgggtttttacccgggaaccgggttaaccggggtaaacccgttaaaccgggtcgggtaaaccgtaaaccgtttaaccgggaaacccggttaacggtttacgggacgggttacccgttaaccgggtacccctaaccggtttaacgtttacccggtttccggtttaaccgtttacccgttacccgttttaccccggttaccccgttaaccccg

SEQ ID NO: 219847 - DNA, 763 bp, Homo sapiens
  misc_feature: GYAE6OF02HCODT.24.87.H10.1.454.CMB.1.raw
  modified_base (205)..(205): a, c, t, g, unknown or other
  misc_feature (205)..(205): n is a, c, g, or t
  modified_base (566)..(566): a, c, t, g, unknown or other
  misc_feature (566)..(566): n is a, c, g, or t
tcagactactatgtcacgaccggtgctcgatttagcagtactgcgttggggtttgggggaggaactgttcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcgagggccaggtgagaatgttaggcaggactaacttaggccttaggtaccaggaccaacggtaaacctggaccacggccctacccgaggtcctccccgtaccttactacgtcgaccgttcgtcctacccgaccgtaccggggtcccctgggtccctacccgacggtccgtacggggtttccggttacggggcggggtcgggttccggtacggggtacctaacgggttactttaccgaccttcgtacccgtaacctacggtaccgaacggtccccgggtcctaccgacgttcgtaaggtaacgttagttttcgtactttacttttacgtttccgtagtacctaacgtnttaggttcggtacgttacgtcggttacccttacccgttaagtttcccggtttaccggaccggtaacggggtaacctaacggttacgggaaacaaccgttaccgaaaccggttacgttgggtacggtacttacggacctaacccgtattacccggttacgtttaccgttactaccccgttttccgtccccgtattacc

SEQ ID NO: 219848 - DNA, 734 bp, Homo sapiens
  misc_feature: GYAE6OF02I3PES.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctcgagggaagcgccacctctcctgcagggccagtgagagtggttgcagcaacgttgcctggtaccagacaagaacctggccaggcctccaggccttcctacctctacgtgtctcgtcctccaccgacgggtcccctggtccgtcccgacgccgtacgggttcgttcgggcggttcgggtcggtacggacgtacgtactttccgacttaccgccgtaacacttccgaacgggtcccggttccgttcccgggtacgttacggttaaacgtttacgttttacgtaccttttaacgttttacgtttccgttaccgttaccgtaaacttacgtttaggttaccgggttacgttacccgtccggttcccttaaccggttactttacccggtttccgggaacccgggttaaccggggaaaccttaaacgggttggtaaccgtaaactaaccggtaaaccgtacgtacggtccggtaacgtaccgaaccgtaacctaagtttccgtacgttacctttaccggtaaccttccccgttaccgaccgttaaccg

SEQ ID NO: 219849 - DNA, 674 bp, Homo sapiens
  misc_feature: GYAE6OF02FR6T7.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccaggggaaancgccaccctctcctgcgagggccaggtgagaatgttggcagctaacttacgcctaggtaccagccaagtaaacctggccacggctcccgaggtcctcctcctctatcgctcgtacctccaccgacgggtcccctgggtccgtcccgacgtccgtaggttcgtggtcggtcgggtcgtcggtacgtacgtagttctacgtctcgacctacgtcgtagtccggtcccgtcctacgtcgtactaacggttacgtttacgtctttaacgtttcgtttaccgttacgttactaaactaaccttagttacggtcgtaccgttcggtacccgtttacccgttacgtttaaccgtttcggttacccggacgggtaaccgtaacgtacggtaagaccgttaacgtaacgaacgttcgggtgtacgtccggacctacgtacttcgttaccgtttcgttactaccgttacccgtccctaaccg

SEQ ID NO: 219850 - DNA, 814 bp, Homo sapiens
  misc_feature: GYAE6OF02HLUO0.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtcctcgaaggggaagacgccaccctctcctgcacgggccagtgagaagtgttggcagacaacgttacgccgtaggtaaccagacaacgaaaccgtcggaccacggctcccgacggcctcccctcctctacgtcgtaccgttcgtcctcccgaccgaccgggtcccccgttgggtcctacccgacgcccgtacgggttccggttggggccggttggggtcgtcggggtactacggtacgtttccaccgttctaccgtaccctaacgttaccgacggtcccggttacccgtacccggtacgttaccgttacggttaaagtttacgtttttacgtaccgttttaacgtttttagtttaccgtttacgtaaccctaaaccgttaacttaacggttacgggtaacgttaccgttaccgggtacccgtttacccggttaaccgtttaccggtttttaccggggacccgggttaaccgggggtaacccgttaaacggttacgggtaaaccgtaacgttaacccggtaaaaccggtacgtttacgggtaacggtccggttactaaccccggtaactaccgtttaccgttacgttacccgtttaccgtaccgtttacccgtccccgttacccg

SEQ ID NO: 219851 - DNA, 666 bp, Homo sapiens
  misc_feature: GYAE6OF02IA5ZO.24.87.H10.1.454.CMB.1.raw
tcagactactatgtcacgaccggtgctcgatttagcagtactgcgttgggtttgggggaggaactgctcagttaggacccagacggaacatggaagccccagcgcagcttctcttcctcctgctactctggctccagataccactggagaagtagtcatgacgcagtctccagccacctgtctgtgtctccgaggggaaagagtcaccctctcctgcagggccagtgagatgttggcagcaacttgcctggtaccagcagaaacctggccaggctccagctcctctctatgctgtcctccaccgcgggcccctcggtcgtcccagccgaggtttcggttggcggttcggggtctggggacagtacgtttcacttccgtacacctattccgagtcccgggtccctaccgacggtttaccgtacggtaaacggttacgtttttcggtaccgttacttttaacgttttcgttacgtttaccgtaaacttacgttaagttcggttacgtacgtcggtcccgttacccgttaacgttaccgttttcggcccgtaacgggggtaacccaaacggttacggtaagtacgtacgtaacggtaacgttcggtacggtcctacggtacctaccgacgttctacggttcctttacgtacgttcccgttcccgtaccc

SEQ ID NO: 219852 - DNA, 701 bp, Homo sapiens
  misc_feature: GYAE6OF02JELYF.24.87.H10.1.454.CMB.1.raw
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (508)..(508): a, c, t, g, unknown or other
  misc_feature (508)..(508): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtntctaccgaggggaaanagccaccctctcctgcacgggtccagtgagtaatggttaggcagtacctaacgtttagccgtggtaccagcacggaaacctggccgacggccttacccgaggtccttaccgttccttacgtatcgcttacgtcctccgtaccgaccgggtcccgtggttaccgtccccgagtcccgtagggttcggttacgggcggtttggggtaccttggggactaggtactttaccgacttccggtaccaccgtactcgacggtccgaccctccgtacgtcgtagtaacgtagttttcgtacttacgtttnttcttcgttactacctactagttcggtctacggtcgtccttacgtaccgttacgtttacggtaccgtacggggtaacctaacggtaacggtacgtaacgtacgtaacgtacgttcggtaacggtaccgttcgtaccgtacctaacgtaccgttacgtttccgttaccgtaccgtttccgttaccccgtacccg

SEQ ID NO: 219853 - DNA, 599 bp, Homo sapiens
  misc_feature: GYAE6OF02IJLER.24.87.H10.1.454.CMB.1.raw
  modified_base (272)..(272): a, c, t, g, unknown or other
  misc_feature (272)..(272): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaaagacgccaccctctcctgcagggccagtgagaatgttggcagcaacttagcctggtaccagcagaaccngccaggctccagctcctctctatgctgtctccaccgacgggcccctggtcgtcccacgtccgaggttcgtggcggttggggtctgggacagtcgtttcacttctaccactatcacggccgcctccgtacgtcgtagaagtattttcgtcgtactttatttcttgttaccaactacttatggtcgactcggccttaccgtacttacgttttcggaccgtaacggggtaacctaaacgtaggaacgtataacgaacgtaacgtcggtacggtcgtcgacctaaccgacttacgtacgtttccgttacctacgttcccgttacccgaccc

SEQ ID NO: 219854 - DNA, 918 bp, Homo sapiens
  misc_feature: GYAE6OF02JRWUY.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggaagaagtagtcatgacgcagtcctccagcccaccctgtctgtacgtctccgaaggggaaacgcgccccaacccttcgtaccgtgaccgaacgggccctaggtggaaggtaattcggttcgggcaacggtaccgtaaacgtttaccggccctttacggggtacccaaggtccgaaacgaaaacccggttcgggaaccccgtaagggtcccttacccccgagggtaccccttcccggttaaccctctacgtacgtccgttcgtcccacccgaccggaaccgggtccttaccgccgggtaccccgtcccccggtaccttacggggttcctacgggtacgggctaaccgggggtcgggtttacccggagggtaacccgtaggaccttttacccgaccggtttacctacccggtaacccggttcccgaacggaccggtacccgtacccgtttaacgggaaccgttaccgttaacgggttaacggtttaacggtttttcggtttaaccggtttacgttaccgtacggttacgtacgacgttacggtcccgttaccgtcccggttaccggtcccggtttaccgtttacccgggggttacccggggtacggggggtacccggttaacgggggttacgggaacgggtacggggtaacccggttaaccgggtacggttacgggtaccgggtaccgttaccgaccggttaaccgtaccggttacgttcccggtttacgtacccgttaccgtttccccggttaccccgtccgttaaccgg

SEQ ID NO: 219855 - DNA, 617 bp, Homo sapiens
  misc_feature: GYAE6OF02FT1HX.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngccaccctctcctgcagggccagtgagaatgttggcagcaacttagcctggtaccagcaagaaacctggaccaggcctcccgaggcctcctcctctatgctcgtcctccaccgacgggtcccctggtcgtcccagccgtaggttccggttcgggcggtgggtcgtgggactaggtatttccacttcctccgacctacgtcacgggccgtccctccgtacgtctagtaagttactttcgtacttacttttatttctacgtactaactacgttagtggtacgtacgtcgggtaccttccgtacttcgttttcgggacgtacgggtaaccaacggtggtaagtacgtacgaacgtacgtggtcgtacgtacgctacctacgtcgttcgttaccttactctttcccgtcccgtacc

SEQ ID NO: 219856 - DNA, 541 bp, Homo sapiens
  misc_feature: GYAE6OF02GGKE2.24.87.H10.1.454.CMB.1.raw
  modified_base (290)..(290): a, c, t, g, unknown or other
  misc_feature (290)..(290): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctccncctctatgctgtctccaccagggcccctggtcgtcccagccaggttcgttggcggtgggtctgggacagtatttcactctcaccatccagccgcctccacgtctagaagtatttgctactttatttctcgtcaactactatggtgactcggcctccgtactacgttttcggccgtacggggtaccaaacgtggagatacaacgaactaggtcggactcgccacctatctcgtcctactactcctcccgtcc

SEQ ID NO: 219857 - DNA, 647 bp, Homo sapiens
  misc_feature: GYAE6OF02IO2DD.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaancgcccaccctctcctgcagggccagtgagaatgtggcagcaacttagcctggtaccagcagaaacctggaccaggctccgaggcctcctccgtctatcgctcgtctccaccgacgggccctggtctccagtccaggtttcgtggcggttggtctagggacagtatttcactctacaccagtccacgccggtcctaccgacgtcgtagtaacgttacgtttagtactttactttactttccgttacgtaacctaactacgttacgttaggtacgtacgtcggtaccttaccgttaccttacgttttcggaccggtaaccgggtaaccgtaaacgtacggtaacgtacgtaaccgtaacgtaacgttacggtacggtaccgtacggtaaccctaccgtacgttccgttacgttaccgttacctaccgtttcccgttacccgtacc

SEQ ID NO: 219858 - DNA, 607 bp, Homo sapiens
  misc_feature: GYAE6OF02GJYOE.24.87.H10.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcagggccagtgagaatgttggcagcaacttagcctggtaccagcagaacctggccaggctccaggctcctctctatgctgtcctccaccgacgggccctggctcccagccaggttcgttggcggtagggtctagggacagtatttcgactcgtacacatcagcgcctcgacgtntgaagtactttgctactttatttctnttacgtaactacgttactggtagtacgtcggtacccgttaccgtacttacgttttcggtaccgaacggggtaaccaaacggtaggtaacgtaacgtaaccgtaaacggtaaccttaggtcgggtaccttacggacgtaacccgttattacgttcggtttacttaccaccgttttcccaccccggttacc

SEQ ID NO: 219859 - DNA, 609 bp, Homo sapiens
  misc_feature: GYAE6OF02FITEU.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtacccaagacgaaaccgtacggccgacggcgtcccgtacggcgtcctcctcctatgctgtctccaccacggcccgtcgtcgtcccacgccgtacggttcggttggtcggtcgggtcgtcgggcgacgtacgttctactctcgacctactcgacgccggtcctcctacgtctcgtaagtacgttttgtctacttttacgtttcgtcgtactaactactagttaggtcgacgttcggtcccgttccgttacgtacttttcgggtaccgaacggggtaaccgaaacgtggtagaacgtaccaaacgtactggtacggctgtaccacctatcgtcgttcttccactcttcccgctacg

SEQ ID NO: 219860 - DNA, 806 bp, Homo sapiens
  misc_feature: GYAE6OF02HX7CN.24.87.H10.1.454.CMB.1.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaaagacgccaccctctcctgcagggccagtgagaatggttggcagcaacttgcctggtaccngcagaaacctggccagcnccaggctcctctctatnctgtcctccaccacgggtcccctgggtcgtccccgagcccagggttccgttggggtccgggtggggttcgtcggggactaggtacgtttccacttccgtacccaaccgtactaccggtacgggtcccgggtaccccgtacccgtaggttaccctttaggggtaaaacgtttaccgtttttacggggtcttttaaacccgttttttacgtttttacccgtttagggtttaaccccttaaaacgttaaccgttttaaaggttacccgggttacgaaacccggttttcccgggttaccctttaaccccggggttttaacttttacccgggttttttaccggggaacccggtaaaccgggggtaaccccttaaaacggtcgggggttaaacgtaacgttaaccgtaaaccggtaacggttcgggtaacgggttacctacgggaccgttaaccctacgtttaccggttttcgtaccccttttacttaaccggttcccccgttttcccgaacccgg

SEQ ID NO: 219861 - DNA, 684 bp, Homo sapiens
  misc_feature: GYAE6OF02IFOKM.24.87.H10.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (627)..(627): a, c, t, g, unknown or other
  misc_feature (627)..(627): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactgganaagttagtcatgacgcagtctccagccacctgtctgtgctccgagggaangccacctcncctgcaggccagtcagagtataacganctaacttatcgccnggtacacaanacgaaacctgaccaggcctaccgagaccttcctaccgtatacgtcgcttccgtactcccgaaccgtacgggtcccctaggttccgcccgtacgcgaacggtttcggtacggcgggttgggtactggacgtagtacgtttcaacttcggtacaccggttcaaggtccctaagtcctacggactccgtaacggtaagttgtttcggtacgtttacgtgtacgtacgtaacgttcgacgtcccggttccgtaccgtccgggtacctaccggttacggttttccggggaacgggttccggtaagggttccggggaagaccgggttaaaggaccgtaacggttcggcggtacgtaccgtaccgaaccgttntaccgttcgtttcgtaaccctcgttaacccgtcccggttacgtacgttacttaacgg

SEQ ID NO: 219862 - DNA, 621 bp, Homo sapiens
  misc_feature: GYAE6OF02HJFU7.24.87.H10.1.454.CMB.1.raw
  modified_base (204)..(204): a, c, t, g, unknown or other
  misc_feature (204)..(204): n is a, c, g, or t
  modified_base (413)..(413): a, c, t, g, unknown or other
  misc_feature (413)..(413): n is a, c, g, or t
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
tcagactactatgtcacgaccggtgctcgatttagcagtactgcgttggatttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaancgccaccctctcctgcagggccagtgacgaatgttggcagcaacgttgcctaggtaccagacacgaaacctggaccaggcctcccaggcctcctcctctacgtcgctcgtcctccgaccgacgggtcccctggtccgtcccacgtccgtacgggtttcggtcgggtcgggttacgggtcgtgggactagtactttcactcctcacatcncgtctagtgtacgacgcctagtaacgttntttcgacttagtttacttacttcgtctacgtccgtacgtnaacctaacgtccgtacccgttacgttcccggaccgttaccgggaccaaggtaccgtacgaactacgtacccgaagtaccgtcggtacgtacgacgtaccaccgtcttacgtctttaccttactaccgttcccgtacccg

SEQ ID NO: 219863 - DNA, 598 bp, Homo sapiens
  misc_feature: GYAE6OF02H4QZE.24.87.H10.1.454.CMB.1.raw
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaanacgcctaccctctcctgcagggccagtgagatgtgcagcaatgctgtacngcagaacctgccagctccaggctctcnctatgctgctccnccacgggccctggtacnccagcctaggttcgtggcggtaggctggacaggtactttcgactcncactancgacgcgcctcgcgtcgtagtaacgtntttcgtacttactttattctctaccgaaccttattacgtggttcgacttcggtaccgttcccgttacgtttaccgtttttcgggaccggtaacggggtaaaccctaacggttaggaacgtaacgtaaccgtaaccggtaacgtggtacgggtccttacgaccgttaaccagtttcctacggttccttatacctttccccgttacctaccc

SEQ ID NO: 219864 - DNA, 710 bp, Homo sapiens
  misc_feature: GYAE6OF02HI4KO.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanacgccaccctctcctgcgagggccagtgagaatggtgcagctaacttagcctgtaccagcaagaacctggccgaggcctcccgaggcctcccgtccctctactcgcttcgtcctcctacccgacgggcccccgtggtccgtcccaggcccgtacgggttccggttgggtcggttcggggttcgtgggacgtagttacgttcaccgttctaccaacccgtatccgagggtccccgcccgtaccgtcgttacgtacggtaacgtagtttcgtaccgttacctttactttaccgttgttacctaacgttactttaacggttcggttacgtaccctcgggttacccttccgttacccgttacccgttttcgggacccggtaacgggtaacccgtaacggtacggtaacgtacgtaaccgtaaaccgtacgttacgggtacggtcctaccggtacctacccgtacgttccgttacgtcctttccgacgtttccccgttacccgttacccg

SEQ ID NO: 219865 - DNA, 665 bp, Homo sapiens
  misc_feature: GYAE6OF02IR5R9.24.87.H10.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (436)..(436): a, c, t, g, unknown or other
  misc_feature (436)..(436): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtgganaagtagtcatgacgcagtctccagccaccctgtctgtcgtctcgaggggaancgccacctctctgcgacggcctaggtgagagtgtggcagctaacttagcctaggtaccagcaacgtaaccgtcggaccgacggcctacccgaggtcccttacccgtcctactagtcgtccttggttccctccgaacccgtcgggtcccccgttgggtaccgcccaggtccggtagggtttcggtgggccgggttgggtcgtagggactagttcttccgatccgtacacctncgtacgggcctcctacgcgtacgtagtaacttgtttcgacctttactttagttctagtacttaaacgtcgttaagttcggtactaccgtccgttacccgtcgttaccggtttaccgtttcggaccgggtaacggtaacctaaacggtgaacgtacaccgaacgttctagggtcgtacgtcgaacttaccgagttcgtaccgttcttactacccgtttccgtacccgtac

SEQ ID NO: 219866 - DNA, 657 bp, Homo sapiens
  misc_feature: GYAE6OF02GCD8W.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcgagggccagtgagaatggttggcagcaacttagcctggtaccagcagaaacctggccaggcctccgaggcctcctcctctatgctgtcctccgaccgacggcccctggtctcccgagccgtaggttcgtcggcggtgggtctgggacaggtactttcaccttctacactagtcacggccggcccttaccgtacgttccgtaggtaacgttagttttcgacttaacgttttatttccttaggttacctaaacgtactttacgttggttcgtaccgttcggtcccgttaccgtaaccttaccgtttttacgggccgtaacggggtaaccctaaacgtcgggtaacgaagtaccgaaacggtaacttcgggtacggaccttacgggacctaccgtattacgttcggttccttactaccgtttcccgttaccccgtaaccc

SEQ ID NO: 219867 - DNA, 847 bp, Homo sapiens
  misc_feature: GYAE6OF02H7Q9O.24.87.H10.1.454.CMB.1.raw
  modified_base (198)..(198): a, c, t, g, unknown or other
  misc_feature (198)..(198): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctcagccacctgtctgtgtctcgagggaangccaccctctctcgcgacgggccagtgagtaatgtggcagctaacttcgcgtcgtacagacgaacgaaccgtggaccgaggtcccgtaccgacggtcctacccgttcctaccttacgtcggtccgttcgtcccgtacccgacccggaccggggtcccccgttagggttcccgtaccccgtacggtcccgttaggggtttccggttcgggggtccgggttacggggttacgtcgggtacgtagttacttttccgaccttccgtactaccgtacgtccgaccgggtcccgtacccgttaccgtacggttaccgtaaggttaaacgtttcgttttaccgttactttaacctttttaagtttttcccgtacgtttaacccgtaacctttaccgttaaggttcgggttacgtaccggtcccggttacccgtttaaccggtttaacccggtttaccggttttaaccgggaccccgggtaacggggttaaaaccccgttaaacggtacgggtaaaaccttaacgttaaccccgtaaaacggttaccggttacgggttaacggtacccgttacgtaacccgttaaacccgttcgttttacccgttaccgtttacccggttttaccttaaccccggtttccccctaccccggttaacc

SEQ ID NO: 219868 - DNA, 844 bp, Homo sapiens
  misc_feature: GYAE6OF02JHZKL.24.87.H10.1.454.CMB.1.raw
tcagactactatgtcacgaccggtgctcgatttagcagtactgcgttgggtttgggggagggaacgtgctcagttaggacccagacggaaccatggaagccccagcgcagcttctcttcctcctgctactctggctcccagataccactggagagtagtcatgacgcagtctcagccaccctgtctgtcgtctccgaggggtaaacgagccctaccctcctccgtgcgaggtccaggtgagtaatggttaggctagctaacttagcctaggtaacctagcctaagaaacctggtcccgaaggtccttacccccggaagggcccctttacccgtacccttacctagtacgtccgttacgtcctcccgaaccccgacggggtcccccttgggttcccggtacccctacggccccgttacggggttacgttcggggccggttacgggtcggttaggggacctaacgtaacgtttcccgtaacgtccttacccgaaaaccctcgtacccgacggtcccggtccctacccggtacgttaccgtaacggtaacgggtttacttttaccgggttactttaacctttttacgtttaccgtttccggtttaaccgttaaccttaacgttacggttcgggtaacgtttacccgtcggttaccctaccgtttaccgttaacgttttccggggaaccggttaacggggtaaacccttaacgggtagggtaaaccgttacgtaaccgtaaaccggtaacgttcgggttaaccggtacgtaccgggtaccttaacccgtccgtttaccggttacggttaccttacccgttaaccggtttcccttacccccggttaccg

SEQ ID NO: 219869 - DNA, 575 bp, Homo sapiens
  misc_feature: GYAE6OF02JA2ZU.24.87.H10.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggagaaatagtgatgacgcagtctccagcctaccctgtcctgtgtctccgaggggaaancgccacctctccngcacgggccagtgagtaatcggttggcagccaaacttgcctggaccagcaagaaccnggccaggccnccgacgctcctcctntactgctgtctccacgaccgggtccctggtccgccaggcctaggttcgtggcggtgggtctcgggacncgtacttcgactctccacatcgacgcgctcncgtctgaagtcttgcttactttattcgtgtacctaacgtnttattcggatcgtacgtccttacggtccttacgtttcgcgacgggtaacctaggtacggagtacacgaacgtcgtcgggtcgtcttcgaccaacctgttccgtacgttccttaccgctttaccctcccgtaccc

SEQ ID NO: 219870 - DNA, 647 bp, Homo sapiens
  misc_feature: GYAE6OF02GHDKM.24.87.H10.1.454.CMB.1.raw
  modified_base (205)..(205): a, c, t, g, unknown or other
  misc_feature (205)..(205): n is a, c, g, or t
  modified_base (391)..(391): a, c, t, g, unknown or other
  misc_feature (391)..(391): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagngcccaccctctcctgcgagggccagtgagaatgttggcagacaattcgcctggaccagacgaacgaaccgtggccaggcctcccgaggcctcctcctctagtcgctcgtcctccaccgcggcccgtggtccgtcccgacgtccgtcggttcggtcgggcggttcgggtcgtgggactagtacttcnctctccactctcgcgccgtcctccgagttctagtagttacgtttcgtactttacgtttacttctacgttacctaaactacgttagttgggttactacggtccggtacccttccgttacgtttaccgtttcgggacccggtaaggggaaacccttaacggacggtaacggtaactaaccggtaaacgtacgtacggtcggacctacggacctaccgtattcgttcgttaccctcttacccttcccgttacccgtacc

SEQ ID NO: 219871 - DNA, 529 bp, Homo sapiens
  misc_feature: GYAE6OF02F33KV.24.87.H10.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagactactatgtcacgaccggtgctcgatttagcagtactgcgttgggtttgggggaggaactgctcagttaggacccagacggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagaagtacttaggcttggtaccaacagaaacctggcctggctcccaggctcctcatctatggtncgtccaccagggccacgtggcgtcgcggacaggttcagtggcagtggctttgggactagacttcactctcatcatcgacagactggacgcccgaagtattttgctagttgtattactgtcagtcttgtttcgtcctctcctcctatgtacctacgttttggcctagggttcctagtctggagtatcagcgactgtggctgcctacatcgtcgttctctactcttcccg

SEQ ID NO: 219872 - DNA, 721 bp, Homo sapiens
  misc_feature: GYAE6OF02JV1KI.24.87.H10.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggcctcccagactaccactggagaagtagtcatgacgcagtctccagccacccgtgtctgtgtctccgaggggtaaangacccacctcctccgtagcgacggccagtnagaattggtcggcctaggactaactttacgcctggtaccagcaacgaacctcggaccgacggcctacccgacggtcctccttacgtctacgtcgtctaccgtcttcccgaactccgggacccctggtccnccctacgccgtacggtttcggtcgggcggttacggggtcgtacggacgtatacttctaacgtccncctactactccggngtcccggtcctacgtacgttcgtacggtaacttacgtttaccggactttacctttaccgtttcgttaaccgttataaacccgtttacgtacttcgggttacaccgttacggtacccttaccggttaccttaacgtttccgggtaaccggtaacgggtaacccttaaggaacggttacgtacgttaccgaaacgggttccgtcgggaccggttacgccttaaaccgcgtaaccgtttacgtccgtaccttacggttccttcccgttaccctaccgg

SEQ ID NO: 219873 - DNA, 748 bp, Homo sapiens
  misc_feature: GYAE6OF02I32G8.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatgaagccccagcgcagcttctcttcctcctgctactctggctcccagataccactggagaagtagtcatgacgcagtctccagccaccctgtctgtgtctccgaggggaaangccaccctctcctgcagggccagtgagtaatgttggcagcaactgcctggtacagcagaacctggccaggcctacccgaggtcctcccttccctactacgttcgtaccgttcgtccctcccgacccgtaccggggtcccccttggggttaccccgttccccgtaggtaccccggttaacggggtttccggttcggggtccggggtttcggggtcgtacggggaccgtaaggttactttcgaccttccgtacgacccttacgttccgaacggtcccggaccgttaccgtacgtttacgacggtaagtttaacttttcggtacgtttacttttacgtttaccttggttaacccttaacgtacgttaggttccgggttactaccggtccggtacccgttccggttaaccttaccggttttacggacccggtaacggggtacctaaacgggttcggaacgttaacgtaaccgaacggtagtaacggtcggtaaccttcggacctaccgtattccgtacgttccttaccgactttccgttacccgtaccg

SEQ ID NO: 219874 - DNA, 713 bp, Homo sapiens
  misc_feature: GYAE6OF02JAKR2.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagagtagtcatgacgcagtctccagccaccctgtctgtgtctccaggggaaagacgccaccctcctcctgccgacgggccagtgacgaatgttggcaggcaacttgcctggtaccagacaacgaaaccgtggccaggtccctccgacggtccttccctccgtctacgtcgtctcgtcctccaccgaccggtccccgttggtccgtacctacggtccgacgggtttccggtgggtacggttcggggtacgtgggacgtaagttacgttacctctacgtaccctaccgtaatccgtaacggccccgttaccgtcccgtacgttaccgtagtaacgtttactttcgtaccttacgttttacttccgtttacgtcctaaacgtacttacggttcggttacgtcgtacgggtcccttaccgtacttaccggtttacgaccggtacgggaaccctaacggtcggtaaagttacgaaacgtaaccggtacgtacggtcggtaccgttacggaacccgttacacgtttacccgttcgttacccttactaaccgtttcccgttaccccgtacg

SEQ ID NO: 219875 - DNA, 818 bp, Homo sapiens
  misc_feature: GYAE6OF02JUZEE.24.87.H10.1.454.CMB.1.raw
  modified_base (587)..(587): a, c, t, g, unknown or other
  misc_feature (587)..(587): n is a, c, g, or t
  modified_base (615)..(615): a, c, t, g, unknown or other
  misc_feature (615)..(615): n is a, c, g, or t
  modified_base (753)..(753): a, c, t, g, unknown or other
  misc_feature (753)..(753): n is a, c, g, or t
tcagactactatgtcacgaccggtgctcgatttagcagtactgcgttgggtttgggtgaggaactgctcagttaggacccagacggaaccatggaagccccagcgcagcttctcttcctcctgctactctggctcccagatacccacgtggagaagtagtcatgacgcagtctccagcccaccctgtctgtcgtctcccgaaggggaacacgccaacccgtcctcgtgacgacgggccagtgagtaacgtggttcggccgaagtaccgtaacgttacggcccgttgggaacccagacctaaccggaaacccgtcgggacccgtaaggccctacccgtacggcccttccccgtccgttacgtacttcggtccttcggttacccacccgacccgggtcccgggtcccccgttacgggtccgtaccccgtaacggtccgttcgggttttccggggttcgggtccccgggttaggggtccggtttacggggaaccgtacggttttaccttttcggaaacccgttccgttaaacccgacccgtagttacccgaacgtcccgtcccgtacctacggttcgtaacggtaagttntttccgaactttaacttttcggtttacnccgttacctaaccgttacgttatacggtactaccgttccgaccgtttaccgttacgttaacgtttccggaaccgggtaacgttaacccgaacggttagtacgaacgttaaccgaaacgttaaggttccggacggttanccggtaccctaacgttccgtacgttaccgtttccgttaacctttaccggtacccccgttacccgg

SEQ ID NO: 219876 - DNA, 735 bp, Homo sapiens
  misc_feature: GYAE6OF02I6WW8.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaagcgccacccgtctccgtgcgacgggccagtcgagtaatgttcggcagacaactagcctaggtaccagacgaacgaacctgggccaggtcctcccgaggtcctccctcctcgtagtcgctcgtcctaccgaccgtccgggtcccctgggtccgtccccgaggtccgttacgggttccggttcggggccgggttggggttccgtacggggtactacggtttactttccgaccttccgtaccaccgtacgtccaccgggtcccggtacccgttacgtacgttcgtagtaacgtttattttcgtactttacttttacgtttctacgttacctaactacgttaggttacggttacgtaccgttccggtacccgttaaccgttaccgttaccggttttaccgggaacccggtaacggggtaacctaaacgggttcggaaacgtacgttaaccgaacgttacgttcgggtcggtactccggtacctaccgttagttccgttacgttaccttaccttcgtttaccccgtccgtaacccg

SEQ ID NO: 219877 - DNA, 592 bp, Homo sapiens
  misc_feature: GYAE6OF02GOQ8L.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaanagccacctctcctgcagggccagtgagatgtggcagcaacttgcctggtaccagcagaaacctgccaggctcccgagcctcctcctctatcgctgtcctccaccgacgggcccctggtctcccgagccgtaggttcgtggcggtgggtctgggacagtactttcactctcacctatcgacgcgcctccgagtctagtaacgtatttgcttactttacttctcgtactaactacttagtgtacgtactcggtccttccgtacttacgttttcggccgtaacggggtaacctaaacgtcggtaacgacgtaccgtaaaccgtaacgtaggtacggtactacgacctaaccgtacgttacgtcgttccttacgtaccttccgttacccgtacc

SEQ ID NO: 219878 - DNA, 767 bp, Homo sapiens
  misc_feature: GYAE6OF02G14WS.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagcccacctgtctgtcgtctccgaggggaaancgcccaccctctcctgcgagggccagtcagagtataagaagcaactacttagcctggtatcaacagaaccgtgaccaggcctcccaggcctccctcactctagtggtatactccgagcgacgggccacgtggtccgtccacgccgtaggttcgaggtgggcagggttcgggtcgtacggggactaggtacgtttaccgactaccgtccctaaccgtactacacggaccgtacggttccacggtctacggttacgtacggtaaaggttttacgtttttaccgggttaccggtttttaaccgttacgttcggttaccgtacggtacccgtacggttccccgggtttcccggtaccccgggttccgggtaccccggttacccggttttaaccgggtttaaccccggggggggtcccgggggggtaaccggttacggggggggttacgggacggggtaaggggtaacccggggtaaccggttaaaccgggttgggttaccgggggtaccttacgggtcccgaaccgtttaccggtccgttttccgtttaccgttccgttaaccccg

SEQ ID NO: 219879 - DNA, 621 bp, Homo sapiens
  misc_feature: GYAE6OF02JETU7.24.87.H10.1.454.CMB.1.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (400)..(400): a, c, t, g, unknown or other
  misc_feature (400)..(400): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagatgccaccggagacattgtgttgacacagtctccagcccaccctgtctttgctccgaggggaanacgccacctctcctgcagggccagtgacaatgtaggattgtagctgtancaacacaaacntggaccaggcctccccggctcctcatctatgatcgctactccgaagtaccggggcccctgggtcctacccaggtccgtagggttcggttcgggcggttgggtccgtgggactaggtactttcgactcgtacaacctntccacggtccgcctccgtagtctaggtaagttatttcgacttacttttatttctagtaccaatacgtagtggtacgcgtcggaccttccgtacgttcgtttcggaccgtacgggaacctaacgtggaactaacgtaccgaaacgtacgttgggtacggtaccgtacgacgtaacccgtagttccgttacgttccttactccttcccttacccgccttaacg

SEQ ID NO: 219880 - DNA, 638 bp, Homo sapiens
  misc_feature: GYAE6OF02H5A3G.24.87.H10.1.454.CMB.1.raw
  modified_base (209)..(209): a, c, t, g, unknown or other
  misc_feature (209)..(209): n is a, c, g, or t
  modified_base (483)..(483): a, c, t, g, unknown or other
  misc_feature (483)..(483): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccactggagaagtagtcagtcgacgcagtctccagcccacccgtgtctgtgtcctcgaaggggaaancgcccacccttctcctgcagggccaggtcgagattggtgcagacaacttgccgtggtaccagacgaacgaaaccgtcggcacggcctccaggtcctcctacctcgtatcgtctcgtcctcccacggccggtcccgtggttccgccgtacgccggttagggttcggtcggggtacggtgggtcggtacggacgtagttccgttcaaccgttcgtacctacctagtaccgcggacccgtcctacgtacgttcgtacggtaaggtttactttccgtntttaccgttttagttccgtagtaccaacttagttgtaggtactcgtaccgtccttacgtacttcggttcggacgtacgggtaccaaggtcgagtacgtaacgaacgtgtcggtgacctagtaccacctgttcgtattcctctactcctaccgtac

SEQ ID NO: 219881 - DNA, 843 bp, Homo sapiens
  misc_feature: GYAE6OF02JNGZ4.24.87.H10.1.454.CMB.1.raw
  modified_base (151)..(151): a, c, t, g, unknown or other
  misc_feature (151)..(151): n is a, c, g, or t
  modified_base (189)..(189): a, c, t, g, unknown or other
  misc_feature (189)..(189): n is a, c, g, or t
tcagactactatgtcacgaccggtgctcgatttagcagtactgcgttgggtttgggggagggaactgctcagttaggacccagacggaaccatggaagccccagcgcagcttctcttcctcctgctactctggctccagataccactgganaagtacgtcatgacgcagtctccagccacctgtctgtntctccgagggaaagcgccacctctcctgccgacgggcctagtacgagtaagttggttggacagtaccgaaacgtttggccccgttaggggtaacccaggtaccgaacggaaaaccgttcggaacccgtacggggtacccctacccccgtaagggtccccttacccgttcccgtacgttacgtcgtccgtttaccgtccctaacccgaccggacccggggttcccctggggttacctaccccacgggtccccgttacggggttttcggttccggggcgggtttacggggccgtttaggggacctaacggtttctttacccggtacgttccgtaccctaaccggtacgttcccggtacggccccgggtacccgtacccgtacgttacgtacggttaaacgttcgttttacgtacgtttaccttttagttaccgttacgtaaccgtaacttacggttacgttacgggtacgttcgtaccggttaccttaccggtttaacgttaccggttttccggaccggtaaccggggttaacccttaacggtcggtaaacgtacgtaaccggtaaccgttacggcggttaacggtaccgttacgtacccgtaacgttcgtacggtttccgttaccgttacctaccgttcccgtttaccccggtac

SEQ ID NO: 219882 - DNA, 677 bp, Homo sapiens
  misc_feature: GYAE6OF02JBFW1.24.87.H10.1.454.CMB.1.raw
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctcaggcaccctgtcttgtctccagggagagagccaccctctcctgcaggccagccggagtcgttagtagtacgttaggctaggtaccaagaagaaaccgtggaccgaggcctcccgaggcctccncatctancgatcgtcctaccgaagtcgggtccacgtcggcccgtccccgcgacggttcaggtcggactaggtcgggtagtcggactagtaccttcgacctcgtaccgacctcgacgactacggcctaggacgtcgtagtaagttatttcgtacggtttacacgttgtacagtcctacggtccgttccgccgttggacccgtacttaccgggttccgggacggggtcgaggggtacgggtacggaacggacggtaacggtaacgttcgggtcgggtacgtcgacccgtacgttacgttccggttacgttacccgttactacccggttttaccccgttaccctaaccggttaccgttacgtaaccgttaccgtaacttaacggg

SEQ ID NO: 219883 - DNA, 681 bp, Homo sapiens
  misc_feature: GYAE6OF02IUKCM.24.87.H10.1.454.CMB.1.raw
  modified_base (200)..(200): a, c, t, g, unknown or other
  misc_feature (200)..(200): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtcctcagccacctgtctgtgtctcgaggggaanacgccaccctctcctgcagggccagtgagattgttggcagactaacttacgcctggtaccagcaacgaaacctcggccacggcctacccgaggtcctcccgttcctctactcgcgttcgtccgtacccaccgaccgggtccccttgggtccgtccccgacggcccgtacgggttcggttgggtcgggtgggtcgtagggtactaggtactttcgactcgtacaccgtatcgacggccgtacctccgtacgttcgtaggtaacgttacgtttttcgaccgtttacttttacgttttcttacggttacaaccgttaacttaggttcggtcgtacgttcggtacccttaccggttactttaccggttttcggaccgggtaacgggtaaccctaaagggtgtacgaacgttaccgaacggttacttcgggtacggctcggactaaccgtacgtccgttcgttctacgtaccttcccgtccctacg

SEQ ID NO: 219884 - DNA, 730 bp, Homo sapiens
  misc_feature: GYAE6OF02JV5B7.24.87.H10.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactgganaagtagtcatgacgcagtctccagcccacctgtctgtgtctccgagggaanacgccaccctctccgtgcaggccagtgacgatgtggacagcaattgcctaggtaccagcaagaacctggccaggctcccgaggcctcctcctcatgtcctctcctccaccggccggcccctggtccaccccgagtccggtaggttccggttcgggccgggttcgggtcgtacgggacctaggtacttaccgacttccgtaccaccgtactcggtacggcccggttcctaccgtacgtacgtacgtaacgtttactttcgtaccgtttactttaacgtttcgttacgttaacctaacgttacgttacggttacgggttactaccgggttaccgtcccgtttacccgtacctttaccgggttttaccggacccgggtaaaccgggttaacctaaaccgggttaggtaaccgttaaccgtaaaccggtaacggttacgttacggtaacgggttaccgaaccgtacccgtacgttaccgtttacggttccttaaccgttaccgacccgttttaccccgtcccgttaacccg

SEQ ID NO: 219885 - DNA, 602 bp, Homo sapiens
  misc_feature: GYAE6OF02GTGUK.24.87.H10.1.454.CMB.1.raw
  modified_base (204)..(204): a, c, t, g, unknown or other
  misc_feature (204)..(204): n is a, c, g, or t
  modified_base (381)..(381): a, c, t, g, unknown or other
  misc_feature (381)..(381): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagccaccctctcctgcagggccagtgagaatgttggcagcaacttagcctggtaccagcaagaaacctggccaggctcccaggcctcctcctctatgctcgtcctccaccacgggcccctggtcgtcccagcctaggttcgtggcggtgggtctgggacagtatttcactctcaccntcagtcctgcctcacgtctacgtaagtatttcgcttacttttactttcttacgttactaactacttagttggtcgtacgttcggtcccgttaccgttaccttacgttttcgggccgtaacggggtaacctaaacgtaggtacgtaacgtaccgaaacgtacgtcggtacggtcgtacgacctaccgtacttcgttcgttaccttctacgttcccttccccg

SEQ ID NO: 219886 - DNA, 674 bp, Homo sapiens
  misc_feature: GYAE6OF02G2BRX.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaangcccacccttctcctgcagggccagtgagaatgttggcagcaactgcctggtaccagcagaaacctggccaggcctcccaggcctcctcctctatcgctgtcctccaccgacgggtcccctggtccgtcccagtccgtacgggtttcgtcggtcggttgggtcgtgggactagtactttcacgtctacactcgtcacggtccggtcctccgacgtcgtacggtaagttacttttcgtacgttacttttatttccttacggttaacctaacttacgtttacgttcgggttacgtaccggttccggttacccttaccgttaaccgttaccggtttttcgggaaccggtacggggtaaccctaaacggtcggaacgttaactaaccgtaaacggtaaccgttggtacggtccttacgacctaaccgtagttcccgttgttaccttacgtaccgttcccgttacccggtaccc

SEQ ID NO: 219887 - DNA, 685 bp, Homo sapiens
  misc_feature: GYAE6OF02IOT4P.24.87.H10.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (473)..(473): a, c, t, g, unknown or other
  misc_feature (473)..(473): n is a, c, g, or t
tcagactactatgtcacgaccggtgctcgatttagcagtactgcgttgggtttgggggaggaactgctcagttaggacccagacggaaccatggaacgccccagcgcagcttctcttcctccttctactctggcttcccagataccactggacaagtagtcatgaacgcgagtctaccagccgtacctggtctgtcgtctccgaaggggaaancgccaccctntcccgtagccaacgggcctaggtcgagtaatggttagactcgactaaacgtttgccttaggaccagactacgaaaccgtggacaggcctacccgaggcctaccgtccactagtcgctgtacctccaactacggccccttgttacgccacgccgtagttcgtggcggtagtcgttgggactaggtcctttacaacgtcctacgtaacctaacttcgacgtccggccgttaccgtacgtctaggtaaacttntttaacggtcttacgttttaatcctaacgtctaaacccagtttacgtacgtacggtacgttcgcccgttaacgtaacttaccgtttacgacgtaacgggtaacctaagtacggacgtaacgttaacgaaaccgtgtacggtaccggtactcggtacctaccgaccgtttcgtcgttaacccttcgaaccctttcgtttcccgtaattaaccg

SEQ ID NO: 219888 - DNA, 768 bp, Homo sapiens
  misc_feature: GYAE6OF02FQ6F8.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggagaagtagtcatgacgcagtcctccagcccaccctgtctgtgtctccgaggggagagacgcccaccctctcctgcgacgggccagtcgagagttgtacgcagcacgtcttactagccgtggtaccagaccaacgaaaccgtcggccgtggccctaccccgaggtccctcctacacttccttaaggttcggtcgacccgttacccgaaccggaacggggtaccctacggtcgggacccggttccggaccgggtacgtacgggttaccgtaggtccgggctagggtcgggtaccgtttacggggaacctaacgttaccgttcctaccgttcctaccgtacttaccgtaacttacccggaaacgacggtaccggtcgggaacccgtaaaccccgggtaaagtttacgtttaggaaccgttaaggttacgtttaacttacgtgttaccgagtttccgtttcgggtttcccggtccccttcttacccgttaccttaacgttaccgttaacctttaccgggtttccggtacccggttacgggttacccgtaagggtcggttacgggtaacgtacgttaaccggaacgtaccggtaaccgttggtccggtacgtccgtaacccg

SEQ ID NO: 219889 - DNA, 581 bp, Homo sapiens
  misc_feature: GYAE6OF02HSK0X.24.87.H10.1.454.CMB.1.raw
  modified_base (203)..(203): a, c, t, g, unknown or other
  misc_feature (203)..(203): n is a, c, g, or t
  modified_base (408)..(408): a, c, t, g, unknown or other
  misc_feature (408)..(408): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaanagccaccctctcctgcagggccagtgagaatgtggcagcaacttgcctggtaccagcagaacctggccaggctcccgaggctcctcctctatgctgtcctccaccacgggcccctggtcgtcccagtccgtaggttcgttgggcggtgggtcgtgggacagtatttcactctcacctatcgagccgtcctccagtctagtaagtntttgcttactttattctgtactaactactagttggtcgtacgtcggtccttccgttaacctcgttttcggccgtacggggtaacctaacgtacggagtacgtaccgaacgtacgtaggtcggacctggacctacgtacgttcgtcgttaccttctacttccgttcccgtaccg

SEQ ID NO: 219890 - DNA, 636 bp, Homo sapiens
  misc_feature: GYAE6OF02HUCT8.24.87.H10.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (582)..(582): a, c, t, g, unknown or other
  misc_feature (582)..(582): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggcctccagataccactggagtaagtagtcatgacgcagtctccagccaccctgtctgtntctcgagggaaancgcctaccctctcctcgcgacgggccagtacgagaagtcgtgctagactaagtacgctggtacncgacaacgaaacgtcgacgacgtcaccgagctccttcntactnctntctcccacgtccggcctggttacccnccgacgtcgtacggttcggtcggccggtggtcgacgggatacggttactttccgacgttccaatacccgtaagtcgaccgcccgggtaccttaccgtacggtactaggtaacgttacgtttcgtaccgtttactttagtttccgtagtaccttaaacgtacgttagtcgtacgtgccgtaccgtctacgttctacggtacgacggtaactacgagacaacgtaaccaacgttcggcgtcgtacncgtaaccactaacgttctaccggttacttacgtaactttcccgtaccgttaacg

SEQ ID NO: 219891 - DNA, 836 bp, Homo sapiens
  misc_feature: GYAE6OF02HH7K9.24.87.H10.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaangccaccctctcctgcgagggccagtgacgaatggttggcagcaacttgcctggtaccagcagaacctggaccaggcctcccgaggtccncccgtctactatcgtcttcgtccctccaccgtacgggtccccctgggtccgtaccccgaggtaccccgttagggtttccggttacggggcccgggttgggggttacccgtcgggggtacctaacgggttaaccgttttccgaacccttccgtttaccgaaccctaggttcccaaccggtacccgggtccctaccgtacgttccgttagtaaacgtttacgtttcgaccgtttaccgttttactttaccttacggttaccctaaacgttaccgttaacgttcgggtttaacgtacccggttaccggttccccgttaacccggtttaccctttaaccgggttttttccgggaaccccgggttaacccgggggtaaacccgttaaaaccgggttacggtaaaccggttaaccgttaaacccggtaaaccggttaaccgtttcggggttaaccgggaaccgttgggtaaccccgaaaccgtttaccgttcccgtttaccggtttaccctttaaccgtacccgttttcccgttaccccccgttaaccc

SEQ ID NO: 219892 - DNA, 480 bp, Homo sapiens
  misc_feature: GYAE6OF02IC1XI.24.87.H10.1.454.CMB.1.raw
  modified_base (147)..(147): a, c, t, g, unknown or other
  misc_feature (147)..(147): n is a, c, g, or t
  modified_base (171)..(171): a, c, t, g, unknown or other
  misc_feature (171)..(171): n is a, c, g, or t
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (479)..(479): a, c, t, g, unknown or other
  misc_feature (479)..(479): n is a, c, g, or t
tcagactactatgtcacgaccggtgctcgatttagcagtactgcgttgggtttgggggagaactgctcagttaggacccagacggaaccatggaacgcccagcgcagcttctcttctctgctactctggctccaagataccatgganaagtactcatgacgctagtcacgngccaccttgtctgtntcacgagggaaacgccacctctcgngacgnggcaagttgatatgtcgcagctaactgctgacancanaactgcagtcncagcnccncantgntntcaccacncggcctgcgccagtcnggtctggcgtgnaggcagtntcactcanccgancgatcggctacatgagacctattcgattacttctttcgatanaacatgtgaacgntcggaactctacngtttcgnacggcaatggaatcgaanagacgtgagcncgtacaccagttccnaactttcggaactcggttacccnc

SEQ ID NO: 219893 - DNA, 900 bp, Homo sapiens
  misc_feature: GYAE6OF02GYXXI.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgccagtctccacgcccaccctgtctgtgtcgtccggaaggggaaagcgccctaccctcctcgtgcgacgggccaggtgagaagttggttcggacacggactaacgttacgccgttagtaccgacgacgaacgaaacccgtcggaccgacggcccgtacccgacggtcccttcccctccgtcgtacgttcgaccttcgtaccgtaccccacccgggacccggttccccggtacgtcccggtaccccgtaccgggtacccggtttacggggtttcggttcggggtccgggtttacgggggtccggtacgggacgttagtttaccgtttcgtaccgttacctaaccgaccgtaacgtcccgaccgggtcccgtcccgtaccggtaccgttacgttaacgggttaacgttttacgttttaccgttaaccgtttttaaccttttaccgtttaccgtttaccgttaaccgttaaaccgtttaccgtttaggttccggtttcgtacccggttaccggttaccccgtttacccggttaaccgttttacggtttacccgggtaaccgggtaacccggggttaaacgtaaaccggtacgggttaaacgtaccgttaaaaccgggaaccgttaacggtacgggttcccgggttacctaccgggtaacttacccgtaccgtttttaccggttaccctttaccggtttaaccccttacccgggtttacccccgttacccgttaccccg

SEQ ID NO: 219894 - DNA, 638 bp, Homo sapiens
  misc_feature: GYAE6OF02GMHBT.24.87.H10.1.454.CMB.1.raw
  modified_base (207)..(207): a, c, t, g, unknown or other
  misc_feature (207)..(207): n is a, c, g, or t
  modified_base (372)..(372): a, c, t, g, unknown or other
  misc_feature (372)..(372): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagataccactggagaagtagtcatgacgcagtctccagcccaccctgtctgtgtctccgaggggaaangcccaccctctcctgcagggccagtgagatgtggcagcaattgcctaggtaccagcaagaacctggccaggcctccgaggcctcctcctctatgctcgtcctccgaccgcgggtccctggtcctcccgagtccgtaggttcggtggcggtggtcgtggactagtntttcactctaccactctcgacgccgtcctccgtacgtctaggtaacttactttcgacttacttttacgttctacgttaactaaccgtagttacgttcgggtactaccggttcggtccctttacccgtaacgtttccggttttacgggaccggtaacggggtaaccctaaggtacggaacgtaactaaccgtaaacgtacgtggtacggtaccgtacgtaccgtaccttagttcgttcgttacctactccgttacccttcccgtaac

SEQ ID NO: 219895 - DNA, 657 bp, Homo sapiens
  misc_feature: GYAE6OF02H8GB4.24.87.H10.1.454.CMB.1.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaagtagtcatgacgcagtctccagccaccctgtctgtgtcctccgaggggaaagagccaccctctcctgcgagggccaagtgagaatgttggcagcaacttgccgtggaccngacaagaacctggccacggcctaccgagcctcctctctatnctcgtccnccaccgacggtccctggtactcccgacgccgtaggttccggtggcggtgggtcgtaggctagtacttcactctacacatcgcgtccgctcgagtcgtagtaattacgtttcgtacttactttaacgtttcttacgtaccttaaactaactgttacggttcgacggttaccgtccgttaccgttaccgtttacggttttacggacccggtaaacggggtaaacctaaacgggtacggtaacgttactaaaccgtaaaccggtacttaggggtcgtacccgttgaaaccgtaccgttagtaccgttacttaccctacttttaacccgtcccgttacccgtaacccg

SEQ ID NO: 219896 - DNA, 749 bp, Homo sapiens
  misc_feature: GYAE6OF02G1KCG.24.87.H10.1.454.CMB.1.raw
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
  modified_base (337)..(337): a, c, t, g, unknown or other
  misc_feature (337)..(337): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagataccactggagaagtagtcatgacgcagtctcagccacctgtctgtgtctccgaggggaaangccaccctctcctgcagggccagtgagatgtggcagacattcgctgtacancagaacctggctggctccgagcctcctctctacgtcgtctcgtccacccgtaccgacgggtccccctgggtaccgtacccgngtacccgttagggttccggttcggggttaccgggtcggggttccgttacgggaccgtacggtttacgtttaccaccgttctacccgtacgtaacttccgaacggtcccggaccgttaccgtacggttcgttaacgtaacggttacgtttttccgacctttaacgttttaacgttttcgttacgttaaccgttaacctacgtttacgtacgggttacgtaccggttccgggtaccctttaccgttaccgtttaccggtttacgggtacccggtaaacggggttaccgttaaaaccgggttcggtaaaccggtaacgtttaaccgaaacgttaacggtttcgggtacggtaccgtacgtaccgtaccgttattcgttaacggttccgtttaactcctttaccgtccccgtaacg

SEQ ID NO: 219897 - DNA, 666 bp, Homo sapiens
  misc_feature: GYAE6OF02I8HFK.24.87.H10.1.454.CMB.1.raw
  modified_base (461)..(461): a, c, t, g, unknown or other
  misc_feature (461)..(461): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggctcccagactaccactaggagaagtagtcatcgacgcagtctccagccacctgtctgtgtcctcgaaggggaagacgtccaccctctcctgcacgggccaggtgagaagtcggtgcagactaacttacggcctaggtaccagacaagaaaccgtggaccgacgggtcctacccgacggcctccctccgtactagtcgctagttccgccaccgtaccggccctggtccgcccacggccgtaggttcggttcggtacggtcgggtccgtgggactacgtactttcacgtctacaacctcgtcagtccgtaccgtcgtactgtacgtaacgtnttttacgacttacgtttattcgtactacgtaaactcgtagttacggtcgtacgttccggtacctccgttaacgtcgttacggtaccgaccgggtaactaaccggtaggtaacgtaacgtaaccgtaaacgtcgtaggtcggtacttacggaacccttaccgtattcggtcttaaccctttagaccccgtttccgttacccgaacc

SEQ ID NO: 219898 - DNA, 751 bp, Homo sapiens
  misc_feature: GYAE6OF02IJRLQ.24.87.H10.1.454.CMB.1.raw
  modified_base (203)..(203): a, c, t, g, unknown or other
  misc_feature (203)..(203): n is a, c, g, or t
  modified_base (418)..(418): a, c, t, g, unknown or other
  misc_feature (418)..(418): n is a, c, g, or t
  modified_base (700)..(700): a, c, t, g, unknown or other
  misc_feature (700)..(700): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtcctccagccaccctgtctgtgtctcgagggaaanacgccaccctctcctgcgacgggccagtgagtaagtgttcggctagctaacgttgccgttggtaccgagaccaacgtaaaccgtggaccgacggtccctcccgaaggtccctcccgttacctctatcgtccttcgtcctaccgaccgtccgggtccctggtcctccgacggccgttagggtttcggtcgggtcggttcgggttgtcgggtaaccnggtttaactttccgactttccgacctaaccgtacgtccgacggtcccgtaccctaccgtagtttaccgtaaggttaaacgtttacgtttttacgaccgtttaaagtttacgtttaccttgtacctacggtacctaccgttaacgaccgttaccggtaccggtaccccgttacggttttacccgggtccccgtaacggggtaacccttaacggccgttaaggaaccctacgttaaacccgaacggttaccttcgggtacggtctacccggtactaacccgttnttaccgttaccgttcttaaccttcccggttaccccgttcccgtacttaacg

SEQ ID NO: 219899 - DNA, 625 bp, Homo sapiens
  misc_feature: GYAE6OF02IZDSY.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcagggccagtgagatgttggcagcaacttgcctgtaccagcaagaacctggccaggcctcccgaggcctcctcctctatcgctgtcctccaccgcgggcccctggtcgtcccagccgtaggttcgttgggcggttggtcgtgggacaggtactttcactctacaccagtcgacgccggtctacgcgtccgtagtaagtgttttcggtacggttttactacttgtacgagtcgtagtccgttccgccgtcggcccgtacgtttaaccggttccggggaccgggggtaccgtaggggtacgggaggtacgggacgtaacggtaacgtcggtcgggacgtcggccgtaccgtagttccgttacgttccgttaccgtacgttcccgttcccgaccttcgtaccgtaacgg

SEQ ID NO: 219900 - DNA, 759 bp, Homo sapiens
  misc_feature: GYAE6OF02IZX15.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaanacgcccaccctctcctgcgacgggccagtgagatgttggcagctaacttgccgtggtaccagacagaaacctggccaggcctcccgaggcctcctcctctatgtctcgtcctccaccgacgggtcccctggtccgtacccgacgtccgtacgggtttcgtcggggtcgggttcggggtcgtggggtactaggtactttccacgttcctaccactagtccgagggtcccgtcctccgtacgttccgtaggttaaacgttagttttacggacctttacgttttacttttccgttacgttaacctaaccgttaccttaggttcgggtacgtaccggttccggtaccccgttaccgtttaccgtttaccgggtttttcggaacccgggtaacgggggtaaccccttaaaacggttcgggaaaccgttaaccgtaaaccgtaaacccgggttacgtttacggggttaaccggtccgttaaccggaccgttaaaccccgttagtttccgtttaccggtttacctttaccgtaccgtttttacccccgtccccggttaaccc

SEQ ID NO: 219901 - DNA, 551 bp, Homo sapiens
  misc_feature: GYAE6OF02I6KT9.24.87.H10.1.454.CMB.1.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (418)..(418): a, c, t, g, unknown or other
  misc_feature (418)..(418): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaancgccaccctctcctgcagggccagtgagatgttggcagcaacttgcctggtaccagcaagaacctggccaggctcccaggcctcctctctatcgctgtcctccgaccgacgggcccctggtctcccgngtccgtaggttcggtggcggtgggtcgtgggacagtctttcactctcacatcgagtccgcctccagtctagagtatttgctactttnttctgtactaactctagtggtctcgtgcctcgtactacgtttcgaccgtagggaccaacgtggaagactacgaacgacgtacggtgtactcgtacacgtacttcgtcgttccttactacttccgtacccgtac

SEQ ID NO: 219902 - DNA, 774 bp, Homo sapiens
  misc_feature: GYAE6OF02ICCBG.24.87.H10.1.454.CMB.1.raw
  modified_base (164)..(164): a, c, t, g, unknown or other
  misc_feature (164)..(164): n is a, c, g, or t
  modified_base (181)..(181): a, c, t, g, unknown or other
  misc_feature (181)..(181): n is a, c, g, or t
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagccatcaccggaggattgtgttgacnagtctccaggcaccctntctttgctccgaggggngatacgcccacccttctcctgcagggccagtcagagtgttacgcngcagtctagtcgctgtaccagcaagtaaccgnggtccgtggcctcccgacggccttaccgtctacgtacttacgtcgggtaccgtaccgtacccacgacggggaccctacggtcgggtccgtacggaccgtaacgtcggttcgaggtacggtcggaagggttcggttcccggtttaggaacgtacggttaaccctttatcccttgtaccgtaactccgttaacgtaccggtaaacgtacggtaaaccggtacgggtacccggttaccgtaaacggtttaccgttttagtaccggtaacgttttacgtttaactttacggttacgttaccgtaacgtttcgggttttacgttttcccgggttacctttaccgttaccctttaaccgtttacgtttaccgtttacccgtttacgttttaccggtaccggtttaccggttaccgggtacggttccggtagggttaacccgtacgttaaccggtacgttaacggtacggttaccgttaggttaccggtcgttaccgtacttacgg

SEQ ID NO: 219903 - DNA, 580 bp, Homo sapiens
  misc_feature: GYAE6OF02FKGQB.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgtggcggtgggtctgggacagtatttcactctcacatcagcgcctccagtctgagtattttgctactttatttctgttactaacacttagtggtgtactcgggtccttccgtacttacgttttcggccgtacggggtaacctaaacgtggaacgtaacgtaccgaaacgtaacgttcggtacgggtctacggacctaccgtagttccttacgttccttaccgtacttcccgttccccgtaccc

SEQ ID NO: 219904 - DNA, 811 bp, Homo sapiens
  misc_feature: GYAE6OF02IJPXZ.24.87.H10.1.454.CMB.1.raw
tcagactactatgtcacgaccggtgctcgatttagcagtactgcgttgggtttgggggagggaactgctcagttaggacccagacggaaccatggaagcccagcgcagcttctcttcctcctgctactctgctcccagataccactggagaagtagtcatgacgcagtctccagccaccctgtacctgtgtcctcgaggggaaagacgcccaccctctccgtgacgcgggccagtacgagacttggtacggcacggactaacgttcggccgtgtaccgagtacaacggtaaaccgtcggaccgtagggtccctacccggtacgggccccttccctacccgtttactacgtcggtccttccggtcccttaccccgaccggtacccgggttccccgtcggggttaccctaccccggtaaccggtccggtacggggttttcggtcggggaccgggtttcggggtaccgtcggggtaaccgtagtttacgttttaccgaccgttcctaacccggtacccgttactacccgggtccgggtacccggtccctaccgtacggttacccgttaacgtacggtttactttccggtacctttaacgtttacgtttaccgtacgtacgttaacgtactttacggttaggtaccgttacggtccggtaccgttccgttaccttacgggttttacgaccggtaaccggggtaaccgtaacggttacgacgtaacgtaacgtaacggtacgttcggacggttacaccggtacctaaccgtctttaccggtcttaccgttccgtacttaccccgtccgttaacccg

SEQ ID NO: 219905 - DNA, 791 bp, Homo sapiens
  misc_feature: GYAE6OF02JT96D.24.87.H10.1.454.CMB.1.raw
  modified_base (120)..(120): a, c, t, g, unknown or other
  misc_feature (120)..(120): n is a, c, g, or t
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
tcagactactatgtcacgaccggtgctcgatttagcagtactgcgttgggtttgggggaggaactgctcagttaggacccagacggaaccatggaacgccccagcgcagcttctcttccncctgctactcgtggcctcccagatacccactggagaagtagtcatgacgcagtccnccagcccacctgtctgtntcnccgaagggaancgccacctctccgtagcgacggccagtagagtaattcggtgacagacctaagtacgccgttacggaaccagacgtaaacgaacccgtggacccgacggtccctacccgacggtcccttcccgttaccctagtacacgtccttacgttaccgacccgaccggcccgggtccccttgggtcctaacccccgaggtaccccggtttacggggttccggttacgggggtccggtttggggacccgttagggaccccgttaaaaggtttcccggtttccaacccggttacgaccccgtaacttacggtacccgtacgggtaccccggttaccctacccggttacgttacctaacgggttaaacgtttcgtttaccgtactttaccgtttagttcccaggtttaacccaacggttactaggttccgtacgttacggtaccgtcccgtttaacggttaccgtttacgggttacgacccggtaggtaacccttaaggtccggtaaacgactaaccgtaacgtaccgtggtccggacgttacgaccttaaccgtgtccttacgtaccgttaccgtaccttaccgtccctacg

SEQ ID NO: 219906 - DNA, 272 bp, Homo sapiens
  misc_feature: GYAE6OF02G0N9Y.24.87.H10.1.454.CMB.1.raw
  modified_base (129)..(129): a, c, t, g, unknown or other
  misc_feature (129)..(129): n is a, c, g, or t
  modified_base (255)..(255): a, c, t, g, unknown or other
  misc_feature (255)..(255): n is a, c, g, or t
  modified_base (258)..(272): a, c, t, g, unknown or other
  misc_feature (258)..(272): n is a, c, g, or t
tcagactactatgtcacgaccggtgctcgatttagcagtactgcgttgggtttgggacagatttcactctcaccatcagcggcctccagtctgaagattttgcactttatttctgtcaacactatggtnactggcctccgtacacttttggccaggggaccaaactggagatcaaacgaactgtggctgcaccatctgtcttcatcttcccgcatctagaacatagtagtctgagcgggctggccaaggcgacanagnnnnnnnnnnnnnnn

SEQ ID NO: 219907 - DNA, 847 bp, Homo sapiens
  misc_feature: GYAE6OF02HAP6R.24.87.H10.1.454.CMB.1.raw
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaagcgccaccctctccgngcgaggccagtgagaagttggttggcagactaacttacgccgttggtaccngacaacgtaaccgtcggaccacggccctacccggaggtcctccttcctactagtcgtcttcgtcccgtacccaccggaccgggtccccttcgggtccgtccccgagtcccggttagggtttcggttcgggacgggttggggtcggtcggggtaactacggttactttcgaaccgttctacccgtaaccctagtacccggtaccggtcccgggtaccctaccggtaccggtttaccggttaaacgggtttaacggtttaacgttttttccggtaacctttttacgtttttaaacgttttcccgttaacggttaacccttaaacgtttaccttttacgggttaggttaccggttacgttcccggggttaccctttacccggtttaacgtttacccgggtttttcccgggaaaccgggttaacgggggtaaacccctaaggttacgggaaaccgttaccgttaaacgaacccggttaacggttcgggtaacgggacccttacgggtacccttaaacccgttcgtttaccgttaccggtttacctttacccgtaccgtttaccccggtaccccgttaaccg

SEQ ID NO: 219908 - DNA, 670 bp, Homo sapiens
  misc_feature: GYAE6OF02IW4HO.24.87.H10.1.454.CMB.1.raw
  modified_base (200)..(200): a, c, t, g, unknown or other
  misc_feature (200)..(200): n is a, c, g, or t
  modified_base (498)..(498): a, c, t, g, unknown or other
  misc_feature (498)..(498): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccacctgtctgtgtctccgagggaancgccaccctctcctgcagggccagtgagatgttggcagacaacgtagccgtggtaccagacagaaacctggaccacggccctccgacggtcctacccttcctcgtactggtcttcgtacctcccgacccgtaccgggtcccctgggtccgtcccacggtccgtacgggtttccggttcggggtcgggttcggggtcgtaggggacctaggttacgtttcacttacctccaaccgtgtaccgcggtccggtcctcccgagttctaggtaagttctttacgtactttagtttacttcgtnttacctaactacgttagtcgtacgtaccgtcgtcctaccgttacgttcgtttacgggaccgtacgggaaccgtagacggaacgtacgtaccgtaacgtaacgttcggtggtccgtacaccgtacgtacgttaccgttcgtttccttaacgtacctttcccggtcccttaacg

SEQ ID NO: 219909 - DNA, 578 bp, Homo sapiens
  misc_feature: GYAE6OF02FVTHA.24.87.H10.1.454.CMB.1.raw
  modified_base (204)..(204): a, c, t, g, unknown or other
  misc_feature (204)..(204): n is a, c, g, or t
  modified_base (342)..(342): a, c, t, g, unknown or other
  misc_feature (342)..(342): n is a, c, g, or t
  modified_base (507)..(507): a, c, t, g, unknown or other
  misc_feature (507)..(507): n is a, c, g, or t
tcagactactatgtcacgaccggtgctcgatttagcagtactgcgttgggtttgggggaggaactgctcagttaggacccagacggaaccatcggaagccccagcgcagcttctcttcctcctgctactctggctcccagataccactggagaagtagtcatgacgcagtctccagccaccctgtctgtgtctccgagggaaangccaccctctcctgccagggccagtgagtaatggttgcagaccagttcgcctggtacagcacgaacctggccaggcctaccgaggtcctcccgtcctactagtgtctgtcctccgaccgacggtccctggtcgtcccngccgtggtcgtggcggtggtcgtggactgtcgttcacttctactacctgtacgacgcgtcctccgtagtcgtagtaagttctttcgcttactttacttgtacgtacacactagtacgtgactcggtaccctcgtactcgtttacgcgacgggacctaagacggtnaactcgtaacgacgtgtacggcctcgacctaccgtagtccttacgtccttactaccttcccgtcccgtacc

SEQ ID NO: 219910 - DNA, 613 bp, Homo sapiens
  misc_feature: GYAE6OF02GD9US.24.87.H10.1.454.CMB.1.raw
  modified_base (205)..(205): a, c, t, g, unknown or other
  misc_feature (205)..(205): n is a, c, g, or t
  modified_base (382)..(382): a, c, t, g, unknown or other
  misc_feature (382)..(382): n is a, c, g, or t
  modified_base (597)..(597): a, c, t, g, unknown or other
  misc_feature (597)..(597): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaanagcccaccctctcctgcaggccagtgagatgtgcagcaacttgcctgtaccagcaagaaacctggaccaggcctacccgaggcctccctcctctatcgcttcgtccctccgaccgaccgggtccctggtcgtcccagccgtaggttcgttgggcggtgggtcgtggacagtacttcnctcgcactatcgacgtccgtcctcgtagtcgtagtaagtagtttcactttactttcttcgtctaactaacctacttgtaggttcgtacgtcggtacccgttaccgttacgttacgtttcgggaccggtaacgggtaacccgtaaagtacgggactacgtaaccgaacgtacgtcggtacggacctcggacctacgttacttctagttacccttanccgttaccctcccacg

SEQ ID NO: 219911 - DNA, 642 bp, Homo sapiens
  misc_feature: GYAE6OF02H9PHS.24.87.H10.1.454.CMB.1.raw
  modified_base (205)..(205): a, c, t, g, unknown or other
  misc_feature (205)..(205): n is a, c, g, or t
  modified_base (387)..(387): a, c, t, g, unknown or other
  misc_feature (387)..(387): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccacctgtctgtgtctccgaggggaaancgcccaccctctctgcacgggccagtgagtaatgttggcagcaacttagcctggtaccagcacgaaacctggccaggctccaggcctcctcctctatcgctgtctccaccgacgggcccctggtcgccacgccgaggttcggtggtcggtgggtcgtgggacagtacttcgactctacaccntccaggtcccgcctccgacgtctagaagttagtttgtctactttatttctagtacctaactactacgttggtcgtacgtcggtccttaccgttacttaccgttttgggacccggtaacggggtaacctaaacggtacggtaacgtaacgttaaccgaacggtaaccgttagggtacggtacccgttacggaaccctacccgtaagtttccgttacggttacctttaccgtacctttaccccgtcccgttaacccg

SEQ ID NO: 219912 - DNA, 743 bp, Homo sapiens
  misc_feature: GYAE6OF02JAVL7.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgagggaaagngccaccctctcctgcagggccagtgagaatggttggcagactaacgttacgccgttggtaccagccgaacgtaaaaccgtggacccaaggcctaccccgaagggtcctaccccgttccctctaacgtcggtccttacgttccctcccgaaccgaccggggtcccccttgggtcctccccgacggtccccgtacgggtttcggttacgggtcgggttcggggtcctgggggaacctggtactttccgacttctcaccctatcgtacgccgtccctaccgtactcgtagtaacgttcgtttgacgttacgtttaagttacgtcgaccgttagaccgtacgtacctaacgtaggtacgtaccgttccgggacccgtaccttaccggttaacccgttttccgggggaccgggtaaggggtaacccggtaaaggggtaccggtaaggtacgaaacccggtaaacgggtaaccgtacgggttcggacgttacgaacccgttacctacgtttacccgtctttaccgttacgtccgttttacccccgg

SEQ ID NO: 219913 - DNA, 746 bp, Homo sapiens
  misc_feature: GYAE6OF02FGP8I.24.87.H10.1.454.CMB.1.raw
  modified_base (236)..(236): a, c, t, g, unknown or other
  misc_feature (236)..(236): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (718)..(718): a, c, t, g, unknown or other
  misc_feature (718)..(718): n is a, c, g, or t
tcagactactatgtcacgaccggtgctcgatttagcagtactgcgttgggtttgggggaggaactgctcagttaggacccagaccggaaccatcggaacgccccagcgcagcttctcttcctcctgctactctggcctccagatacccactggactaacgtagtccagttcgacgtcagtcctaccagcccaccgtgtctgtctctaccgaagggaactcgacctaccctctccgngacccgacgggtccagtcgaacgacttcggttagaccgtnaccttaacttcggcctaggacnggacacgaaccnggaacccncggtaccncccgtacgtccctcctccggtaatctcgtactacggcctacccacgggtccggtccctaggtccctaccgacgtcccggtaggttcggtcgggcggttcggtcgacgggtactacgtatttacccgcctaccgaacgtacccagtcccgtaccgccgtaccgtaaccgtacgtagttaccggtaacttaacgtttaccggacttttacgtttacgtaccgtagtacccgtaacgtactttaacggttcggtacttaccggttccgtacccggttaacttaaccggttccgtttaacgggtaccggtaaacggtaacctaagaccgtataacccggaactaacgtacggtcggtacgtaccgtaccgtaacctaccgtaacgtccgtttaacnccctttaggaccctttccggcctaaccc

SEQ ID NO: 219914 - DNA, 652 bp, Homo sapiens
  misc_feature: GYAE6OF02GWHSI.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccaggggaangccaccctctcctgcagggccagtgagatgtgcagcacttgcctggtaccagcagaacctggaccaggcctcccgaggcctccgtcctctatcgcttcgtcctcccgaccgacgggtcccctggtcctcccgagtcccgtagggttcgtcgggcggttgggtctggggactaggtactttcgacttcctccacctatccgacgccggtccctccgacgttccgtaggtaagttctttacgtacttacttttacgtttcctacgttacctaacttacgttagttcggtcgtacgtcggtacccttaccggtactttaccgtttacgggacccggtaacgggtaaccgtaaacggtcggaaagtacgtaaccgtaacgtaacgttggtccggtactacggacctaactacgtaccgttcggtaccttaccgtacttcccgttacccgtacc

SEQ ID NO: 219915 - DNA, 638 bp, Homo sapiens
  misc_feature: GYAE6OF02ISSVU.24.87.H10.1.454.CMB.1.raw
  modified_base (249)..(249): a, c, t, g, unknown or other
  misc_feature (249)..(249): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaagacgccaccctctcctgcagggccagtgacaatgtaggaagttgtancctggtatcaacacaaacagtcggccaggcctccccggctcctcatctatgatcggacactaccaagtacgggccacgtcggaccactcccagaccgtaggttcaggtcggtcgtgggttcgggtcgtaggggaccaggtacttaccgactccgtacacctagtcgagtactaagggttcgtaacgacggtaccgtaggtaacgtttgtttacgtacttacggttttattaccgttgttacacgtacctacggttacgaaccgtacgtcggtaccccttacggttacccggtcccggtacggaacctacgtacgtacgaacctaccgtaaccgaaccgtacgttcggtacgtaccgtacgacctacctacgttcgttcgtaccttaccg

SEQ ID NO: 219916 - DNA, 641 bp, Homo sapiens
  misc_feature: GYAE6OF02IFD4B.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaaancgccaccctctcctgcagggccagtgagatgttggcagcaacttagcctggtaccagacaagaaaccgtggaccaggcctcccgagcctcctcctctatcgctgtcctccgaccgacgggtcccctggtcgtcccagtcctagggttcgtggcggtgggtctgggactagtacgtttcactcctacacctagtccgacggcccggtcctaccgagttccgtagtaacgtacttttgacttacgtttatttcgttagtacctaaactacttacgtggtacgtacgtcggtacccttaccgttacgttacgttttacgggaccgtaacggggtaacctaaacgtggaacgtaactaaccgaaacgtaacgttggtacgtacgtacggacctaacctacgttcgttacgttacctttctaacgtttccctaccccgtaccg

SEQ ID NO: 219917 - DNA, 808 bp, Homo sapiens
  misc_feature: GYAE6OF02J11LJ.24.87.H10.1.454.CMB.1.raw
  modified_base (276)..(276): a, c, t, g, unknown or other
  misc_feature (276)..(276): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggcctcccagataccactggagaagtagtcatcgacgcagtctccagccaccctgtctgtcgctcgagggaagcgccaccctctcctgcgtagggcctaggtgacgaatcggttcggcacgtacgtaacgttcgcgtaccggttacncggacaaccggtaaacctcggaccgaacgggcccttaccccgacgggtccttccccgttcccgtacgttacgtcgtcgtccgttacccttacccggacccggtaaccccggggccccgtttcgggtacccgttacccgaacggtccccggttacgggtttccggggtttcgggaccgggggtttcggtacgggttcgggactcggtttaacgtttcccactttacccgccctaaccggtaaattcccggaaggttcccggtacccctacggttaaccgcgtttaacgtaacggtttagttttaccgcctttaacttttacgtttcgttacggtaaccttaacgttaccttaaggttcgtaacgttacgtcccgtaaccgttccgttacgttaccggttttaccgaccgggtaaccgggttaaccgtaaacgtcgggtaacgtaaccgttaaccgtaaccggacgtttacgggacgtccgtagtcccgtaactgtaccgtttacgtcccttataccgtttccgtacccttacg

SEQ ID NO: 219918 - DNA, 695 bp, Homo sapiens
  misc_feature: GYAE6OF02G1N88.24.87.H10.1.454.CMB.1.raw
  modified_base (516)..(516): a, c, t, g, unknown or other
  misc_feature (516)..(516): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
  modified_base (674)..(674): a, c, t, g, unknown or other
  misc_feature (674)..(674): n is a, c, g, or t
  modified_base (689)..(689): a, c, t, g, unknown or other
  misc_feature (689)..(689): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccactggagaagtagtcagtgacgcagtctccgacgcccaccctgtcgtgtcgtccgtaccggaggggaaacgcgcccaccctcctcctgccgacgggcccaggtagagaacgttggtcggactacgactaacgttacgccttggtaaccgagacgtaaacggtaaccgtcggaccgacggtccccgtaccccgtacggccccttcccgtcccttaacgttcgttcggtcctttaccggtccctacccggtacccggtaccggggtcccccttcgggtacccgtcccggtacgtcccggttacgggggtttcggtccgggggtacggggttcggtcgggtacgggtacacggtttacttcgactcctaccacntaccgcgccggtccacgtctcgtaggtaattgtttcctatactttattcctagtactacgtatntggtcncgtcgtacttaccgtagttccgtgaaccgacgtacaagggtnaacncgtaacgactgtcggtcgaccgctcaacgtcgtatccggttntaccgtacttcccgnttaccg

SEQ ID NO: 219919 - DNA, 723 bp, Homo sapiens
  misc_feature: GYAE6OF02IW57D.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagatacccactggagaagtagtcatgacgcagtctccagcccaccctgtctgtgtctccgagggaagngcccaccctctcctgcagggccagtgagaatgtggcagcaagttgcctggtaccagcaacgtaaccgtggccaggcctcccgaggcctcctcctacgtatcgccttcggtcctacccgacccgtacgggtcccccttggtccgttccccgacgttaccggaccgggtttcggttcgggcccgggtttgggcgttcggggactacggttactttccgaccttccgtaccgtaaccctagtaccgcggtacccggtccctaccgtacgtacgtacgtaagttacgtttcgtacgttacgtttactttcgttacgttaccgtaactacgttagttcggttacgtaccgtccggtccttaccgttaccgttccgtttacgggacccggtaaccgggtacctaaacggtacggtaacgtaaccgtaaccgtaaccggtaacgttcggtaaccggtacgttccgtaaccgtaccttaccgttaccgttcgttaccgtacttaccgttacccttccccgtaaccg

SEQ ID NO: 219920 - DNA, 801 bp, Homo sapiens
  misc_feature: GYAE6OF02JLLZH.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtcctgtgtctccgagggaaancgccaccctctcctgcgagggcctgtgagaagtggttgacagacctaacgttacgtccgtacggtaccacggaccgaacgtaaaacccgtcgggacccgtacgggaccccttaccccgacgggtacccttccccgtacccttactagtccgcttacggttcctcccgtaaccgaccgggtccccgtacgtcccgtaccgacgtccgtacggttcggttcggtacgggttcggtcgtacggggacctaagggttactttaccgcctttcccgtaacctaccctaacgtccgaacgggtccccggttaccctcccgtacgttaccgtaggtaacgttactttcgtacctttactttactttacgttccgtaaccttaacgttaccgttaaggttcgtacgtttaccgtaccggttccccgttaaccgttacccgtttacgtttccgggtaacccggttaaccgggtaacccgttaaacgggtacgtacggtaaactacccggttaaacggttacggtccggttacggtaccgttacgaaccttacccgtacgtttacgttaccggttccctttacttcccgttacctcccccggttaac

SEQ ID NO: 219921 - DNA, 652 bp, Homo sapiens
  misc_feature: GYAE6OF02G36OU.24.87.H10.1.454.CMB.1.raw
  modified_base (206)..(206): a, c, t, g, unknown or other
  misc_feature (206)..(206): n is a, c, g, or t
  modified_base (616)..(616): a, c, t, g, unknown or other
  misc_feature (616)..(616): n is a, c, g, or t
tcagactactatgtcacgaccggtgctcgatttagcagtactgcgttgggtttggggggaggaactgctcagttaggacccagacggaaccatggaagcccccagcgcagcttctcttcctcctgctactctggctcccagataccactggagaagtagtcatgacgcagtctccagccaccctgtctgtgtctccagggggaaanagcccaccctctcctgcagggccaggtgagaatggttggcagcaacttgcctggtaccagcaagaaccgtggccaggcctcccgaggcctcctcctctatcgctcgtcctccaccgcgggtcccctgggtccgtccccagtccgtagggttccggttggggcggttacggggttcgtaggggacctaggttactttccgacttcgtaccacctacttcggacggtcccggtcctacccgtagttccgtaggtaagttcgttttcgactttacttttacttccttacgtactaactacgttagtggtcgtaccgtggtcccttccggtactttcgtttacgggaccggtaacgggaacctaaacggttggaacgtactaacgaacgtacgtgtcggtctacgacctacgtnttacgttcgttaccttctaccgttcctacccgtacc

SEQ ID NO: 219922 - DNA, 830 bp, Homo sapiens
  misc_feature: GYAE6OF02INQSJ.24.87.H10.1.454.CMB.1.raw
tcagactactatgtcacgaccggtgctcgatttagcagtactgcgtttgggtttgggggaggaactgctcagttaggacccagacggaaccatggaagccccagcgcagcttctcttcctcctgctactctggctccagataccactggagaagtagtcatgacgcagtcctccagccaccctgtctgtcgtctaccgaggggaaagacgccaccctcctcctgcgacgggccagtgaagatcgttggacagacaacttcgcgtcggtaccagccaacgaaaccgtcggaccacggtcctacccgacggtccttcccgttccttctacgtcgtcgttcgttacccgtcccaacccgggtaccgggtccccgttacgggttcccggtacccgacggtacccgttacggggtttcccggttaggggtccgggttcggggttccgttacgggggaccgttaggttaacgttttccgaaccgtttccctaccgtaaccccgtaagttcccggaaccgggtcccggtacccgtcccgtaacggtttaccgtaggttaaacgtttcgtttttacggtacctttaaccgttttctttaccgttaccgttacttaaaccgtacgttttacggttacgggttacgttaccggtccgttacccgttaaccgttaccgtttaccggttttacgggaaccggttaaccggggtaaacccttaaacggtacggtaaacggtaacctaacgtaaccggtacgttacgggtcgtccggtacgtccaaccgttccgttacgttaccgttaccgttaccttaccgtttacccgtacccttaacccgg

SEQ ID NO: 219923 - DNA, 642 bp, Homo sapiens
  misc_feature: GYAE6OF02IV9GO.24.87.H10.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaanacgcccaccctctccgtgcgagggccagtgagatggttggcagcaacttgcctggtaccagcagaacctggaccacggcctccgaggtcctcctcctntactcggtcttcgtcctcccgaccgacggggtcccctggtccgtcccagccgtaggttcggtggcggttgggtcgtgggacagttacttcgacttctcacctatccgcggtcgtcctaccacggttactacggtaagttgtttacgcttaacgtttattacctgttacctaactacgttacgttcggtcgtaccgtcgtaccgttacgttaccgttaccgtttggacccgtacggggaaccctaaacggtggtaacgactaaccgtaaccgtagtaccgggtaggtaccgtacgaccaacccgtattaccgttcgttccttactacgttcccttcccgtacg

SEQ ID NO: 219924 - DNA, 691 bp, Homo sapiens
  misc_feature: GYAE6OF02ISZH3.24.87.H10.1.454.CMB.1.raw
  modified_base (311)..(311): a, c, t, g, unknown or other
  misc_feature (311)..(311): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcaatgacgcagtctccagcccaccctgtctgtgtctccgaggggaagacgcccaccctctcctgcagggccagtgagaatgtgcagctactgcctggtaccagcaacgaacctcggccagcctcccgaggcctccctcctctatcgctgtccnccgaccgccgggtcccctgggtcctcccacggtcccgtagggtttcggtggggtccggttggggtccgtaggggacaggttactttcgaccttcctacacctagtcgacggcccgtcctaccgtacgtacgtagtaacgttacgttttcgtacctttacttttactttccgttacgttaacctaaactacgttacggttggtacgtaccgtcggtacccttaccggttacgtttccggtttaccggaccggtaaccggggtaaccttaacggagggtaactaacgtaaccgtaaacgtaccggttaggtcggttaccgtacgtacccaccgttagtttccgtcgtttacccttacctaaccgtttcccgttcccgtaacc

SEQ ID NO: 219925 - DNA, 780 bp, Homo sapiens
  misc_feature: GYAE6OF02G68YF.24.87.H10.1.454.CMB.1.raw
  modified_base (190)..(190): a, c, t, g, unknown or other
  misc_feature (190)..(190): n is a, c, g, or t
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtcctgtntcctaccgaggggaaanacgcccaccctctcctgcgaggccagtganatgtgcngcaactgctggaccagcagaacctggccaggcctaccgaggcctccctctctatcgtctcgtcctaccgaccgtaccgggtcccctagggtcctaccccgacggtcccgtacggggttttccggtacggggtccgggtttacgggtacccggtttaggggaacccttaaagggtttccgttttacccgaacccgtttccgttaacccgaacccgttaagtaccgtaaccgggtcccggttacccgtaccgtaacggttaccgtaacggttaacgtttacgttttacgtaccttttaacgttttacgttcgtaacgttacctaaacttaccgtttagtcggttaccgtaccgttcggtcccctttaaccgggttactttaccggtttaccggaaccggtaacggggttaacccttaaacggtacggaaacgtacttaaccggaaacgttacgttacggtcggtaacctcggtaccctaacgttaccgttaccgtttcggtaccctttacgacccgttttacccgttcccgtaacccg

SEQ ID NO: 219926 - DNA, 852 bp, Homo sapiens
  misc_feature: GYAE6OF02IWS9G.24.87.H10.1.454.CMB.1.raw
  modified_base (227)..(227): a, c, t, g, unknown or other
  misc_feature (227)..(227): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (426)..(426): a, c, t, g, unknown or other
  misc_feature (426)..(426): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctccagataccacgtaggagtaagtagtcaatcgaacgcacgtctccacgtccctacccttgtaccgtggtacgtccgaccgaacgggtaagcncccgtaacctccgtcctggaccgaggtaccaggttagaacgttaagttcggtcgacgtaacgtacaacgtttacggcccgttaggaaccaaggcctaaaccggaaccggtcggtaaccgacggtccctaccggtacgtccnccttaccgtctacgtcnccgtagtcccctccgaaccggtccgggtcccgtcggttccncccgtaccgtaccggttcggttaccggtcgggtcggttaaccggggtccgtgggtacgacgtttaccttacggaccttcgtcccgtaacctacgacctacgggtcccgttccccgtacgtacggtaccgttaaacggtcgtttaagtttccggttacgttaaccgttttaacggtttcctacccgggttaactaaaccgtttacttacggttaacgttaccggttaccggttacgttaccccgtaggttttacccggtttaccggttaccggtaccgggaacccggttaaacgtaccggtaacgggtaagttaaccccgttaaagacccggtttacgttacggggtaacctaccggttcgtaacccggtacttaaccggttcttacccggtttagttacccgttcgttaccccgttagttaacccg

SEQ ID NO: 219927 - DNA, 692 bp, Homo sapiens
  misc_feature: GYAE6OF02FORNI.24.87.H10.1.454.CMB.1.raw
  modified_base (203)..(203): a, c, t, g, unknown or other
  misc_feature (203)..(203): n is a, c, g, or t
  modified_base (426)..(426): a, c, t, g, unknown or other
  misc_feature (426)..(426): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtctgtgtctccgaggggaangccaccctctcctgccagggccagtcgagaatgttggcagacctaacgttgcctaggtaccagcaacgaaccgtggaccaggcctccccgaggtccctcctcctactagtcgctccgtccgtacccaccgtacgggtccccttgggtctccccgagtcccggtagggtttccggttgggcggttcgggtcgtgggactaggtactttcgactcctcaaccgtntaccgacggccgtacctcgtacgtcgtacggaagttcgttttcgacctttaactttcttcgtgttaacctaactacgttacggtcgggttactccggttccggtacccttaccggttaccgtttaccggtttcgggaaccggtaacggggtaaacctaaacgggtcggtaactacgtaaccgaacggtcgttacggtacgggccttacggacctaaccgttagtttccgtacgtttacctccttacccggttccctacccctaacg

SEQ ID NO: 219928 - DNA, 748 bp, Homo sapiens
  misc_feature: GYAE6OF02IPRCY.24.87.H10.1.454.CMB.1.raw
  modified_base (150)..(150): a, c, t, g, unknown or other
  misc_feature (150)..(150): n is a, c, g, or t
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactgganaagtagtcatgacgcagtctcagccacctgtctgtntcctccgaggggaaancgcccaccctctcctgcgagggccagtgagaattggttggacacgactaacgttgccttaggtaccagaccgagaaacctggccaggccctccgaggcctccctcctcgtactcgtctcgtacctcccgaccgtaccggggtcccttcgggttccgtccccacggtccctacggggttttccggttacgggggttccgggtcggggttcgtacgggggtacacggtttactttccgaccttccgtaccacctacgtcgaaccggtccgtccctacgtcgtactacggtaatttcgttttagtactttacgttttactttcctttacgttactaaaccgttactttacggttacggttaccgttacggtccggtttcccgttacccgtttaaccgtttaccgtttttaccgggacccggtaaccggggtaaacccgtaaggttaccgggaaagtaccgttaaccgaaaccgtaacggtttacggtacgggttcgtaccgtacaccttacgtcctttacggttcttacgtaccgttcctaccccgtac

SEQ ID NO: 219929 - DNA, 838 bp, Homo sapiens
  misc_feature: GYAE6OF02H5YPR.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaacatggaagccccagcgcagcttctcttcctcctgctactctggctcccagataccactggagaagtagtcatgacgcagtcctccacgccaccctgtctgtgtctccgaggggaaancgccaccctctcctgcgacggccagtagagtaagttggtggcacgactaacgttacgccgttaggtaaccaggacgaaacggtaaaccgtcgggacccgacggtccctaccccggacggtcccttcccgtacccttcgtaacgtcgtccgtcgtaccctacccgaacccggtcccgggtccccgttagggtcccgtaccccgacggtacccggttagggtttccgggttcgggggtccgggttcggggttacggtacggggtaactaccgtttacgtttaccgtaccgtttacccgtaccgtaaccctacgttaccggccggtacccggtcccctaccggttacgttccggtaacggttaacgtttaccgttttacgttaccttttaaccgttttacgttttaccgttacgttaaccgttaaccttaacgttacggtttcggttacgttaccggtaccgttcccgttaccgtttaccgttaccggtttaccgggtaccggtaaccgggtaaccgtaacggtacggtaacgtaacgtaaccgtaacgtacggtacggtcggtacgtacgaacccgttaccgtacgtttccgtactttaccgttacgttacccgttaccccgttacccgtacccg

SEQ ID NO: 219930 - DNA, 810 bp, Homo sapiens
  misc_feature: GYAE6OF02FGU38.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctttgtctccgagggganagagccaccctctcctgccgagggccagccggagtgttaagtaagtacgttaggctggtaaccaacgaacgaaaccgtggaccaggcctacccgaggccttccgtcacttctaatggtaatcggtacctaccgaaacgtcggggtaccaaccgttcggggccccgtacccccgacgtacgggttccaagggtcggacgtagggttcgggtcgtggggaacctaggtaccttcgaacgttcctaccgacccgttacacggcctaacggcctaaggaccgtcgtaacggtaaacgttacggttttttacgggaccggtttttaacctacggtttacgaccggtaacggtaccgtacgggtaccccggttttccggccccgtttacgggaaccccttaaccgggtttaaccgggtttcccgggggggacccggggggggtaaaccgtaggggggttaacgggggtaacggaacggggtaaaccggtaaccgggttaacgttacgggggttcggtaccgtacggtacccgtaacccggtactttcccggttacgtttaccgttccgtaacgtttcccgttaccccggacgttaccttaccggtagtaaaccg

SEQ ID NO: 219931 - DNA, 749 bp, Homo sapiens
  misc_feature: GYAE6OF02FMT2A.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccaggggaaangccaccctctcctgcgagggccagtgagaatggttggcagacaacttgcctaggtaccagcaacgaaaacctcggaccaaggtcctaccacggtcctccctcctctatgcctgtcctcccaccgccgggtcccctgggtcgtccccgacgtcccgaggtttccggtcgggtcgggttggggtcgtggggaacctaggtacgttttccgacgttcctacgacctacgtcgtacggtcccgtcctacccgtagtccttaggtaaacgttacgttttcgtaccgttactttttaacgttttccgttacggtttaacctaaaccgttaacctttacggttacgggttacgttaccgttaccgggttacccgttaccgttaaccgtttaccgttttttaccggggacccggttaaccggggtaaacccgtaaaccggtaacggtaacgtaacgtaaccgaaaccgtaaccgttacgggtacggtcgtacgtaccgtaacctacgttaccgttacgtttccttaccgtttaccttaccgttccccgtacccg

SEQ ID NO: 219932 - DNA, 866 bp, Homo sapiens
  misc_feature: GYAE6OF02I459Y.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaacgacgccaccctctcctcgcgacgggccaggtagaacgtaagttcggttacggacgacggtacctaaacgttacgtccgttaggtaacccgaacggaccaacggtaaaacccgtcgggacccgaacggtccctaccccgaggtcccttcccgttacccttcttaacgtcggtccttccggttcctacccgaccggtaccgggtcccccgttcgggtccgtacccgaccgtcccgttacgggttcggtcggggtcgggttcgggtccggtagggtacgtaacggtttactttaccgaccttcctacccgtacctaccgttaccgaccggtcccggtacccttacccggtacgttaccgtaacggtaaacgtttgtttttaaccgtccgtttaaactttttcctttacgttaacggttaaccttaaaccttacggttaacgttcgggttaaccgtaccggttccggtacccgtttaccgttaacccggtttacgttttaccggggaacccggttaaacgggtaaccctaaaacggttacggaaacgttaaccgtaaccgtaaaaccgtacgtttacggggtaacgtaccgtacgtaaaccgtaagttaacctttacggttacgtttaccctttaacccgtaccgtttaccccgtacccgttaccg

SEQ ID NO: 219933 - DNA, 794 bp, Homo sapiens
  misc_feature: GYAE6OF02G8SUC.24.87.H10.1.454.CMB.1.raw
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcagtgacgcagtctccagccacctgtctgtcgtctccgaaggggaagacgcccaccctctcctcgcgacgggccagtgaagaagttggttggacgacgactaacgttcgccgtacggtaccgacgacgaacgtaaccgtcggaccgacggccctacccgacggtccctcctactctcgttagttgggtccggtcccgtacccaaccggccggacccgtcggtcgggtacccgtccgggacggtaccgtaggttaccgaggttccggcggtagggttcgggttacggtttcgggaacgtacggttacctaccgttctacctactactacgtacgcgtaccgtaggtcgtacggacggtaaccgtagtttaccgttcgacgtagttacgttaacgtttacgtcgttacgtacgttcgtttccggggtttccgtttcccctttacccgttcccgttttaccgttacgtttaccgtttaccgtttaccggttttcccggaaccggtttaaccgggttcccgggtaccgggttaccggttaacgggtaaacggtccgggttaaacccgaacgttaccgggttaaaccggttcgggttaaccgggtccttaacccgggccttaacccgttcgtttaaccgg

SEQ ID NO: 219934 - DNA, 692 bp, Homo sapiens
  misc_feature: GYAE6OF02GHH2H.24.87.H10.1.454.CMB.1.raw
  modified_base (171)..(171): a, c, t, g, unknown or other
  misc_feature (171)..(171): n is a, c, g, or t
  modified_base (234)..(234): a, c, t, g, unknown or other
  misc_feature (234)..(234): n is a, c, g, or t
  modified_base (556)..(556): a, c, t, g, unknown or other
  misc_feature (556)..(556): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctccagataccactggagaagtagtcatgacgcagtcncagccacctgtctgtgtctccgaggggaagcgccacctctcctgcaggccagtgagatggtgnagactacttagccgtggtaccagcgaagaaacccgtggacccgaggccctccccgaggtcctccgtcccttactacgtcggtcctgttccctccgaacccgtcccgggccccttgggttcctccccgagtcccggtagggtttccggtcggggtcgggttgggtaccggtggggacctaagggttactttcctaccgttctacccaccgtacgtccgaccgggtcccggtacccttcgacgtttacgaggttaagtttcgttttacgacctttaacgtttttatttcgttacgtacctaaacgtccgtttaagtcgggtacnccggtttcgggcccctttacgtacctttcgtttccgggaccggtagggaaccctaaaggcggtaagaacctaccgtaaacgtcgtggtaacgcttacgactccttagtcttgttacctcctacttcccgtccctac

SEQ ID NO: 219935 - DNA, 1006 bp, Homo sapiens
  misc_feature: GYAE6OF02GKE1Y.24.87.H10.1.454.CMB.1.raw
tcagactactatgtcacgaccggtgctcgatttagcagtactgcgttggggtttgggggagggaactggctcccacgttagggtaccccaggacggtaaccatggtaagccccagcgcgagcttctcttcctcctgactactctggctcccgagtagtaccacgtaggacgtaaggttacgtctagtcgtaacgttacgagtcctcctagccgaccgttgtctgtcgtcgtccgaggggtaagaggccgaccttcgtccgtcgccggtacggggccctaggtcggaagtaacttcggttggacgacgtacgtaaccttacggtccgttaggttaacccacgttaccgaaacggtaaaacccgttcgggacccgtaacgggtaccttaccccgggaacggtccgttaccccggttcccgttccgtaaacgttcggtaccgttacgggttcccgtacccgaaccggtaaccggggttccccgttagggttcccggttaccccggaacggttacccgttaacgggttttacgggttaccggggtcgggttaccgggttacggttaacggggtaaccttaaggtttaacgtttaccgtacttacccgttaaccgtaacccgttaacggtaccggtaacggtacccggccttaaccgtaaccggttacgtaacggttaaacgttaccgttttacgggaacttttaaacccggttttaattttaacccggtaccgttaaccgtaaacgtttaccgtttaacggtttaccggtaaacgtccggttacgggttaccccgttaaccgggtttaacctttaacgggtttttaccggaacccgggttaacggggaaaaccccgttaaacggtacgggttaaccgtaaggttaaaaccttaaacggggttacctttagggggttaacgggaccttacggggtaaacctaacccggttacgtttacggttaccgggtttaaccttacggtttacccgtccccggttccggttaacccgg

SEQ ID NO: 219936 - DNA, 802 bp, Homo sapiens
  misc_feature: GYAE6OF02GX2CQ.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtcctccagcccaccctgtctgtcgtctccgaaggggaaagacgccaccctctcctgcgagggccagtgagatgtggcagcactgcctggtaccagacaacgaaaccgtggccgacggcctcccaggtcctcccgttcctactagtcgtctcgtcctccgaccggccggtcccctggtccgtccccgaggtcccgtacgggtttcggtcggggtccgggttacgggtccggtaggggacctaggttacctttaccgtaccgttctaccacctagtcccgacggtcccggtcctccgtaaggttcgttaacggtaagtttacgttttcggacctttaacgttttacgtttaccggtcttaaacctaaaccgttagtttacggtccggggtctaacccggttccgggtaacccctttacccgggttaacctttccggttttacccggggaacccgggttaaaccgggggtaaacccttaaacggggtccgggaaaacgttaacccgttaaacccgggtaaaccgggtaccgttacggggtaaccggtaccgtacccgtaacccgttaaacccgtgttttccccggttacggttttacccctaaccggttaccccttttccccgtaccccgtacccgg

SEQ ID NO: 219937 - DNA, 713 bp, Homo sapiens
  misc_feature: GYAE6OF02G9LYQ.24.87.H10.1.454.CMB.1.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (303)..(303): a, c, t, g, unknown or other
  misc_feature (303)..(303): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctgggctcccagataccactgggagaagtagtcatgacgcagtctccagccaccctgtctgtgtctccgaggggaaagcgccaccctctccngcagggccagtganaatgttggcagcaacttcgctggtaccagacagaaacctggccacggctccaggcctcgtcctcgtancgcttcgtcctcccgaccgcgggccccttggtccgtcccgaggcctacgggttcggtcgggcgggtcgggtcgtaggggtactacggtatttccgaacttcgtaccaccgtacgtccgacggtacccgggcccttacccgacggttcctagggtaaacgttacgttttcgctttaacgtttttactttaccgttacggttaacctaaaccgttaacgtttaacgttagggttcgtaaccggttccgggttacccttaacccgggttactttaccggtttttccggggaccggtaaaccgggggtaacctaaacgggttggaaacgtacgtaaccgtaaacggtacctagggtcggtacgtacgaccgtactacgtactttcgtccttacaccgtttccttccccggtacc

SEQ ID NO: 219938 - DNA, 826 bp, Homo sapiens
  misc_feature: GYAE6OF02H5A8I.24.87.H10.1.454.CMB.1.raw
  modified_base (176)..(176): a, c, t, g, unknown or other
  misc_feature (176)..(176): n is a, c, g, or t
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (602)..(602): a, c, t, g, unknown or other
  misc_feature (602)..(602): n is a, c, g, or t
tcagactactatgtcacgaccggtgctcgatttagcagtactgcgttgggtttgggggagaactgctcagttaggacccagacggaaccatggaagccccagctcagcttctcttcctcctgctactctggctccagatcgccgaccggagactattgtgttgacacagtttttcnccacgccacctgtctttgctcgagggaancgccacctctctgcgaggcagtgactaagtggttaaggacgtttgtacgccgtggtaaaccaacgacgaaaccgtggccgaggtcctacccgaggtccttccctntacgttacttatacgtagttacgttcctaaccggtaaaccggtacggggttacctaccggtccggggtccccccggttacccccgtaccggttaacgggtttccgaagggggttcgggaccgttaacgggggttcggggttaccggtacgggggtaactaccggtttaaccgtttacccgtaactttcccgttacccgggtaaacccgtacgaccgggtacctaccggtaaccgttacgggaacgtaccgtaggtaaacgtttcggttttacggttacgtttacttacggtntaccgaggtacgcgttccgttacccggccgttccgggtaccttaccggttaacgggtttaccggggggaccggggggttaaccgaggggggttaaggacgggtaacggggtacgtaacggaacggtttggggacgtccggtacggtaccacccggtaacgtttcgggtacctttcgttactccgtttaccccgtaccgtacctaccgtttaccgtaagtaacgg

SEQ ID NO: 219939 - DNA, 735 bp, Homo sapiens
  misc_feature: GYAE6OF02IF7M7.24.87.H10.1.454.CMB.1.raw
  modified_base (347)..(347): a, c, t, g, unknown or other
  misc_feature (347)..(347): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagactactatgtcacgaccggtgctcgatttagcagtactgcgttgggtttgggggaggaactgctcagttaggacccagacggaaccatggaagcccagcgcagcttctcttcctcctgctactctggctccagagaccacggaagaaattgtgttgacacagtctccaggcacctgtctttgctccgaggggagagacgtccacccttctacctcggacgacggggcctaaggcccgggtaagttgttaagtaacgtacttagggctacggtacaaacgacgaaacctggaccaggccgtaccaggccttcctcaattcgtaatgacgtggtacctacaaacncgggtcaacgtcggaccgtccccgcgtaggttaccaggttcggaggtacggtgggttcgacggtacgtaactacggttcaacctcgtaccgaccgttnacggtcncggttaccaagacgtccgtagtaacggtatttacggttacggttacttacgttgacgtagtacgtacgtcgttaccggtcgtacggccgtaccgttaacggttccgggtacggggaaccggtacgggacgggtaacgggaacggacggtaaacgggaacgttacgggtaggtccgtacgacccgtaccggtaacgttccggttaacgttaccggttacctaaccgttccggttaaccccgtcgtaacgtttacccgggttaacgtaacgtagtttaaaccggg

SEQ ID NO: 219940 - DNA, 661 bp, Homo sapiens
  misc_feature: GYAE6OF02FIQZV.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaaancgccaccctctcctgccaggggcccaggtgagaatggttggcagcaacttgcctggtaccagcacgaacctggaccaggcctccccaggccctcctcctctatcgcttgtcctccaccgacgggtcccctggtcgtccccaggtcccgtagggtttccggttgggccgggttagggtcgtaggggactaggtactttcactctccaccgtactccgacgccggtccctaccgagtctcgaagttactttcgacttactttacttctgtactaactacgttagtcggttacgtacgtcggtacccgttaccgtacttaccgttttacgggacccggtaacggggtaaccctaaacgttagggaactaacgtacgaaaccgtacgtcgggtacgtcgtacgaccaccgtagttccgttacgttaccttaccgtactttacccgttccccgtaaaaccg

SEQ ID NO: 219941 - DNA, 684 bp, Homo sapiens
  misc_feature: GYAE6OF02JH2HX.24.87.H10.1.454.CMB.1.raw
  modified_base (485)..(485): a, c, t, g, unknown or other
  misc_feature (485)..(485): n is a, c, g, or t
  modified_base (616)..(616): a, c, t, g, unknown or other
  misc_feature (616)..(616): n is a, c, g, or t
  modified_base (635)..(635): a, c, t, g, unknown or other
  misc_feature (635)..(635): n is a, c, g, or t
  modified_base (655)..(655): a, c, t, g, unknown or other
  misc_feature (655)..(655): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagataccactggagaagtagtcatgacgcagtctccagccacctgtctgtcgtctccgaggggaaatcgcctaccctctcctgcgacggccaggtgacgtatggttacgcgagccaacgttacgccgtcggtaccgagacgaacgtaaaccgtcggaccgacgggtccctacccggtacggtccttcccttacccttagtaacgttcgtccgtttaccgtccgtaaccccgacccggtaccggggtccccgttacggggaccgtccccggacgtaccggtacgggtttccggtcgggttcggggtaggttaccggtgggtacctacgtctttacgacttctaaccncgtactcggacgtccgtcctacgtcgtacctggtaacgtatttccggaatttctttcgtcctagtaccacttactgtggtactcgtacggtccttcgttacttacggtggacccggacggtactaacggtnaactaacgacgtacgtcgngtacggtctacgctaacgtnttcgacgtttccacgtccttccgtctacg

SEQ ID NO: 219942 - DNA, 641 bp, Homo sapiens
  misc_feature: GYAE6OF02GGZ67.24.87.H10.1.454.CMB.1.raw
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
tcagactactatgtcacgaccggtgctcgatttagcagtactgcgtttggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaagagccaccctctcctgcgagggccagtggagaatgttggcagcaacttacgcctggtaccgagcaagaaccgtggaccgaggcctcccgagtcctccgtcctctactgctcgtcctaccgaccgacgggccctggtctcccgacggtccgtacgggttcggtcggtcgggtgggtcgtgggactagtcttcactcnctaccgntacgcgcccgacctccagtccgtagtattctttagtcttatttactttgtactctaactacttacgttgtcgtaccgtccggtcctttaccgtacgttaccgtttccgggaccggtaacgggtaaccgaaacgtaggtaactacgtaaccgtaaccgtacggttaggtcgggtaaccgtcgaccgttaccgtacgttacctcgtttaccgttcctacgtttccccgtaccctcccg

SEQ ID NO: 219943 - DNA, 657 bp, Homo sapiens
  misc_feature: GYAE6OF02HW450.24.87.H10.1.454.CMB.1.raw
  modified_base (205)..(205): a, c, t, g, unknown or other
  misc_feature (205)..(205): n is a, c, g, or t
  modified_base (423)..(423): a, c, t, g, unknown or other
  misc_feature (423)..(423): n is a, c, g, or t
  modified_base (468)..(468): a, c, t, g, unknown or other
  misc_feature (468)..(468): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaaggggaaanacgccaccctctcctgacgacgggccaggtgagaattggtggacagctaaactcgcctaggtaccagacacgaaacctggccaggcctaccgacgtcctccctcgttctagtcgtctcgtcctcccaccggccgggtcccctgggtccgtacccaggtccgtagggttcggtcgggtcggtcgggtcgtggactgtatttcacttctaccgtaccgtnacgcgacgacgtagccgtctagtattgttttgtaccgttttaacncgtgacaggactcggtccgttccgcgtccggtaccgttacgttaaccgggttccgggggacgggggaaccgttgggggtaacggacgggaacgggtaagaaccggttagtcgggttagccgttaggcccgtactacggttccttaggttccttacgtacttcccgttacccggacttacgtacgtaacg

SEQ ID NO: 219944 - DNA, 904 bp, Homo sapiens
  misc_feature: GYAE6OF02IOIK7.24.87.H10.1.454.CMB.1.raw
  modified_base (201)..(201): a, c, t, g, unknown or other
  misc_feature (201)..(201): n is a, c, g, or t
tcagactactatgtcacgaccggtgctcgatttagcagtactgcgttgggtttgggggagaactgctcagttaggaccagacggaaccagtggaagccccagcgcagcttctcttcctcctgctactctggctccagataccactggagaagtagtcatgacgcagtctccagccacctgtctgtgtctaccgagggaaancgccaccctctccgtgacgacgggccaaggtcggaagtaagttcggttacgggacctaagaccgtaaacgtttacggcccgttagggttaacccaacggaccgtaaaccgtaaaacccggttcgggacccgtaacgggccccttaccccgaacgggttcccccttacccccgtttcccgttaccgtttaacgttccggtccgtttccggttcccctaaccccggtaaccccggaaccccgggggttcccccgttagggttccccgttacccgaaccggtcccggtttacggggttttccgggttcggggtccgggtttacgggggttccggttacggggaaccttaagggtttaaccttttccgaaaccgtttcctaaccgaccgttaactccggaacggtcccgtacccgttaccgacggttacgtacggttaacgttacgttttacggtaacctttacgttttaacgtttcgtaccgttaactaaccgttaacgttaggttacggttacgtaccgttccgggttaccttacccggttacgtttaccggttttacgggacccgggtaacgggtaaccctaaacggtcggtaaaccgtaacgttaacgtaaccggtacgtttcggtacggtacccgtacgtaaccgtaccgttagtttccgttaccggttcctttaacggtacccgtttaccctacccgtacc

SEQ ID NO: 219945 - DNA, 938 bp, Homo sapiens
  misc_feature: GYAE6OF02JJVJE.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagatacccacgtggagtaaggtagtcatggaaccgcgaagtctccagcccacctgtctgtcgtctccggagggaagacgcccaccctcctacctcggacgagggccctaggtcgtaagaaggttggtttcgggccaacgtaccgtaacgttaccggaccgtcgggttacccgacgaccgtaaacggtaaacccggttcgggaacccggtacggacccccgttaccccggtacggggttaccccttaccccttacccgttacggttaccgttcggacccgtttcccggttacccgtacccgttaaccccgggtaacccccgggttccccgggttaacggggttccccgtaccccggtaaaccgggttcccggttaaacccgggggtttttccggggttccgggggtaccggggttaccgggggttaccgggtttacggggaaccggtttaaccgtttaccgtttacccggtacccttttcccgtaaacccggtaccccgttaaggtacccggtaccggggtaccccgttaccggtacccggttacggttaccggttaacggttaaccgggtttacgttttaaccggttccgtttaacgttttaccgtttaccgtttaccgtaacgttaaaccgttacggttacgttaccgggtacgttcgtacccgttccgtaccttacgttaccgtttcgggtaaccggtacgggtaaccctaaggtacgagtacctaagaccgtaacggtcgtacggtctagtaccgtacttcgtacgttcgtacttacgttccttaccgtccctacgg

SEQ ID NO: 219946 - DNA, 856 bp, Homo sapiens
  misc_feature: GYAE6OF02GRZZ6.24.87.H10.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
tcagactactatgtcacgaccggtgctcgatttagcagtactgcgttgggtttgggggagaactgctcagttaggacccagacggaaccatggaagccccagcgcagcttctcttcctcctgctactctggctcccagataccatggagaagtagtcatggacnagtcctccagccacctgtctgtgtctcgaaggggaangcccaccctctcctgacgacgggccaaggtgaaggtattggttcggcaacgtctaaacgttggacctacggtaaccagacgtaacgaaaaccgtggacccaagggaccctccgaacggtaccttaccctaccttacgtaagtccggtcttaccgttaccctacccgaacccggtaccgggtccccgttgggtaacccgtacccgaacggtccccggttaacgggtttccgggttaggggtaccgggttgggggtaaccgtacgggggtaactaacggttttactttaccgaaccgttccgtaactaacccgtaagtcccggtaacggtaccccggacccgtttaccgtaacggtaccgtaaggtaaacgtttagttttacggtaacctttactttacgtttaacccgtacgtttaaccaacttaacgttaacgtgggttaccgttacggttaccgggtacccgtttaccgttaaccgttttaaccgtttaccgggtaaccgggttaaaccggtaaccgttaaacggttaaccgggaaacgttaacgtaacccgtaaaacggttacggtacggttaacggttaccggtaacggtaccgtaaacccttcgttaacttaccggtttcctactttaccgttacccgtttaccccaaccg

SEQ ID NO: 219947 - DNA, 765 bp, Homo sapiens
  misc_feature: GYAE6OF02HRK3H.24.87.H10.1.454.CMB.1.raw
  modified_base (150)..(150): a, c, t, g, unknown or other
  misc_feature (150)..(150): n is a, c, g, or t
  modified_base (208)..(208): a, c, t, g, unknown or other
  misc_feature (208)..(208): n is a, c, g, or t
  modified_base (353)..(353): a, c, t, g, unknown or other
  misc_feature (353)..(353): n is a, c, g, or t
  modified_base (410)..(410): a, c, t, g, unknown or other
  misc_feature (410)..(410): n is a, c, g, or t
  modified_base (698)..(698): a, c, t, g, unknown or other
  misc_feature (698)..(698): n is a, c, g, or t
  modified_base (721)..(721): a, c, t, g, unknown or other
  misc_feature (721)..(721): n is a, c, g, or t
tcagactactatgtcacgaccggtgctcgatttagcagtactgcgttgggtttggggaggaactgctcagttaggacccagacggaacatggagccccagcgcagcttctcttcctcctgctactctggcctcccagactacccatgganaagtagtcatgacgcagtcctccagcccaccctgtctgtcgtcctaccgaaggggaanacgccctaccctcgcctagccgaacgggcctagtgaacgtaagtcggttagctagactaaacttcgccgttacggaaccgaataccgaaacggtaaaccgtcggacccgtaggccctacccgaacggcctaccctacgttcacgntcgcgtacctccgaccggccggtcccgtggtaccgccacggtccgtagggtttcggnggtccggtcgggtacgtacgggacttacggtacgtttaccaccgttactacccgaaacgtcgtaccggtaacggcccgttccctacgtaccggttacgtacgttaacgttacgtttactacttttaacgtttcttttacaccgttaacaaccgtttacgtacgttaggtaccgttaacggttccgtacccgtttacgtaccgtttacgggtttaccggaccgggtaaaccggttaaaccgtaacgggtcgtaaacgtaaccgtaaccggaacgtttaccggttacggnggtcccaacgtaccttaaccgtnttcggttaacctttccgttacccgttaccttcccgtaacccgtc

SEQ ID NO: 219948 - DNA, 690 bp, Homo sapiens
  misc_feature: GYAE6OF02HFP5B.24.87.H10.1.454.CMB.1.raw
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagactactatgtcacgaccggtgctcgatttagcagtactgcgttggggtttgggggaggaactgctcagttaggacccagacggaaccatggaacgccccagcgcagcttctcttcctcctgctactctggctccagactaccacgtggagaagtagtcatgacgcagtctccacgccacctgtctntgtctcgagggaancnccacctcnctgcaggcnganagtaatgtgcacgactactagcctggtacngacacgtaaccngacacggctaccgacgtcctcctcttacctgtcgtcttacggtcctccgaaccggtccgggtccgttcgggtctacccgcggtaccgtttacgggtttcggtacgggcgggttacgggtcggtagggacgttacggtttacttccgacttccgaactaaccgttacgtccgacggcccgttaccctcgtacgttacgtagttaacttacgtttcgttactttacgtttctttctacgtaacttaacgttacttgttacgggttacgtccggttacgtacccttggttaaccttaccggtttcgacgggtaaccggaccttaacggtaacggaacttaccgtacgaacggtaccgttagggcctcgtaccggacttaccgtgttaccgttacttcgtaccgtttccgttacccgtccctaccg

SEQ ID NO: 219949 - DNA, 699 bp, Homo sapiens
  misc_feature: GYAE6OF02FYWTY.24.87.H10.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtctgtntctaccgaggggaangccaccctctcctgcgacgggccacggtgaagtagtggttggactacgcgtaacttcgccgtacggtacagtactaacgaaaccgtcggaccgaacggtccctccgaaggcccttaccctccgttctacgtcgcgttcgtcctacccgaccgtacgggcccttgggtacctccgaacggtcgttacgggttcggtcggtcggtgggttcgacggtactagttcttacgcctcgtacacctacgtacgacggtcccgtacctacgtatcgaagtagtttactttcgactttacgtttacttcagttacaaacgttacgttagttcggtacgtacgttcccggcctttaccgttaacgttcgtttaaccggaccggttaacgggaacctaaacgtcggtaaacaacgttaaccgaacgttacgtaggtcggtcctaaacgtcctaacgtagttccttaacggttccctactaacccggtttccctacccgttaaccg

SEQ ID NO: 219950 - DNA, 719 bp, Homo sapiens
  misc_feature: GYAE6OF02G5DUU.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaaanagcccaccctctcccgtgcgagggccagtgagtaatggttggcagctaactagcctggtaccagcagaacctggaccaggcctcccgaggtctcccgtccttctagtcgtcctacgttcctaccgaccgtaccgggccccttgggtccgtccccgagtccccgtagggtttccgttcggggccgggtttgggtaccgtttgggaaccgttaggtagttttccgaccgttcccttaaccgaccctactccggtaccggtacccggtcccgtacccggtaccggttaccgttaaggtaaacgtttacgttttacgtccgttaaacttttacgtttccgtacgtttaccgtaaactacgttacgttacgggtcgttaccgttacggttcccttacccggtacctttccgtttacggtaccggacggggtaacctaacggtaggtacgtacgtaacgaacgtacgtacggtcggactcggacgtaccgtatcgttactcgttactacttcctccgtacc

SEQ ID NO: 219951 - DNA, 745 bp, Homo sapiens
  misc_feature: GYAE6OF02FXLUM.24.87.H10.1.454.CMB.1.raw
  modified_base (207)..(207): a, c, t, g, unknown or other
  misc_feature (207)..(207): n is a, c, g, or t
  modified_base (423)..(423): a, c, t, g, unknown or other
  misc_feature (423)..(423): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgagggggaaangcccaccctctcctgcgagggccaggtgagaatgttggcagcaacttagcctggtaccagcaacgaacctggccaggcctcccaggcctcctcctctatgctgtcctaccaccgacgggtcccctgggtccgtcccacgtccgtagggtttccggtcggggtcgggttcggggtcgtacggggactacgtacttttccgaccttctacgaaccctntacccggagggcccgtccctaccgtacgtcgtacggtaacgttattttcgtacctttaaccttttactttaccttcgttaacctaaaccgtacgtttaacgttcgggttactaccggtttacccgggttacccttaccggttaccgtttacccggttttacggggaacccggttaaacggggtaacccgtaaacggtacggaacgtaacgtaaacccgtaacgtaaccgttcgggtccggtacgtaccgtacccgtaacccttacggttccgtttacggttaccctttaaccgtacccgttttacccgtaccccgttacccg

SEQ ID NO: 219952 - DNA, 741 bp, Homo sapiens
  misc_feature: GYAE6OF02JJQLL.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagatacccactggagaaatagtgatgacgcagtctccagccaccctgtctgtgtctccgagggaacacgcccacctctcctgcagggccagtgagatgttgcagactaacgtgccgtgtaccagacagaacctgccagcctccgaggtcctccgtacacgtctagtcggtcgccgtacccaccggacgggccctacggtcggtacccggttccggaccggtaaccgtacgggtttccaacgggtcggtaccgtaggttcggttcgtttacgggaacgtacgtacgttcacgttctacgtactcgacgtacgaacgtacggacgtcggaccgaccgtaagttacgtttacggacgtagttaacgttacgttaacgttcggttaccgtacgttccgtttacgggtttcccgtacccgtttcccgtttaccgtttaccgttaacgtttaccgtttaaccgtttaccggtttttaccgggaacccggttttacggtacccggtagggttacccggttacgggtaaccggttacgttaccggtaaaccggtaccggttaacgttacgggttccggtacgttacccggacgttaacccgtcgttacccgg

SEQ ID NO: 219953 - DNA, 774 bp, Homo sapiens
  misc_feature: GYAE6OF02I3BNI.24.87.H10.1.454.CMB.1.raw
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagataccactggagaagtagtcagtgacgcagttctccacgcccacccttgtcctgtcgtctccggagggaagacncccaccctctcctgcagggccagtgagatgtgcagacaacttcnccgtggtaccagcaacgaacctgacctggccctccgagcctaccnctatctatgtacttacgtcctacgaacgtcggtcacgtcggcccgtcccgtcgtcgggtacaggtcggcgacgggttcggtcgagggtaccagttaaccttcctaccggttcctacccgtaccgtacgtacgaccgtaacggcccgtaagggaccgttaccgtagggttaacgtttcgttttacgggttacccggtttttacctaacgttcggtccgtaacggtcccgtaaccgggtttccggtcccccgggttcgggtacccggtacccgggttttaccccgttcgggggtttacccggggggggtaccgggggtaaccccggtggggggtaaaccgggaacggggtaacgggtacccgggtacggttacggttacggggtcccgggttacctacgggtaccgtaacccggttccggtttactttaccggtaccgttccgttaccggtttaccccggcccgttaacccg

SEQ ID NO: 219954 - DNA, 663 bp, Homo sapiens
  misc_feature: GYAE6OF02JCGLS.24.87.H10.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgagggaaagngcccaccctctcctgcagggccagtcagagtanaagaagcaactacttagcctggtatcaacacgaaaccgtcggaccaggcctacccgaggtccttcccgtacatacctagttggtaatactccagcgacgggcctacgtggtcgtccccaggcctaaggttccagtggcgtaggttcgggtcgtgggactagtacgttccactcgtaccacctagtccgagtctacgtccgtcgacgtacgtacgttaggtaaagttgttttacggaaccgttttaagttttaacttaccggtacgtacctaaggtccgaacgtacccaacgtacggggttcacgggtttccggaacctcccgtaccgttaccgggtttcgggaccgggtaacggtaccggtaagggttggaacgtacgtaacgtaaaccgtacgtcgggttagaccggtaccgtacgtaaccgttcg

SEQ ID NO: 219955 - DNA, 767 bp, Homo sapiens
  misc_feature: GYAE6OF02GYG2C.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgctagtcctccagccaccctgtctgtgtctccgagggaaagagcccaccctctccgtgcgacgggccaggtagtagaagtggttcggacagtactaacgttacgccgtaggtaccgacgactaacgtaaaccgtcggacccgtacgggcccctaccgaacgggtccctccctacccgttaccgtagtcgtccgttcgtcccgtacccgtaccgaccgggtccccgtgggtccttccccgaggtcccgtacggttcgttcgggcgggttcggggttcgtacgggactaggtcttacgtacctctactaccgctacggaccgcgtcccgtacgtacgtcgtacgtaagttacgtttcgtaccgtttaactttcgttacttacggtaactaaccgttacgtacggttcggttacgtaccggttaccggttacccggttacccttaacggtttacgttttaacccgggacggtaacccggggtaacctaaacggtacggtaacgtaactaacccggtaacgtaccgttacggtgtaccgtcccggtaacacccgtttaggctttccgggtacctttaccgtaccgtttccccgtacccgttacccg

SEQ ID NO: 219956 - DNA, 782 bp, Homo sapiens
  misc_feature: GYAE6OF02FOQGB.24.87.H10.1.454.CMB.1.raw
  modified_base (204)..(204): a, c, t, g, unknown or other
  misc_feature (204)..(204): n is a, c, g, or t
  modified_base (721)..(721): a, c, t, g, unknown or other
  misc_feature (721)..(721): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccacgtggagaagtagtcatgacgcagtctccagccacctgtctgtgtctcgagggaaagncccacctctcctgcgagggccagtgacatgtgcagctacttacgccgtggtaccaggcaacgtaaaccgtgggacctaacgggcctacccccgagggtcccttaccccttacccgtattacgtcgtccgtttggtccctcccgaccggtcccgggttaccccgttcgggtcccgtacccgaccggttccggttaaccggggttttcggggtggggttcccggggtggggttacggacgggggtaactagggtttaacttttcgaccttcctaccgtaccgtacgttacgaccggtacccgggtcccgtttaccgacgggttcctaacgggtaacggttttacttttcgtacgttttaacttttactttcggtactttacgtaaccttactttacggtacggttaccttacggttcgtcccgtttacgttaccgttaccggtttttcggggaaccggtaccgggtaaacctaacggttcggtaacgtacgttaaaccgacgttaaccggtcgggttcnccggttacggacctaaccgttgtcgtttacgtcctttacgtcccgtttcgtaccccggtac

SEQ ID NO: 219957 - DNA, 688 bp, Homo sapiens
  misc_feature: GYAE6OF02HBWGM.24.87.H10.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctcgagggaangccaccctcncctgcaggccagtgagatgtgcagcattgctggtacngcagaactgccaggcctccgagcctcctctctatgctgcctccaccgcggccctgtctcccagccgtggttcgtggcggttggtcgcgggactagtacgtttccacgttcctacgacctagtcccgacgggtccgtacccgtcctacgttacgtaggtaaacgttcgttttcgaccttttacgtttaatttcccgggtacttacccgttaacgtactttaggttccgggttcgtaccgttccggttacccgttacccgttactttaccggttttccgggaaccgggtaccgggtaaaccttaacggtacggtaacgtaaccgttaacggaaacccgttaggttaccggtccggtaacgtccgggaaccccttacgttaccgttccggtttaaccgtttccggtttaactttccccgtttacccgtttaacccccgtaacc

SEQ ID NO: 219958 - DNA, 807 bp, Homo sapiens
  misc_feature: GYAE6OF02FO23G.24.87.H10.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
tcagactactatgtcacgaccggtgctcgatttagcagtactgcgttgggtttgggggaggaactgctcagttaggacccagacggaaccatggaagcccccagcgcagcttctcttcctcctgctactctggctcccagataccactggagaagtagtcatgacgcagtctccagccaccctgtctgtgtctccgagggaaanagcccacctctccngcaggccagtgagatgttgacngacaacttgccgtggtaccacgcacaacgtcggccaggctcccgacggctcccgtcctntatgctcgtccacctaccgaaccgggtccccgtgggtcgttccccgacgtcccggtacggtttccggttgggtcccggggttgggggttccgtacggggggtacctaacggtacgtttttaccgaccttccgttaccgaaccctattcccgacggtcccggtcccttacccgacggttacttaagtaaacggtttacgttttacggtacccgtttaacgtttttactttaccgttcgttaccctaaactaccttaagtttacggttaccgttaacgttccgggtaccccgttcccggttaacttttacccggtttttaccgggaccccggttaaacgggggtaaccctaaaaccggttcggtaaacggtaacctaaccggtaaacccggttacggtacgggtttaccgggtaccgtaccgggtacccttaaaccccgttaaccgttcccggtttaacgtttaccccgtttacgtaacccgttacccccgttttaccccgtaacccccg

SEQ ID NO: 219959 - DNA, 676 bp, Homo sapiens
  misc_feature: GYAE6OF02FJ7C0.24.87.H10.1.454.CMB.1.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggctcccagactaccactggagaagtattcatgacgcagtctccagcccaccctgtctgtgtctcgagggaaangccaccctctcctgcagggccagtganatgttggcagcaacttacgcctggtaccagacaagaacctggcctggacctcccgaggcctcctctatcctagtcggtcgccgtcccacgacgggtcccacgtcgggcgtcgggaccggtactacgggttcacggtggtccggaggttcgggttcgtttcgggactacggtaccctttcgaacgttccttacgattaccggattccgaacgtacggaaccgttcgggaaccgtccccggtaaagtttacggtttacgacggtaagttaggtttaaccttacgttcgttacgtaccgttcgtttcggttttccgtcccgttactttccctacgttaacgttcgtttaacccgttcgttttaccggccgttacgggttccgtacgggttacgtgggtacgtacgtacgaggtacctacgtcgtacgcgtacggacctcgtattccg

SEQ ID NO: 219960 - DNA, 701 bp, Homo sapiens
  misc_feature: GYAE6OF02IM7JD.24.87.H10.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
tcagactactatgtcacgaccggtgctcgatttagcagtactgcgttgggtttgggggagaactgctcagttaggacccagacggaaccatggaagccccagcgcagcttctcttcctcctgctactctggctcccagataccactggagaaatagtgatgacgcagtctccagccacctgtctgtntctccgagggaancgccaccctctcctgcacgggccagtcagagtaataacgaagcaactacttagcctggtactacgaacaagaaaccgtcgaccaaggtcctacccgaggtcctcctcatctagtagtatactccgagccgacggtccacgtggtacctccgacgtccgtacggttcagggtcggctagggttcgggtacgtaggggtaacctaggtcggttctacgtccttaccaaccgtacgtcacgtacgtacggttcctagacctacgttacgttaggtaaaccggtttcgttttagtacgtttaaacgttttaaccgttacgttccggaccttacggaccgtacgtaccgtaccgtaggtacgtaccgtccgggtaccgtacccgttaccgttaccggttaccggggaccgggtacgggtaacccggtaagggtaccggtaacggtacgttaacccggtaaaacggtcggttacggtaccgggtcctacggtaccccgacgttaccg

SEQ ID NO: 219961 - DNA, 609 bp, Homo sapiens
  misc_feature: GYAE6OF02IAJZ5.24.87.H10.1.454.CMB.1.raw
  modified_base (149)..(149): a, c, t, g, unknown or other
  misc_feature (149)..(149): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
tcagactactatgtcacgaccggtgctcgatttagcagtactgcgttgggtttgggggagaactgctcagttaggacccagacggaaccatggaagccccagcgcagcttctcttcctcctgctactctggctccagataccactgganagtagtcatgacgtcagtctccagccacctgtctgtctctcgaggggaaancgccaccctncctgcaggcctaagtnacgatgtacggntagcaatttgcctggtaccagcagaactggccaggcctccgagtctctcngtatgctgcactaccgacggccctgtcgtccagcctacggttcgtggaccgtgggtcgtggactgtatttaccgngttcnccgataccgtnaacgtcgggacctcgagtactacgtaacgtagtttacgcgttactttaacttcgtcgttaacaactacgttatggtcgtacgtacggtcctaccgtacttacgtttacggccgtaacgggtaaccaaacggttgaacgtctaacgtaaccgtaacgttacgggtccgtacggtacgtacgtacccgtaagttcgtacgttaccgttactacgttacccttcccggttacc

SEQ ID NO: 219962 - DNA, 813 bp, Homo sapiens
  misc_feature: GYAE6OF02GG8I2.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccacctgtctgtgtctacgagggaaagcgcccacctcctcctaggaacgggccagtccaagtagtaagtaagaagtcctaaacgtacttaacgccttaggtaattaccaacgaacggtaaaaccctgggacccctaacgggtacccgtaccccgaaggtccctaccccgttaccccttacgttaacgtcggtaaccttccggtaccttaccccgaaccggttacccggggcccccgttaggttccgtaccccgtaacgccggtacggttttaccggttacggggtcggttacgggttcggtacggggaccttaagggttacttttaccgaaccttaccgtacgtaaccctacgtaccgacgggtacccgtccgtacccgtagttcgttaacggtaacgtttagttttacgccgtttaaacgttttaactttcgttacgttacgtaaacctacgttaacttacggtacgttacgttacgtacccgttacccgttacgttaaccgtttccggacgtaaccgggtaacctaacgttacggactaacgtaacgtaaacgtacgtacggtacggtctacgaacccgtacgtacgttacttacggttaccttaccgttaccgttacccgttacccgaccttaccg

SEQ ID NO: 219963 - DNA, 823 bp, Homo sapiens
  misc_feature: GYAE6OF02HDVUD.24.87.H10.1.454.CMB.1.raw
  modified_base (206)..(206): a, c, t, g, unknown or other
  misc_feature (206)..(206): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccacgtggagaagttagtcatgacgcagtctccagcccacctgtctgtgtctccgaggggaaancgccaccctctcctgacgacgggccaggtagagtaagttggttcggacacggacaaacgtttagcccgtaggtaaccaggactaaacggaaaccgttcggacctaacgggcctaccccgaagggcctttaccccgtcccttactaagtcgtaccgtcgtaccctacccgaccggaccgggaccccgtttgggtccgtaccccgtacggccggtttaacggggtttccgggttggggtccgggttcgggggtcttaacgggggtaactacgggtttactttccgactttccgttaccaaaccttacgtccggtaacgtcccggtaccctaccgtacggttacgttacgtaaacgtttagttttaacggtcctttaacctttagtttaccttcggttaaccttaaccttaacgttaggttacggttacggtacccgttccgggtacccgttaccgttaccgttaccggtttttccgggaaccggtaaccggggtaacctaaacgggttacgaacgttaacgtaaccgtaaacggtacgttagggtcgtacgttacggacccgtaaccttaggttaccgttaacttccggtttacaccgttttcccgtaccccgtaaccg

SEQ ID NO: 219964 - DNA, 773 bp, Homo sapiens
  misc_feature: GYAE6OF02JTQ0Y.24.87.H10.1.454.CMB.1.raw
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
  modified_base (478)..(478): a, c, t, g, unknown or other
  misc_feature (478)..(478): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggacgaagttagtcagttcgaacgcacgttcnccagcccgtaccttgtctgtgtcctacgaggggaanacgccacccgtcttccgacggcgacgggtcccaggttagagtaacgttggttcggacacggaccttaacgttacggccgtacgtaacgacgtacaacgtaaccgtggaccgtacgaccgtaccgacggtcctccgtccgtctacgtctacgtcgtcctccgtaaccgtccggtccccgtaggtccgtacccgtacgtacccgtacgggttcggttcggtcggttcgggtcgtacgggtactacggttcttcgtacgttaccncgtacgtacgtacgacggtccgtaccgtaccgtacgttcgtaacgtacgttacgtttcgtacgttttaacgttttcttacccgtttaggtaccttaacgttaccttaggttacgttaccgtaacgttccggttcccgtttaccgttacgtttccggttaccggtaccggttaacgggtaacctaaacggtcggtaacgttaacgtaaccgttaagtaccgttacggttaccggaccgttacgacctacgtagttaccgttacgttccttacgttaccgttacccgttccgtaccg

SEQ ID NO: 219965 - DNA, 848 bp, Homo sapiens
  misc_feature: GYAE6OF02GWP0R.24.87.H10.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagcccaccctgtctgtntctcgaaggggaanagcccacctcctcctgcgagggccagtganagtgttggnagacaacttacggcctcggtaccagacgacgaaaccgtcggaccgaggccctacccgacggtccctacccgtcccttactacgtcgtccttcggtccctaccccgtaccccggacccggggtcccccgttcggttcccggttaccccgaccggttaccccgggttaacggggttttccgggtttacggggggtcccggggttccgggggttcggttacgggggtaaacccgtaaggttttaacccgttttaccgtacccgttaccccttacccgtaaccctaccggtaccgtaaccgggccccgtcccttaccggtaccgttacgtacgggtaacgtttacgttttaccggtacttttaaccgtttttacgtttcgtttaccgttaacttaaacccgttacgtttaacggttaggttacggttaaccgtcccgggttacccgtttacccggtttaacgttttacggtttttaccgggaacccgggtaacggggttaaaccctaaacgggttacgaacgtacgtaaccgtaaaccgtacggtggtaccggtacgttaccgacctactaccgttctttcgtaccttcgtaccgttcccttacccgtcc

SEQ ID NO: 219966 - DNA, 810 bp, Homo sapiens
  misc_feature: GYAE6OF02GMQXF.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagactaccacgtggagaagtagtcatgacgcagtcctcagccacctgtctgtgtctccgaagggaanacgccgacctctcctgcgacggccagtcgagtagtggttgacacgacgtaacgttacgccgtacggtaccaagacgtaacgtaaaccgtcggaccgacggtccctacccggacggtcccttaccgtactacgttaccgtagttaccggtacgttaccggttaccgtaacccgtaaaacgggtccggggtaccttaccggtccgggtacccccggttacccccggtcgtaaccggggttaccgtcggttaccggtacggggttacgggttacggggtacgttacggggaaccttacggtaccttaccgtaaccttccggttacccgtaacccgtcggtaaccgtcccgtaacgtaccggttacgaccggttaccgtacgttaaacgtttcggtttacgtaaccggtttacttaccggttcgtaccgtaacggccgttacggttcccttaccggcccggttacccggtaccggtttaccggtttaaccggggttccggggtaaccggggtacggtacgggttaggaacgggttacgaacggtacggtacgtcggtacgaccgtacgtccgattcgtcgttacggttcaccgtccttacccgccgtacg

SEQ ID NO: 219967 - DNA, 814 bp, Homo sapiens
  misc_feature: GYAE6OF02GG2JQ.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggaagacgcccacctcctctcgcacgggccagtcgagaagtggttggctagacaacgttacgccgttacggtaccagaccgaacgaaccgtcggaccacgggcccctaccgacggtcctcccttcctaccgttagtcgtccgttacgttcccgttcccgaaccccggtaccgggtcccccgttacgggtccccgtacccgacggtacccgtttacggggtttcggttcggggttccgggttaggggttccggttagggaccgttacgttacgttttaccgacctttacctacccgtaccgttacgtcccggtaaccgggtcccggtaccccgttacggtacgttcccgttaagggtaacgttttacgtttcgttaccttttaacgtttttactttaccgtttacgtaaccttaactaccgtttagtttccggtagtcccgttccgggtcccttaccgtttaccgttacggttttaccggggtaccggtaaccgggttaacctaaacgggtcgtaaccaacgttaaccgaacggttaactcggggtactacggttacgacccgtaaccgttacgttaccgttcgtttaccgttaccttccgttcccgttccctaccgg

SEQ ID NO: 219968 - DNA, 570 bp, Homo sapiens
  misc_feature: GYAE6OF02I3CUJ.24.87.H10.1.454.CMB.1.raw
  modified_base (204)..(204): a, c, t, g, unknown or other
  misc_feature (204)..(204): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaggggaangccaccctctcctgcacgggccagtgagaatgttggcagcaacttagcctaggtaccagacaagaaccgtggccaggcctccgaggcctcctcctctatcgctcgtcctccgaccgaccgggtcccctgggtccgtacccgcgccgtagggttcgtcgggcggtggggtctgggactagtacttcacttcncacntcngtccgctcagtcagtaatctttgacttactttacttcgtcgtactactcgtatcgcgtctcgctcgtactcgttcgacgtacggacctaagtcggaagactacgaacgtagtcggtcgtacgtacgactaccgtatcgttacgttccttactcttaccgtccctaccg

SEQ ID NO: 219969 - DNA, 757 bp, Homo sapiens
  misc_feature: GYAE6OF02GWLQI.24.87.H10.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaagtagtcatgacgcagtctccagccacctgtctgtgtctccgaggggaancgccaccctctccgtgcgaggccagtcagagtaanaagacgacaactacgttacgccgttaggtaactacgaaacaacggtaaaccgtcggaccgacggccctacccgaggtcctccgtacagtcttagttacggttaactactccgaggccggtacggaccctacgtcgggttaccgccccgaaggtccggttaacggttacgtacgggtcgggaccgtagggttcggggttacggtacggaacgtacggttacgtttcccaccgttacctacccgtaaccgtacgttccgaacggtccttaaggttcctacgacgttacgtacgtaaggttaacgtttacgttttcgaacgttttaacgtttactttaccgccgttaccgagtaccgaacgtaccgttagtaccgttacggccgttccgggcccgttacggtttccgtaaccgggtttcccggggaaccgggtaaccgggtacgggttaagggtacccggtaaacgtaccgtaaacggtaaccgtacggtcggtacggtcgtaacccgtaccgtacttacgg

SEQ ID NO: 219970 - DNA, 696 bp, Homo sapiens
  misc_feature: GYAE6OF02HJPKN.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtctgtgtctccgaaggggaaagacgcccaccctctcctgcgagggccagtgagagtgtgcagactacgtacgctgtaccagcaagaacctgaccacggcctccgaggcctcctctctactcgtctcgtcctaccgaccgacggtcccgtcggtccgccgacgtccgtacgggttcggttggggtaccggttcggggtcgtacgggacgtagtttaccttacgtaccgttcctaccaccgtacgtaccgacggtcccggtaccctacggtacggttacgttaacggtaaacgtttcgttttacggaccttttaacttttcgttttacgtacgtaacccttaaacgttacgttaggtcggttaacgtcccgtaccggtttaccctaccgttaccgtttacgtttccggggaaccgtaacgggtaacctaaaggtcggtaacgtacgtaacgaacgtacgtgtacgggcttacgacctactagtctttacgccttaccgtcctccgtaccctacg

SEQ ID NO: 219971 - DNA, 846 bp, Homo sapiens
  misc_feature: GYAE6OF02HRWXM.24.87.H10.1.454.CMB.1.raw
  modified_base (755)..(755): a, c, t, g, unknown or other
  misc_feature (755)..(755): n is a, c, g, or t
tcagactactatgtcacgaccggtgctcgatttagcagtactgcggttggggtttgggggacggaactgctcagttaggacccagacggaaccatgggaagccccagcgcagcttctcttcctcctgctactctggcctccagactaccacgtgggacgaagtacgtctaagtcgacgactagtcctccgacgccctaccctgtctggtcgtcctcggaaggggaaagcgccctaccctctcctggacgtacgggtcctaggtacggtaagtaagttcggttacgggacaacggtactaaaccgtttacggcccgttacgggttaaccgacggtaacctaaacggtaaaaccgttcgggaccgaaccgggtacccgtaccccggtaacggtcccttaccccttaccgtacttacgtcggtctacggtaccctacccgtaaccggtaccggggtaccccttcgggtaccgtacccgtaccggtacggttaacgggtttccggtcgggggtaccgggttcggggttacggtacggggaaccgtaggtttaacctttaccggacctttaccgtaaccaacgttacgtccggaacggtcccggtacctacgtacgttacgttaacggtagtttacgtttacgtacgtttactttacggttcttaaccggaacttaaccgtacgttaagtccggttaagtccgttaccggtccttaccgttaacgttaccgttggaaccggtaacggtaacttaacgggngtacgtaacgtaaccgtaacgtcgtacggtgtacccgactaccgaccgttactcggtttcgacctttaaccgtccttccccgttactaccg

SEQ ID NO: 219972 - DNA, 678 bp, Homo sapiens
  misc_feature: GYAE6OF02F4D9D.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgaggggaangcccaccctctcctgcagggccagtgacgatggttggcagactaacttagcctggtaccagcaacgaacctcggaccacggtcctcccgaggtccctccctccttcttagtcgtcttcggtaccctcccgaccggaccggggtcccctgggttccgtccccgaagtcccggtacggggtttccgggtcggtcggggttcgggtcggttacggggctagttaactttccgtactcgtacacctagtcgacggcccgtccgtaccgtacgtcgtagtaagttcgtttacgtcctttacttttacttccgttcgttacctaactattacgttgtcgtacgttcgtccttccgtacttcgtttccggacggtacgggtaacctaagtacggtagtactaacgtaacgtacggtaggtcggtaccgtacggactaccgtacgttacttccgttaccttacgtccttacccgtcccgtacc

SEQ ID NO: 219973 - DNA, 793 bp, Homo sapiens
  misc_feature: GYAE6OF02FJ00D.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttggggtttgggggaggaactgctcagttaggacccagacggaaccatggaagccccagcgcagcttctcttcctcctgctactctggcctcccagataccactggagaagtagtcatgacgcagtctcagccaccctgtctgtgtctccgaggggaangccacctctcctgcgaggccaggtcgagaatggttcggcagactaacgttcgccttagggtaccagcgaacgtaaaccgtggaccgacggcctaccccgaggtccccttccctccgttactacgtcgtccgtttcgttacccgtaccccgaccggtaaccggggttcccccgttacgggttcccgtacccccggacggttaccccggttacggggttttcggggttaccggggtccgggggtttcggggtaccggttacgggggtaaccgtaggtttaccgttttacccgaacccgttttccgtacccaaacccgttacgttaccggtacccggggtccggtaccccttaccgtaccggttaccgttaggtaaccgtttacgttttaccggtaacctttacgtttacgttttccgtcttaacgtaactacgttacgtacggtacgtctcggccttacggttacttacgtttacgggaccgtacggtaacctaacgtacggacgtataaccggtaacgtcgttacggtacggtacgtacgaccgttacgttcgtcttcggttacttcccactttccccgtcccgttaacc

SEQ ID NO: 219974 - DNA, 737 bp, Homo sapiens
  misc_feature: GYAE6OF02GAJPB.24.87.H10.1.454.CMB.1.raw
  modified_base (214)..(214): a, c, t, g, unknown or other
  misc_feature (214)..(214): n is a, c, g, or t
  modified_base (660)..(660): a, c, t, g, unknown or other
  misc_feature (660)..(660): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggacctcccagatacccactaggagaagtagtcatgacgcagtactccacgcccaccctgtcctgtgtcctccgaggggtaaancgcccaccctctccgtgcgacggccaggtagagtaacgtgttggcagccgtaacgtgccgttacggtaccaggtcaacgaaacccgtgaccgaaggtccctcccgaggtccctccctccgtactatccggtcttcggtccctccgacccggtacggccccgttgggtccctacccgacgaccggtcgggtttcggtaccggggtcgggttacgggtccggtacggggtacttaacggtttctttccgtaaccttccgtaccgtaaccccgtagtcccgaacgggtccccgtccctaaccgtggtaccgtagggttatttaacgtttcgtaacctttaccgttttacttacgttaccgtacttaactacgttagttcgtacgtaccgttcttcccggttacttaccgtttccggttacgaccgggtaacggacctaacggcggtaanaccgttaacgaaccgtgtacgggtcctacggtcaaccgttactgttacttcgttaccctctacttcccgtcccgtac

SEQ ID NO: 219975 - DNA, 610 bp, Homo sapiens
  misc_feature: GYAE6OF02ITXZ3.24.87.H10.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccacctgtctgtcgtctcgaggggaaancgccaccctctccngcgaggccagtgagatggtcggcagactacttagccgtgaccagcaagaacctggccacgctccgngcctcctctctntcgctcgcctccgaccgcggccctggtcgcgcgtcgtggttcgtggcggtaggtctgggacngtacttcactcctcactatcgcgccgtcctacgtacgtacgaggtaagttactttgaccgtttactttacttcctagttaccaacttacgtagttcggtacgtacgcgttacccgtcgttaccgttgtttaccggaccgggttaacgggaacttaacgggtacgtaacctacgttaaccggaagttacggttggtacggcctacgtaccgactacgttcgttacgttccttaactccgtttccaacccttcg

SEQ ID NO: 219976 - DNA, 662 bp, Homo sapiens
  misc_feature: GYAE6OF02JMY2H.24.87.H10.1.454.CMB.1.raw
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (541)..(541): a, c, t, g, unknown or other
  misc_feature (541)..(541): n is a, c, g, or t
  modified_base (631)..(631): a, c, t, g, unknown or other
  misc_feature (631)..(631): n is a, c, g, or t
  modified_base (657)..(657): a, c, t, g, unknown or other
  misc_feature (657)..(657): n is a, c, g, or t
tcagactactatgtcacgaccggtgctcgatttagcagtactgcgttggggtttggggggaggaactgctcagttaggacccagacggaaccatggaagccccagcgcagcttctcttcctcctgctactctggcctcccagataccacgtggagaagtagtcagtagacgcagtctccacgcccaccctgtctgtcgtcctaccggaaggggaaagacgcccaccctcctccgtcgccgacgggccaggtacgaaggtaacgttggtggacacggtactaaacgttccgaccgtacggtaccacgaacaacggtaaaccgcggaccgacgtcccgtaccgacggtcccttccctaccctgtactcgtccgtcctcccncccgaccggcccggtccctcggtaccnccgcgtccggtggttcgggtcgggtcgggttggtccggtaggacgtacgtttactccgtacctctccacctatacggccgccgtccctcgtacgtctagtaagtttcttcgtactttctttattcactacacgtntagtcgtctctctcctcttacgttcgttacgacggtacgacgaacgtacgaatccgaaacaccgtagttacggactcggttcaaccacgnttcctaacgttccacccttcttcccncctac

SEQ ID NO: 219977 - DNA, 790 bp, Homo sapiens
  misc_feature: GYAE6OF02HOQZ7.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtcctgtgtctccgagggaaagcgccgacctctctgcgaggccagtgagagtggttcgcagacattacgccgtaggtaccgagtacgaacgtaaccgtaggccgtacgtccgtacccgacggtacctcccttacctctacgtcgtaccttcgtaccctacccgaccgtaccgggtccccgttcgggtacccgtcccgacggtccggttacgggttcggttacgggccgggttggggtacggtacgggtacgtacggttacttaccgacgttcaaccgtacctagtccgacggtcccgtactaccgtgtttaccggaagtttaacgtcgtttacgtacctttacttttaccggtttactcgggttaaacctaacgtttaacgttcggttacgtaaccgggttaccgtacccgggtttcccttaacccgttttaacggtttccccgttaacccggggtaccggtaaacccgggttaaccctaaccggggttaagaccgttaaattaaacccggtaaacggttactaccggggttaagccgttaacccgcgttaaaccctttagtccggtttactccgttttaacccgtacgtttcccccgtacgttaaccg

SEQ ID NO: 219978 - DNA, 778 bp, Homo sapiens
  misc_feature: GYAE6OF02FOSCL.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgagggaaagcgccaccctctcctgcgaggccagtgagagtgttggcagtcaacttagcctaggtaccagacaacgtaaaccgcgaccgtaggcctacccgaggtcctcctcctctatcgctgtccctcccgaccgtacgggtccccgtggtccgtcccgacggcccgtacggttcggttcgggtccgggttacgggtcgtgggaacaggttactttacacgtcctacgacctagtaccgtacggcccgtacccgtaccgtcgtacgttaaccgaaggttttacttttccggtaccttttaaccgttttcgtttacccgttacggttaaccttaaaacccggtttaacttacggtttacgggttacccgtacggttaccgggtttacccctttaaccggttaaacccgttttccggtttttacccgggacccggttaaaccggggttaaccgtaaaaccgttggggtaactaaaaccggtaccgtaaacgttaacggttcggttaaccggtacgtaaccgtccgttaaccgttaacgttccggttactttaccttccgtaacccgtttccccgttaccccgtaccg

SEQ ID NO: 219979 - DNA, 659 bp, Homo sapiens
  misc_feature: GYAE6OF02F965Y.24.87.H10.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccaccctgtctgtgtctccgagggaaanagccaccctctcctgcgagggccagtgagtaatgttggcagacaacttacgccgtggtaccagcaacgaacctggccaggcctccgaggcctcctcctctactcgtctgtcctccgaccgacgggcccctggtctccacgccgtacggttcgtgggcggttgggtcgtagggacgtagtactttcgacttctacaactcgtcacggccgtcctaccgattccgagaacgtttnttttacggctttaacttttaagttcgtacgtacctaaacgttacgttagttcgggtaactcgttacggtaccccgttaccgttacgttccggttttcgaacccgggtaacgggtaaaccctaaacggtacgggaacttaacggaaccgtaaacgtcgtacggtacggcttaacggacctaccgtagttccttagttccttaccacggttcccttaccgtaacg

SEQ ID NO: 219980 - DNA, 711 bp, Homo sapiens
  misc_feature: GYAE6OF02FZKNH.24.87.H10.1.454.CMB.1.raw
  modified_base (202)..(202): a, c, t, g, unknown or other
  misc_feature (202)..(202): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccagataccactggagaagtagtcatgacgcagtctccagccaccctgtctgtgtctccgaggggaancgccaccctctcctgcgacggccaggtgagtaagtggtggacagtacctaacgttcggcctacggtaccagtcaacggaaaccgtgggccacggtcctcccgaggtccttccctcctacgttatccgcttccggtcctccgaccgtaccgggtccccttggtccggtccctaggcccgttacgggttcggttcggggcgggtttcgggtacggtccggggtaactacgggttactttaccgtaccttccgtactaacccgtaacgtccggacgggtcccggtcctaccggtacgtcgttaaggatttacgtttcgacctttacgtttacttcgtctaactaacgtacttagtcggtacgtacgtccgtccttacgttacgttgttaccggaccggtacggggtaaccaaggtaggtagtaacgtaaccgaacgacgttaggggtcgtacgtaccggctaaccggtcttaccgttcgttacctccgtaccgtttccctccccgttaaccg

SEQ ID NO: 219981 - DNA, 662 bp, Homo sapiens
  misc_feature: GYAE6OF02FP0OV.24.87.H10.1.454.CMB.1.raw
  modified_base (165)..(165): a, c, t, g, unknown or other
  misc_feature (165)..(165): n is a, c, g, or t
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacncagtctccagccaccctgtctgtcgtctccgaggggaacgacgcccaccctctcctgcagggccagtgagatgtgnagcactgctggtaccagcagaactggccaggtccnccgagctcctcctntatgcttgtccctccgaccgtcgggccccttggtccgtacccagtcccgtaggtttccggttcgggtcgggtgggttccgtggggtacctagggttaccttttccgacttccgtacctaccgtacgttccgacgtccggtacccttccgtacgttctacggtaagttacgttttcgacttacgttttactttcgtacgttacctaaacgtcgttagttcggtcgtaccgtcggtccttacccggttaattcccggttttacggaccgtaacggggtacctaaacggtaggtacgtacgttaccgaacgtaccgtggtaggtcctacgacctacgtcgtcgtacgttccttacgtaacttcccgtccgtaacc

SEQ ID NO: 219982 - DNA, 757 bp, Homo sapiens
  misc_feature: GYAE6OF02ISZN1.24.87.H10.1.454.CMB.1.raw
  modified_base (208)..(208): a, c, t, g, unknown or other
  misc_feature (208)..(208): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
tcagactactatgtcacgaccggtgctcgatttagcagtactgcgttagggtttgggggaggaactgctcagttaggacccagacggaaccatggaagccccagcgcagcttctcttcctcctgctactctggcctcccagataccactggagaagtagtcaatgaccgcagtcctccagccacccttgtctgtgtctcaggggaaancgccaccctctcctgcgagggccagtgagtaatggtgcagcaagttcgcctggtaaccagacaacggaacctcggccaggtcccaccgacggtcctccctccttctagtcgctcgtccctccgaccgtaccgggtcccttggcctcccgagtccgtaggttcggtcgggcggtcgggtctgggaacngtctttcnccgttcncacctctcggtacgccgtaccgtacctacgtacgtaggttaattcgtttcgtacctttacgtttacttttcgttacgttaacctaaacgttacgttacgttacgggttacgttaccgttaccggttacccgtttacccggtttaacgtttaccgggtttttacccgggaacccgggttaaccggggttaacccgttaaaacgggttaccgggtaataaccgttaaccggtaaaccggtaaccggttaccggttacggtaacggttccggtaaacccttcccgttaacggtttcccgtttacggtttaccctttaccgggtaccctttcccggttaccccgtaacccg

SEQ ID NO: 219983 - DNA, 655 bp, Homo sapiens
  misc_feature: GYAE6OF02G0V8B.24.87.H10.1.454.CMB.1.raw
  modified_base (167)..(167): a, c, t, g, unknown or other
  misc_feature (167)..(167): n is a, c, g, or t
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (345)..(345): a, c, t, g, unknown or other
  misc_feature (345)..(345): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccactggagaaatagtgatgacgnagtcctccagcccaccctgtctgtcgtctccgaaggggaaancgccaccctctcctgcagggccagtcagagtanaagagcaactacttagcctaggtatcaacacgaaacctggccaggcctcccaggctccgtcactctatggtatactccagcgacggccacgtggtccgcccgngactacggttcacggtcggcgtaggttgggtcgttacggggactagggtacggttactaccgtcccgttaccaacctactacgtacggaccttaggttacgtacgcgtacgtcgtaagtaagttagtttttcgattaacggtttttacttcgtacgtaccctgcacggtaccagtacgtacgtaccgtcgtcccgtcgttaccgtaccggtttccggggaccggacgggtaccgggtaagggtacggagtaaccgtaacggtaaccgtaacggttcggtacgggtccgtaaggtcccgtaacgttaccgg

SEQ ID NO: 219984 - DNA, 691 bp, Homo sapiens
  misc_feature: GYAE6OF02IIPX7.24.87.H10.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
tcagactactatgtcacgaccggtgctcgatttagcagtactgcgtttgggtttggggaggaactgctcagttaggacccagacggaaccatggaagccccagcgcagcttctcttcctcctgctactctggctcccagataccactggagaagtagtcatgacgcagtctccagccacctgtctgtgtctcgagggaaangccaccctctcctgcagggccagtgagaatgtcggcagcaagttgcctggacagcagaacgngccagccnccagtctccantctagtgatcgtctaccgaagtacgggtcacggtcggcccgttccccgcgtacggttcgacggtcggagtacggtcggggtctgggtacgaacgttcctttacgaccttaccgtcccgaaccgttccgaacgccgtacgaccgtaagtacgtacccgtaggttaaacgtcgtttacggtacgggttttaactacgttcggttaccacgtacgtaccggttccgtccgtccgttacgggtacccggttaccgttaaccgggtttcggggaccgggggttaaccgagggggtacggaagggtaccgggacggtacggtaaccgttggggtacggtacgttacggaccgttaacctacgtttaccggttcgtttaccgtttacccgttacgtttccccgttaccccgtaccg

SEQ ID NO: 219985 - DNA, 784 bp, Homo sapiens
  misc_feature: GYAE6OF02GGAPS.24.87.H10.1.454.CMB.1.raw
  modified_base (219)..(219): a, c, t, g, unknown or other
  misc_feature (219)..(219): n is a, c, g, or t
tcagactactatgtcacgaccggtgctcgatttagcagtactgcgttgggtttgggggaggaactgctcagttaggacccagacggaaccatggaagccccagcgcagcttctcttcctcctgcctactctggcctcccagataccacgtggagaagtagtcatgacgctagtcctccagcccacccgtgtactgtcgtcgtaccgaaaggggaaaacncgacccctacccttcgtccgtaggtccgacgggtccctaaggtagaacgtaagttcggttcggacaggtacctaaacgttcggccgtacggtaaccagaccgtaaacgaaaccgtcggaccgaacgggccctaccgacggtccttcctacctacttagccgtcttacgtcctacccgaaccggcgggtaccctggtcacccagtccgttaggttacggttcgggtacggttcggggtacgtacgggtaacttacgtacgtttaccacttccgtaccgaaaccttataaccggaccggtcggtaccccttacgtacgtacgtaacgtaacgtttagtttaacgtactttaaccgtttactttcggtactaaccttaaatacgttacgtacggttacgtaccgtcgttacccgttagtacccgtttcggttaccggtaccgtaacggtaaaccgtaacggtaccggtaataaaccgtacgtaaacgtacgttacgtcggtaccgtacgtaacccttaacgttcgttaacgttccgttacttacctacccgttaccctccccgttaac

SEQ ID NO: 219986 - DNA, 895 bp, Homo sapiens
  misc_feature: GYAE6OF02I65LI.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagcccaccctgtcctgtgtctaccgaggggaaagcgcccacccctctccgtgcacgggccagtgagaatggttgcagccacttacgcctaggtaccagacaacgaaacccgtggaccacggccctcccgaggcccctcccttacccgtcttacgtcgtccgttaccgttcctaccctaccccggaccggggtcccccgttagggttcccgtacccgacggtcccggttacggggtttccggttacgggggtcgggttcgggggtcggttacggggtaacccgtaggtttacctttaccgtaaccgttcccgtaacccgtacccgtacgtaccggtaaccgggcccggtccccgttacccgtaacggtccgtttaaagggtaaaccgtttagttttttacccggaccgttttaacgtttttaccgttttaccgttaccgttaccgttaaaaccgttaccttttaacgggttccggttaccggtaacccggttcccgggttaccccttttacccgggtttaacccgttttaaccggtttttaccggggaaccccgggttaaaccgggggttaacccttaaacgggtttaccggaaccggttaaaccgttaaccggtaaaccgttacgggttcgggttaaccggtccgttacgacccgtaacccgttaagtttcgttccggttacccctttacgttaacccggtttccccttaccccggtaaccg

SEQ ID NO: 219987 - DNA, 850 bp, Homo sapiens
  misc_feature: GYAE6OF02FSCXJ.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctccagccacctgtctgtgtctccgaggggaaacngccaccctctcctgcgagggccagtgagatgtgcagacaacttcgccgtagtaccagtcgaacgaaaccgtggaccgaggcctcccgacgtcctacctcctactactcggtctcgtcctacccgaccggtaccggtccccgtcgggttccctacccgacggtcccggtacggggtttcgtacggggtcggggttcgggtccgtacggggacgttaagtacgtttaccgaccgttcctacgacccgtaacgtccgaccggtcccggtaccgttacccgttaacggtccgttaggtaaacggttttacgttttcgtaccgttttaacctttttaacgtttacccgttaacggttaccgttaaaaccttacggtttaacggttaccggggttaacccgttacccggttaccggttacccccggttttaacccggtttaaacgttttcccgggttttacggggtaaccccggggtaaaccgggggttaaaccctaaacgggttacgggtaaaccgtaaccgttaaacccggaacgttaaccgggttcggtaacggggttaaccctacgggtaacccctaaccgttaccgtttaccggttaacggtttccccgttaccgtttaacccgttaccccgtttaccccgtaaccg

SEQ ID NO: 219988 - DNA, 922 bp, Homo sapiens
  misc_feature: GYAE6OF02GXUCZ.24.87.H10.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagactactatgtcacgaccggtgctcgatttagcagtactgcgttgggtttggggagaactgctcagttaggacccagacggaaccatggaagccccagcgcagacttctcttcctcctgctactctggctccagactaccactggagaagtagtcatgacgcagtctccagccaccctgtctgtgtctcgagggaaancgccaccttctccngcgacggcagtagaatagttgttcggacagctaacgtgccgtacggtaccagacaaacgtaaccgtcgaccgacggtcccctacccgacggtccccttcccgttaccttaccgtacgttccgtcgtcctaacccgttcccgacccggtacccgggttcccccgttgggtacccgtaccccgtacggtacccggtttaccggtttcgggtacggggttccgggttcggggttccgggtaacggggtcctttaaacggtttaccgttttacccgtacccttaccggtaccgttaaccccggtaagttacccggtacccggggtcccgttaacccccgtttaccggtaaccgtaccgtttaaagggttaaaccggttttaaccgttttttcccgggttaacctttttaaaacccggtttttttaccgttttaccggttttaaacccgttaacccgttaaaacctttaccggtttaaccggtttagggttacccgttacccggttacccgggtttaaccccggttaacccggtttacccgtttttaaccggggtttacccgggtaacccggtaaccgggttaaaaccggttaaccggaggttaaacgtaactaaaccgggtaaaccgtgttaaccgggtcgtaacgtccgtacccttaacgtacttaccgttctttaacccgttccggtaccttttccccggaaccctccg

SEQ ID NO: 219989 - DNA, 768 bp, Homo sapiens
  misc_feature: GYAE6OF02F7RGC.24.87.H10.1.454.CMB.1.raw
  modified_base (153)..(153): a, c, t, g, unknown or other
  misc_feature (153)..(153): n is a, c, g, or t
  modified_base (260)..(260): a, c, t, g, unknown or other
  misc_feature (260)..(260): n is a, c, g, or t
  modified_base (729)..(729): a, c, t, g, unknown or other
  misc_feature (729)..(729): n is a, c, g, or t
  modified_base (754)..(754): a, c, t, g, unknown or other
  misc_feature (754)..(754): n is a, c, g, or t
tcagactactatgtcacgaccggtgctcgatttagcagtactgcgttgggtttgggggaggaactgctcagttaggacccagacgaaccatggaagccccagcgcagcttctcttcctcctgctactctggcctcccagactaccacgtgganaaatgtcgatgacgcagtctccagtcccacctgtctgtcgtctccggaagggaacagtcccaccctgtccctggcgtacgggccgaagtcgaagtaagtcggttcgnacgtacctaactttcggccgttaggtaccagtacaacggtaaaccgtcggacgtaccggccctacccgacggtaccctcccttccttactaagtcgtccgtcgtcccgtacccgaaccggtcccgggtccccgttgggtacccggttccccgacccggttacccggttaacgggttttccggggttacggggtccgggttacgggggttacggtcgggtaaccggttagttaccgtttaaccgtaccgttcccctaccgtacctacgcgtaccgtcccgtaccctcgtacgtctaagtacgtttacgtttacgtcgtttacgtttcgttacgttaccgtacgttaaacttacgttaggttgtacgttaccgtaccgttcccggttaccgttaccgtttaccggtttcggaaccgggtaacgggtacgtaaacggtacggtaactacgtaaccgacgtacgtcggacgtnccacctacgtatccgtactcttacnccgttacctctacg

SEQ ID NO: 219990 - DNA, 850 bp, Homo sapiens
  misc_feature: GYAE6OF02FX78M.24.87.H10.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (213)..(213): a, c, t, g, unknown or other
  misc_feature (213)..(213): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctggcctccagactaccnctgganaagtatcagtgacgcagtctccagccctaccgtgtcctgtcgtctccggaggggtaaacncgcccaaccctgtccgtgaccaacgggtccaggtcgaagtaagttgttacggactaacggccttaaaacgtttcggcccgttacggttaaccaacggactaaaccggtaaaaccgttcggacccggtaacgggtacccttacccggaacgggttcccctttccccgtacccttacgttacgttccgtccgttaaccgtcccgttacccgaacccggccgggtacccttcgggtaccgtcccgaaccgtccggttcgtttacgggtcggtcgggtcggtcgttacggggacttacgtttaccgttacgtcgttccgtacaaccgtcgttaccgacggtccgtaccgtccgtacgttccgtagtaacgtactttacgactttacgtttacgttacgttcgtaccttacgtaccgttacgtacggttaccgtaaccggtcggttacccgttaccgttaccgtttaccgtttacgggtaacccgggttacgggtaaaccgttaaaccgttacgggttaacgtaaccgttaaccggtaacggttaaccggtacggttacgtaaccgttacgtaacccttaccggttaccttaccgggtttacccttacgttaaccggtttcccttaccgttccccgtaaccg

SEQ ID NO: 219991 - DNA, 828 bp, Homo sapiens
  misc_feature: GYAE6OF02IM7JH.24.87.H10.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
tcagactactatgtcacgaccggtgctcgatttagcagtactgcgttggggtttgggggaggaactgctcagttaggacccagacggaaccatggaaggccccagcgcagcttctcttcctcctgctactctggcctcccagactaccactggganaagtagtcaatgaccgnagtcctcagcccaccgtgtctgtacgtctaccggaaggggaaacgcgccctaaccctctaccgtgaccggacggggcctaggttggaacgtaagttggttgggaccaagactaacgtttcggcctagggtaccagtaccgaaacgtaaaccgtcggaacccgaacggtcctccggacggtcctcccgttccttacctagttccggtccgttcgttacccgttacccgaaccggtaccccgggggtccccttgggtaccccgttccccgaacggttccggtaaccgggggtttcgttcccgggggtacggggttccggggtaccgttagggggaaccttagttcgtttacccgtaacgttccctacccgtaactaacggtccgtaacgggtcccgggtacctaccggtacgttacgtaacgggttaagttacgttttcgtaacgtttacctttacgttacgttacgttaaccgtaacgtacttaacggtccggttacgtaccgtcggtacccttcgttaaccgttccgtttacggacggtaaccggtaaccgtaaacgcggtaacaactaaccggaacgtacggttacggccgttcgtagacccgtacgtacgttcgttacttaccgttaccggttactcccggttaacccgtacg

SEQ ID NO: 219992 - DNA, 718 bp, Homo sapiens
  misc_feature: GYAE6OF02G257C.24.87.H10.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
tcagactactatgtcacgaccggtgctcgatttagcagtactgcgtttggggtttgggggaggaactgctcagttaggacccagacggaaccatggaagccccagcgcagcttctcttcctcctgctactctggctcccagataccactggagaagtagtcatgacgcagtctccagccacctgtctgtntctccgaggggaaancgcccacctctcctgcacggccagtgagaatgttggcagacaacttgcctaggtaccagcagaaaccngccagctccagctcctctctangactgtctccacgacggccctggtcgtcccagtccgtaggtttcggtaggtcggttcgggtcgtggggaactaggtactttccgaacgttcctaccgtaaccgtaatccgaacggtccgtaccctccgtaacgttctaggtaaacgttacgttttacgtaccgttaactttttacgtttaccttacggtttaccttaaacttaccgttaacgttacgggttacgtaacggttccggtacccgttaccgtttaaccgtttaccgtttttacgggaacccgggtaacgggtaaaccctaaacggtacggaaacgttaacgtaaccgtaaacgtaacgttacgggtaccggttagtaccgtaccgtaaccgttacgttaccgttacggtttacttaccgtaaccgtttcccgttaccccgtaaccg

SEQ ID NO: 219993 - DNA, 849 bp, Homo sapiens
  misc_feature: GYAE6OF02I1K7H.24.87.H10.1.454.CMB.1.raw
  modified_base (203)..(203): a, c, t, g, unknown or other
  misc_feature (203)..(203): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctccgagataccactggagaagtagtacatgacgcagtctccagcctaccctgtctgtgctacgagggaanagccacctactcctgcagggcctagtagagaagtgttggacagacgaacttacgccgtacggacctaagaccgagaaaaccgtcggacacgcctaccgagtcctaccgtacctacgtacttacgccgtcttccgtacccaaccggtaccgggtaccccgttcggtaccgtacccgtacggtaccgttacggggtttccgtttaggggtaccgggttgggtaccggtacggggtaacgtagtacttttaccgtacctccgttacccacctaacggttacgtaaccggtccggtaccctaccgtagtaccgttaacggtaacgtttaacgttttggtaacctttaacgttttaactttaccgtttacgttaaccaaaactttaaccggttaacgttacgggttttaaccgacccggttacccggtacccttttaacccggttaaccgttttaacccggttttaccggggtaaccccgggtaaacggggttaaaacccgttaaaccgggtaaacggtaacggttaaacttaaaacccgggtaaaccgtaaaccggttagggttaaccggtacgttaacgacccttaaaccggtacctttaccgttaccgtttacccgttaccctacgtttacccccgttacccgttacc

SEQ ID NO: 219994 - DNA, 772 bp, Homo sapiens
  misc_feature: GYAE6OF02JA05Z.24.87.H10.1.454.CMB.1.raw
  modified_base (92)..(92): a, c, t, g, unknown or other
  misc_feature (92)..(92): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (555)..(555): a, c, t, g, unknown or other
  misc_feature (555)..(555): n is a, c, g, or t
tcagactactatgtcacgaccggtgctcgatttagcagtactgcgttgggtttgggggaggaactgctcagttaggacccagacggaaccanggaagccccagcgcagcttctcttcctcctgctactctggcctccagataccactggagaagtagtcaatggaacgcagtcctccgagccctaccctgtctgtcgtacgtaccgaaggggaaaacgcctaccctntccgtcgacgacggccaggtacganaagttgttacggcaggtactaacgttacggccgtttacggaaccgacgacgaaacggtaaacccgtggacccgtaaggcccgtacccgacggtcccttcccgttaccttaccggtatcggaccgttccgtcccttacccggaaccgtcccggggtccccgttggttaccccgcccgttcgacccggtttcggttaacgggttcggcggttcggggttcggaacgggtaccttaacggttcttaacgcgtcctacgtacctagttcgacgtccggtcctacgacgtactacgtaagttacgttntaccgtttacgtttagttcgttacgtacgtaactactacggttagtccgtacgtaccggttacctaccggttacgttacgtttaccgggaccggttacgggtaaccgttaacggtacgtaacgtaccgtaaacgtaccgtaacgttacggaacgttcggactaacggttcctacgttcgttaccgttacgtcccgttacgtttccgtacccgtaccg

SEQ ID NO: 219995 - DNA, 914 bp, Homo sapiens
  misc_feature: GYAE6OF02HUIQH.24.87.H10.1.454.CMB.1.raw
tcagactactatgtcacgaccggtgctcgatttagcagtactgcgttgggtttgggggaggaactgctcagttaggacccagacggaaccatggaacgcccccagcgcagcttctcttcctcctgcttactctggcctcccagactaccacgtggaagaagttagtccagtgacgctagtcctaccacgcccacccgttgtaccttcggtcgttccgtacccggaaagggggaaaccgtacgaccccctaacccccttccgttacccgtacgacggtaacggggtaccctaagggttacggaacggtaagtttcgggttaccgggacgtaacgtaacccgttaaacccggttcgttacccgttagggtaaacccctaaggaacccggaaacgtaaaaccccggtcgggtacccgacggggtccccttaacccccggagggttcccctttacccccgtccgttataccggttcgtccgtacgttcccgtacccgaaccggtcccccggggtcccgtttgggaccctaccccgtaacgggtccccgtttacgggggttttcgggtacgggggtacccgggttggggttaccgtacgggaacgtaaccggtttattcccgtaaccttccggtaactaacccgctaacggtcccgcccggtacccgtaccgtacgtacgttaacgttaacgtttacgtttacgttacctttaacgtttacgtttaccgttacgttaacctaacgttaggttaccgttagtacgtaccgtccgttaccgttaccgttaccgttacggtaccgtaccggtaacggtaaccgtaaaccgtaggacgtaacgtacctaaacgtccggtacgtccgacgtcgtacgttaccgacttacgttcgtaaccttacgtccttacccgtccgtaaccg

SEQ ID NO: 219996 - DNA, 823 bp, Homo sapiens
  misc_feature: GYAE6OF02FWU9L.24.87.H10.1.454.CMB.1.raw
  modified_base (204)..(204): a, c, t, g, unknown or other
  misc_feature (204)..(204): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtctaccagccaccctgtctgtgtctcgagggaagcnccacctctccgtgcgacgggccaggtacgagattggttgacgagtactaacgttcgccgttaggtaccgagtaccgtaaacgtaaccgtcggaccacgggcccctcccgacggtcccttcccgtcctacgtattcgccttcgtacctacccgaccgggtaccgggttccccgtgggtcccttaacccggtacggtacccggttacgggtttccgggttaccggggtccgggtttacggggtaccggtaccgggggtaacttaacgggttccttttaacgaccgtttacccgactaaccgtacggttacgaccgggtaacccgttccgtacgtacgtacgttaacggtaactttacgtttaccggtacttttaccgttttaccgtttaccttaccggttaaccttaaacttacgttacggtttaccgtaagggtacccgttccgggtaccctttacccgggttactttcccgggtttagggacccggttaacgggaaacccgttaacggtacggttaactaacgtaaccctaagggtactttcggaacggttccgtacggacccttacgttaccgttacgtcgtttacctaccgttacccgttaccccgtggttaacccc

SEQ ID NO: 219997 - DNA, 855 bp, Homo sapiens
  misc_feature: GYAE6OF02HK51K.24.87.H10.1.454.CMB.1.raw
  modified_base (302)..(302): a, c, t, g, unknown or other
  misc_feature (302)..(302): n is a, c, g, or t
tcagactactatgtcacgaccggtgctcgatttagcagtactgcgtttggggtttgggggaggaactgctcagttaggacccagacggaaccatggaacgccccagcgcagcttctcttcctcctgcctactctcggcctccagactaccacgtggagaagtagtcatgacgcagtcctccacgccccaccgtgtctgtcgtcgtaccgaaggggaaacacgcccacccgtctccgtgccgacgggccaggtgaacgtaagttcggttaggacaacgtactaacgttcgccgtaggtaccgngacgaacgtaaacccgtaggaccgacgccctacccgacgtcctacccttccgtctaacgttccgcgttcctcccgtacccgacccggtacccgggtccccgtccggttacgaccccgtaggtaccccggtttagggtttccgggtcgggggttccgggttcggggttcgggtcgggtaaccgttggttaactttccgaccttacacccgttaaccgtacgttccgacggtcccgtacctcccgtacgtacgttacgttaacttacgtttacgttacttacttttacttttaccgttacgtaacttaaccgttacgttacgttacgtaccggttagtcccgttacccgttaccggtttacctttaccggttaccgtaaccgggtaaccggtaaccggttaacgtaaccgggtaacgtaaaccgttaaccgaaaacccggtcgggtttacggttaccgggtaccgtaaccgggtaacctacccggttaacgttcccggtttacgtttaacccgtttacccgtacccggtttacccccgttaccccgtttaccccg

SEQ ID NO: 219998 - DNA, 835 bp, Homo sapiens
  misc_feature: GYAE6OF02FS12O.24.87.H10.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagactactatgtcacgaccggtgctcgatttagcagtactgcgttgggtttgggggaggaactgctcagttaggacccagacggaaccatggaacgccccagcgcagcttctcttcctcctgctactctcggcctccagactaccactggaacgtaagtagcaatcgacgctacgtctcgacgccctacctgtcgttgtcgtcctaccggaaggggaacacnccaccctctcgtcgcgacggtccnggtacgaagtacgttggtcgacagtactaacgttcgcgtacggaaccagtaccgaacgtaaccgtcggaccgacggtcctacccggtacgtcccttcccgtcttacgtcgtccgtacgtaccgttcccgaacccgtaccgggaaccccgggtcccttcggggtaccctaccccggtacgtacccgggtttcggttccggggttacgggggtccggttaagggggttccgtacggggtaactaacggtttctttaacccggctttaaccgccgaaaccgtcaaccgggtacccgcccgttaccggtaccggttaacggtacgttaacggttacgtttacgtttacggtacctttttaacttaccttttcgtaccgttaacgttaaccgttacttagggttaaccgtcgggttacccgttaaccgggttcccttaacggttacgtttaccggtaccggtaaccgggtaacccgggtaattaaaccggacggtaagtaaccgaacggtaaccgtggtaccggtagtccggttacccacccgtcgttaaccgttcgttacttacgtaccctcccggtttaccgcccgtaac

SEQ ID NO: 219999 - DNA, 804 bp, Homo sapiens
  misc_feature: GYAE6OF02GFBFU.24.87.H10.1.454.CMB.1.raw
  modified_base (287)..(287): a, c, t, g, unknown or other
  misc_feature (287)..(287): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccactggagaagtagtcatgacgcagtcctcagcccaccctgtctgtcgtctccgaggggaaagacgccaccctctcctgccgagggccaggtgagtaactggttggacagacaacttgcctggaccagcaacgtaacctggccngtcctccgaggcctcctcctcgtactcgtccgttagtccctaccgaaccgaccgggtccccgttgggtccgtaccccgacggtcccggtacgggtttccggttcgggtcgggttacgggtcggtacgggacgtaggttactttaccgacttccgtacctaacccagtaccgacggtcccgtacccgttcctaacggttcgtaacgtaaagtttcgttttacggtaccttttaaaccttttgtttacccgtacgttaaccttaaaccgtacggttttacggtacggggtttacctaaaccgggtcccgggtttccccgtttaaccggtttacccttttacgggttttacccggggaccggttaaaccgggggtaaaccttaaaccggggtaagggtaacgttaaacccttaaccggtaaaaccggtgtttaccgggtccgggttactacccgggaccttaacccgtggtttaccctcgttttaccccgttacgttacctttaccccctcccggtaacc

SEQ ID NO: 220000 - DNA, 831 bp, Homo sapiens
  misc_feature: GYAE6OF02IL9LA.24.87.H10.1.454.CMB.1.raw
  modified_base (123)..(123): a, c, t, g, unknown or other
  misc_feature (123)..(123): n is a, c, g, or t
  modified_base (181)..(181): a, c, t, g, unknown or other
  misc_feature (181)..(181): n is a, c, g, or t
  modified_base (701)..(701): a, c, t, g, unknown or other
  misc_feature (701)..(701): n is a, c, g, or t
  modified_base (788)..(788): a, c, t, g, unknown or other
  misc_feature (788)..(788): n is a, c, g, or t
  modified_base (794)..(794): a, c, t, g, unknown or other
  misc_feature (794)..(794): n is a, c, g, or t
tcagactactatgtcacgaccggtgctcgatttagcagtactgcgttgggtttggggaggaactgctcagttaggaccagacggaaccagtggaacgccccagcggcaggtcttctctttccnccgtgcttacgtctggcctaccaggtactacccgatcggagaacgtgtacagtcgacncagtcctcgacgtccacccgttgtaccgttgtacgttccggtaccggtaagggggaaaacctcggaccccttaccccgttcgttacccggtggaccgggtttcccggggaccctagggttacgaaccgttaaacggtttcggttaaacccgggtccaaccgttaccgtaaccggtttacgtaccccggtacggttaacccgacggtaaccgtaaaacggtaacccccggttcgaaccgtaccggtacccgtaaccccggtcgggtacccctacccgtccctttaccgtagttcgtaaccgttccgttaccctacccgtacccggccgggttaaccctcggtaccggaccctaggtcccggtagggttccgtacgggttccgtcggggtaccgtagggtacctacgttacgtttccgaaccggttcctaccgtacgaccgttacccggtcctaacccggttccgtacccgtgtaacgttacggtaacgttcgtttacgtactttacgtttacgtcgttacngttaacgtactgtcgtcgtcgtccgtcgtacttacgtcgtcggtaccgtacggtaactcgtagagtaactacgtagtcgtgcgttanccgtcncgtagttcgtacctactccgtacgtacccgtgtaccg

SEQ ID NO: 220001 - DNA, 678 bp, Homo sapiens
  misc_feature: GYAE6OF02HNM2O.24.87.H10.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (415)..(415): a, c, t, g, unknown or other
  misc_feature (415)..(415): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctgctcccagataccactggagaagtagtcatgacgnagtctccagccacctgtctgtgtctccgaggggaaancgccaccctctcctgccgacgggcctagtcaggaagttaactaaggaacgactaaacttacgttacgccgtaggtactaccaaanaacggaaaccgtcggaccaggccctacccgagtcctcctagtactcgtagttggtaatacgtaccgagtcgacgggtacctagtcggtccgtacccgagtacctaggttcaggtcgcgtaggtcgggntagggctagtacgtcactctacacctatcgagtctacggtctcgacgtacgttacgtagtaacgtttacgttcgtaacgtttaagtttacttacgtcgtaccgagtacgacctaacgacgtacgtcgtccggtcgtcccgtacgttagtaccgttccgggaaccggggttaacgggtaacccgtaagggtccgggtaaaggtaaccgtaaaccggttaacggtaccggttaacggggtccgtacggttacaccgtaccgtaag

SEQ ID NO: 220002 - DNA, 945 bp, Homo sapiens
  misc_feature: GYAE6OF02HRYIR.24.87.H10.1.454.CMB.1.raw
  modified_base (205)..(205): a, c, t, g, unknown or other
  misc_feature (205)..(205): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggctcccagataccacgtggagaagtagtcatgacgcagtctccagcccaccctgtctgtgtctccgaggggaancgccaccctctcctgcacgggccagtgagatgttgcagcaactcgctgtacagacacgtaaccgtgccgaggtcctacccgaggtccttacccgtcccttctagtcgtccgttcgtccctacccgtacccgtaccggggtccccttgggtcccgtaccccgtaccggtccccggttacggggtttcccggttcgggggtaccgggtttcgggggttacccggttacggggggaacccgttacgggtttaaccgttttacccgtaacgttcccgtaacccgtaaacccgtacgtttcccggaaacgggtccccgggtaccccgtttacccggtaaccgggtttaccggttaaacggttaaacggttttacttttttaccgggtaccctttttaaaccgtttttaccttttacccggggttacgtttaaccctaaaaccgtttaaccgggtttaggtttaccgggtaccgttacccggttacccggggttaccccgtttaaccccggttagttttaaccccgggttttacccggggtaaaccccgggtaaccggggttaaaaccccggtaaaaccggttaggggaaaccgttaaaccgttaaccccgggtaaaaccggtttaccggttaccgggttaaccggggttccctaaacgggttccccgtaaaccgttaccgtttacccgggtttaccggtttacccttttaaccgttacccgtttcccccgttacccgttaacccg

SEQ ID NO: 220003 - DNA, 910 bp, Homo sapiens
  misc_feature: GYAE6OF02GP00M.24.87.H10.1.454.CMB.1.raw
  modified_base (219)..(219): a, c, t, g, unknown or other
  misc_feature (219)..(219): n is a, c, g, or t
  modified_base (474)..(474): a, c, t, g, unknown or other
  misc_feature (474)..(474): n is a, c, g, or t
tcagactactatgtcacgaccggtgctcgatttagcagtactgcgttgggtttgggggaggaactgctcagttaggacccagacggaaccatggaagccccagcgcagcttctcttcctcctagcctactctggcctcccagataccactaggacgtaagtacgtcgactgacgcagtcctccacgccctaccctgtctgtcgtcctccggaagggaanacgccctacccgtcctccgtacgaccggacgggtcctaggtaccggtaaggtaagttcgggttaacggccaaacgtaccgtaaaccctttaggggcccctttaacgggaacccgaaggttaacccggaaacgttaaaaccccgtcgggaccccgtacgggacccctaccccggtccgggtaccctccccttaccgtacgttgaccgttcctacttcccgtaacgccccggttaccggccccgttgggttaccccncccggtaccgccgggtttacggtttccgggacggggttccgggtgggttaacgcggggaaactcggtttccttaacggtccccttagtacccacgttcggaccgtccggcccgtacgtccgttacggtacggttaacgtaacggtttactttccgtactttaccttttaccttaccggttaccgttaccgtacgttaaccgtttaaggtaccgggttccgtaaccgttacccggtacccgttaacccggttaccgtttaccggttacggggttaaccggtaaccgggttaaaccggttaacggtacggtaaaccgaacgttaacccgtaaccggttacgttaccggtaggtaccccggttaaagtacccgtaaccgttaccgttacgttccggtttacccttaacccgttccccgttccccgtccctttaacccgg

SEQ ID NO: 220004 - DNA, 765 bp, Homo sapiens
  misc_feature: GYAE6OF02HVZNP.24.87.H10.1.454.CMB.1.raw
tcagactactatgtcacgaccggtgctcgatttagcagtactgcgttgggtttgggggaggaactgctcagttaggacccagagggaaccatggaagccccagctcagcttctcttcctcctgctactctggctcccagagaccaccggagaaattgtgttgacacagtctccaggcaccctgtctttgtctccgaggggagagacgccaccctctcctgcagggccagccggagtgttagtaagtacttaggctggtaccaacagaacctggaccaggcctacccgaggcctcctcatctatgatcgtcctaccgaacgtagggtccacggtcggtcccgtcccccgctacggttcgaggtcgggcgtagggtcgggtcgtacgggactaggtaccttcaccttccgtccgaccgtcacgcacgtcccgtaggccgaccgtagtaagttacgtttttcgggtaccggttttactacgttcgtacgacgtccgtacggtcccggttcccgtccgttccgggtacccgttaccgtttaaccgggttttcccgggggaccggggggtaacccgtaggggggttacgggaacgggtacgggtaacgggtaacccggttaacgggttcgggtacgggttaccgtcgggtacccgtaacccgtacggtttcccggtttacggtttcccgtttaccgtacccgttttccccgtttacccccggaccgtttaccgttaacccggttaacgtaaaccgttaggtttaaacggg

SEQ ID NO: 220005 - DNA, 739 bp, Homo sapiens
  misc_feature: GYAE6OF02F99XY.24.87.H10.1.454.CMB.1.raw
tcagactactatgtcacgaccggtgctcgatttagcagtactgcgttgggtttgggggaggaactgctcagttaggacccagacggaaccatggaagccccagcgcagcttctcttcctcctgctactctgctcccagactaccactggagaagtagtcatgacgtcagtctccacgccacctgtctcgtctccgtccgaagggaagacgacccaccctctccgtgcgacggccagtgatagtgtgacagactacgtcgctggaccagacgaacgaccgtcggcacggcctccgacgtcctcctctcgtatcgcctccgtcctacccgaccggtaccggtccccgtggtccgtcccgaccggtaccggttacgggttccgggttacggggtccgggttcggggtcggtacgggaccgttacgtttacgttccgaccgttcctaccgtaacctcgtccggtaccgtcccgttacccgtccgttacgtacggttaacgttaacgtttcgtttacgtaacctttacgtttttaacgtccgtacgtacttaaccgtagtttacgttagttccgggtactcccgtaccttccggttaaccgtttcggtttccgggaaccggtaacgaacccgttaagacggtactaacgtaaccgtacggtacgttcgggtaacgtccgtaacgtaaccgtaccgttacgttacccgtttaccggttcctaccgttacctttcgtaccccgtac

SEQ ID NO: 220006 - DNA, 814 bp, Homo sapiens
  misc_feature: GYAE6OF02GD5BB.24.87.H10.1.454.CMB.1.raw
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
tcagactactatgtcacgaccggtgctcgatttagcagtactgcgttgggttgggggaggaactgctcagttaggacccagacggaaccatggaacgccccagcgcagcttctcttcctcctgctactctggcctccagactaccactggaanaagtagtacatgaccntagtctccagcccacctntctagtcgtcctaccgaaggggaanacgtcccacccttctccgtagcgaacgggtccaaggtacgaaggtaaactcgggttaacggctacgtacctaaaacgtttccggccgttaacggaaccgacgtaccgtaaaacgtaaacccggtccgggaacctaacggggcccctacccgtaaaccgggttccctacccccgttacccgtaacgtttaacggtaccggttccggtttacccgtacccgttaacccgaaccccgggtaccggggttccccctcgggttacccgtacccctacgggtccggtaacggggttttcccgggttggggttacccggggtttcggggtacggtttaggggaccctttaaggtttaacctttccgaaccttccgtaacccgtaaactacgtcgtccgacccgttcccgtactaccgtactacgtaacgtttacgttcgtactttacgtttattactcgtactaacgtatacgtagtcgacgtcgtacctacgtacttacgttccgaccggaacggtaacctaagtacggtacaacgttacgaacgtacggtactcggtacgtacacgttacgacttcggttacttcgttacgtcacccgttacgtacc

SEQ ID NO: 220007 - DNA, 712 bp, Homo sapiens
  misc_feature: GYAE6OF02I30YF.24.87.H10.1.454.CMB.1.raw
  modified_base (310)..(310): a, c, t, g, unknown or other
  misc_feature (310)..(310): n is a, c, g, or t
tcagactactatgtcacgaccggtgctcgatttagcagtactgcgttgggttgggggaggaactgctcagttaggaccagacggaaccatggaagccccagcgcagcttctcttcctcctgctactctggctcccgagataccactggagaagtagtcatgacgcagtctccacgccaccctgtctgtgtctccgaggggaaagcgccaccctctcctgcgacgggccaggtagagaattggttcggcagactaacttacgccgtcgtaccgagacgaagaaccgtggccgaggcctccgagcctcctcncttatcgtcgtcgtcctccaccggtaccggtccccgtaggtcccgtaccccgtacggtcccggttagggtttccggttcgggggtaccgggttcggggttccggtacgggtaccgtacggtttactttcccgacgttcctaacgaaccctactccgaccggtcccgtcccgtaccgtcggttacgtaggtaacgttcttttacggacttttaccgttttcgtttccgtacgtaccttaacgtacgttacgttacggtctaccgtccggttccgtacgttccggtttaccgtttcggaccggtaaccgggtacctaacggtgtaacgtactaacgtaacgtacgttgggactacgcgaccgtaatcgttcgtctttcctacgtccttttcccgccgttaaccg

SEQ ID NO: 220008 - DNA, 727 bp, Homo sapiens
  misc_feature: GYAE6OF02FWKGM.24.87.H10.1.454.CMB.1.raw
  modified_base (171)..(171): a, c, t, g, unknown or other
  misc_feature (171)..(171): n is a, c, g, or t
  modified_base (409)..(409): a, c, t, g, unknown or other
  misc_feature (409)..(409): n is a, c, g, or t
tcagactactatgtcacgaccggtgctcgatttagcagtactgcgttgggtttgggggaggaactgctcagttaggacccagacggaaccatggaagccccagcgcagcttctcttcctcctgctactctggcctcccagataccatggagtaaagtagtcatggaccgtnacgttctccagcccacctgtctgtcgtcctcgaaggggaaacacgcccacccttctccgtgaccgagggtaccaggtcgaagaagttggttggaccaggaactaacgtttcgccgttacggaaccgacgactaaacggaaaccgtcggaccgtagtccctacccggacggtcctcccctccgtactacgttcgaccgttcgaccctaacccgaccgggtaccggcccgttcgggtacnccccgtaaggcccgttacgggttcgggttcgggccggttagggggtctacgggtactacgttactttcctcgtactaccgactacgccgtaacgggcctaccgtcgtacgtcgttaagtaacgtttacgttcgtaccttaacgttttacgtcctacgttaacctaagttaccttgtaacgacgtcgtcttcccgttacgttacgttacgtcggggtaacgtacggtaaccgtaatcggtacgtaagtaaccaacgtacggtcgtcgacgttacactaccgtcgtcgttacgttccttaccgtacttcccgtccgtacc

SEQ ID NO: 220009 - DNA, 506 bp, Homo sapiens
  misc_feature: GYAE6OF01AZYPN.44.71.G05.1.454.CMB.1.raw
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (502)..(502): a, c, t, g, unknown or other
  misc_feature (502)..(502): n is a, c, g, or t
tcagacagtatatacacgaccggtgctcgatttagtgtcgtcgcaagagagagggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacagcccccaaatcattattatgcggtcaatgttcgcccttccggtgtcccctgagcgcttctctgggtccaagtctggcaacacggcctccctgacccatctctggctcaggctgagacgaggctgattattactgcagctcaatatacaagtggaactactttaanattcggcncagggaccaagctgaccgtcaggtcagcccaaggctcgcccctggtcncgtc

SEQ ID NO: 220010 - DNA, 320 bp, Homo sapiens
  misc_feature: GYAE6OF01D57P3.44.71.G05.1.454.CMB.1.raw
  modified_base (306)..(306): a, c, t, g, unknown or other
  misc_feature (306)..(306): n is a, c, g, or t
  modified_base (312)..(320): a, c, t, g, unknown or other
  misc_feature (312)..(320): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtctgggtcgcctggacagtcggtcaccatctcctgcactggagccagcggtcagcccaaggccaaccccactgtcactctgttcccaccctcctctatatactgtctgagcgggctggcaaggcncatagnnnnnnnnn

SEQ ID NO: 220011 - DNA, 273 bp, Homo sapiens
  misc_feature: GYAE6OF01BOV7R.44.71.G05.1.454.CMB.1.raw
  modified_base (270)..(273): a, c, t, g, unknown or other
  misc_feature (270)..(273): n is a, c, g, or t
tcagacagtatatacacgaccggtgctcgatttagtgtcgtcgcaagagagaggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggctacttcctcgatcgcgtctgagcggctggcaaggcgcatagnnnn

SEQ ID NO: 220012 - DNA, 525 bp, Homo sapiens
  misc_feature: GYAE6OF01BAE5T.44.71.G05.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacacgcccccaaatcattatttangcggtcaatgttcgcccttcggtgtccctgacgcgcttctctgggtccaagtctggcaacncggcctcctgaccatctctggctccagctgaggacgaggctgattattactgcagctacatataacgaagtgggaactactttactagttcggcgcgacgggaccaagcgtgacccgtctaggtcacgcccaaggcctcggccccctcggtcaccgtccg

SEQ ID NO: 220013 - DNA, 533 bp, Homo sapiens
  misc_feature: GYAE6OF01APFBP.44.71.G05.1.454.CMB.1.raw
  modified_base (306)..(306): a, c, t, g, unknown or other
  misc_feature (306)..(306): n is a, c, g, or t
  modified_base (427)..(427): a, c, t, g, unknown or other
  misc_feature (427)..(427): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctcctgcactggaaccaacagtgacgtcggtcgttttgaccgtgtctcctggtaccagcacgaccccagaaacacgacccccaaactcattatttangcggtcaatcgttcgcccttcggtcgtccctgacgcgcttctcgtgggtccaagtctcggcaacacggcctccctgacccattcctcgtggctccgagctgagacgagctgattacttacngcagctacatatacgaagtgggaacttactttactacgttcggcgcgaggaccaagcgtgaccgtcgtggccacgcccacggtcctcgcccctcggtctacgtccg

SEQ ID NO: 220014 - DNA, 279 bp, Homo sapiens
  misc_feature: GYAE6OF01A8SUM.44.71.G05.1.454.CMB.1.raw
  modified_base (272)..(279): a, c, t, g, unknown or other
  misc_feature (272)..(279): n is a, c, g, or t
tcagacagtatatacacgaccggtgctcgatttagtgtcgtcgcaagagagaggggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatagnnnnnnnn

SEQ ID NO: 220015 - DNA, 679 bp, Homo sapiens
  misc_feature: GYAE6OF01B06EG.44.71.G05.1.454.CMB.1.raw
  modified_base (305)..(305): a, c, t, g, unknown or other
  misc_feature (305)..(305): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcacatctcctgcactggaaccaacagtgacgtcggtcgttttgaccgtgtctcctggtaccagcacgacccagaaaccacgaccccaactcattatttangtcggtacaattcgttaccgtcccttccggtcgtccctgacgcgtcttcgtcgtcgggtaccaagttcgtcggaccaaccgaccggtccctccctagaccctactctcgtcgggcctaccgaggtcgtaggacggacgacggtctagtaatttaacgttacgtcgcacgtctactaattaacgtaacgtaaggttacggaaaccttaacgtttaacgtacgttccgggacgtaccggaacgggaacccgtaaacggtaccgttaccgggaaccccggtttaccgtaacggggttcccaaacccgggtacccccgaaacggggtccccttaccccggtacccccccggttcggttaccccgtacccgtttccccg

SEQ ID NO: 220016 - DNA, 719 bp, Homo sapiens
  misc_feature: GYAE6OF01CPQUA.44.71.G05.1.454.CMB.1.raw
  modified_base (229)..(229): a, c, t, g, unknown or other
  misc_feature (229)..(229): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctctcactcaggcacaggatcctgggctcagtctgccctggctcagccctccctccgtgtccgggtctcctggacagtcagtcacatctcctgcactggaaccaanagtgacgttcggtcgttttgaccgtgtctctggtaccagcacgaacccagaaaccacgaccccaaaatctaatttatttaatcgtcgtactaagttcgttaccgtccccgtttccgggtcttcccgtacgagtccgtctttccgtcgttcggggtaccctaaaggtccgtacggaccaaaccggtacccggtcccttaccccgtagaacccctacgttccgtccggtcggggtccttacccgaacgggtccgttaaggaacgggaaccggtaacgggtaccgttaaggttaacgttttaaacgttaaccgtcggtaacctaacggtaccttactaaacgttaactaaacgtaaacgggttacgggtaaaccttaacgttttaacgttacgttaccgggacgtacgaaacgggtaaccaaggtccgttacggacccgttacgtggtaccacgacccgaacggtccctcccgtaccccgtcgtacctacccg

SEQ ID NO: 220017 - DNA, 557 bp, Homo sapiens
  misc_feature: GYAE6OF01BUJD5.44.71.G05.1.454.CMB.1.raw
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggactcctgggctcagtctgccctggctcagcctccctcgtgtccggtctcctggacagtcagtcaccatctcctgcactggaaccacagtgacgtcgtcgtttgaccgtgtctcctggtaccagcacgacccagaaacacgacccccaaactcattatttatgcggtnaatgttccncccttcggtctcctgacgtcgcttctcgtggtaccagtctggcaacgacgcctccctgaccatctcgtcgggctccgaggctggacggacgaggctagtattattactgcagctacatactacgaaggtacggaactactttactacgttcggacgacgacggaccagtcctacggacccgtacgtacggtccacgacccgaacggtcctacccgccccgttccggtcctccgttcccg

SEQ ID NO: 220018 - DNA, 665 bp, Homo sapiens
  misc_feature: GYAE6OF01DPE8B.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactaggaaccaacagtgacgtcggttcgtttgaccgtgtcctcctggtaccagcacgacccaagaaacacgacccccaaactctaatttattatcggcggtacaagttcgttccgtccccgtttccggtcgttcccctgacgtcgtcctttccgtcgttcgggtaccctaaggttccgtacggaccaaccgtacccgggtcccttccccgtagaccctaacttccgttccggtcgggtccctcccggaagggtccgtaagggacgggtacggaggcttagtactttaacttaccgtgactagtcctactaatacgtaacgtaagggtacggtaaacttactttaacttacgttacggcgacgtaacgggaccaagtcgtacggtacccgtactacggtccaaccgcccgaacggtccgtacccgcccccgtcggtcctccgttcccg

SEQ ID NO: 220019 - DNA, 629 bp, Homo sapiens
  misc_feature: GYAE6OF01AR1FO.44.71.G05.1.454.CMB.1.raw
  modified_base (310)..(310): a, c, t, g, unknown or other
  misc_feature (310)..(310): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatcctcctgcactggaaccaacagtgacgtcggtcgttttgaccgtgtctccgtggtaccagcacgaccccagaaaccacgacccccaaactctattattangcggtcaatcgttccgcccttcggtcgtccctgacgctcttctcgtcggtacagtctggacaacgcgtcctccgtgacctatctcgtcggcctccgaggtctaggacggacggacgtcgtagtactttacgttacgtggtacagtccttacgtaacttaacgtaacgtaagggttaccgggtaaaccttaaccgttttaacgttacggttccggacgtacggtaacggacctaacgtccgtacggtacccgttacgtacggtccaccggtacccgaacggtcccgtacccggtacccccgttcggtcctaccgttcccg

SEQ ID NO: 220020 - DNA, 602 bp, Homo sapiens
  misc_feature: GYAE6OF01D9FXG.44.71.G05.1.454.CMB.1.raw
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctcctgcactggaaccaacagtgacgtcggtcttttgaccgtgtctcctggtaccagcacgacccagaaaccacgacccccaaactctaattatttatggcggtacaattcgttaccgtcccttcggtcgtcccctgacgcgcttctcgtcgggtccaagtctggcaacgcggcctccctgaccctatcctcgtcgggcctccgaggctggacggacgaggctagatttacttacgtgcagctacaatactaacgaaggtacggaactaacgttttactagttcggacgacgtacgggaaccaagtccgtacggtaacccgttaccgtacgggtccaaccggacccaaacgggtccttacccggaccccccgttcggtacctaccgttccccg

SEQ ID NO: 220021 - DNA, 580 bp, Homo sapiens
  misc_feature: GYAE6OF01D07JX.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgacccagaaacacgcccccaaactcattattatgcgtcaatgttcgccttccggtgtccctgacgcgcttctcgtgggtccaagtctggacaacaccggccctcccgtgaccctatcctcgtcgggtcctccgacggctggaggacgaggctcgacttattactgcagctacaataagtaaaagaacgacaaactacgttagttaatacgttcggacgggtaacgggaccgaagcgtacggtacccgttaccgtacggtccacgtaccccgaacggtcctaccggcccccttcggtcctaccgttccg

SEQ ID NO: 220022 - DNA, 586 bp, Homo sapiens
  misc_feature: GYAE6OF01CYZKI.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggttcgttttgaccgtgtctcctgtaccagcagaccccagaaacacgcccccaaaactccaactttatttatgtcggtcaattgttccgccctttccggtcgtccctgacgcgtccttctcgtcgggtccaagttctggcaacaccggccctcccgtgacccatcctctcgggcctccgaggctgacggacgaggtctgtattattactgcagctcatataacaaggtagggaactactttactagttccggcgacgacgggaaccaagtcgtcggacccgttacgtacggttccaccggtacccgaaggtccctacccgccccccgttcggtccctaccgttcccg

SEQ ID NO: 220023 - DNA, 630 bp, Homo sapiens
  misc_feature: GYAE6OF01C5T4X.44.71.G05.1.454.CMB.1.raw
  modified_base (198)..(198): a, c, t, g, unknown or other
  misc_feature (198)..(198): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctctcactcaggcacaggatccgtgggctcggtctgccctggctcagcctccctcgtgtccgggtctcctggacngtcagtcacatctctgcactggaaccaacagtgacgtcggttcgtttgaccgtgtctcctggtaccagcacgacccagaaacacgaccccaaatctaattattatcgcgtactaagttgttccgtaccctttccggtcgtcccctggtacgtcgtctttcgtcgtcgggtacctaagttcgtacggacctaaccgacccggtcccttacccgtcgaccctactccgttcgtcgggtcctccgaggtcgtacggacggacgacggtctagtaatttacttacgtgcgtacgtctactaagttaactaacgaaggttacggtaacttactttactacgttcgacgtacgaacggtaccagtcctacggtacccgttacgtacggtccacggtacccaacggtcctacccgcccccgttacggcctccgttcccg

SEQ ID NO: 220024 - DNA, 651 bp, Homo sapiens
  misc_feature: GYAE6OF01BCIBB.44.71.G05.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatccgtgggctcagtctgccctggctcagccctccctcgtgtccggtctccgtggacagtcagtcacntctcctgcactgaaccngctaatttcagttgtaatcatcgactatcgtcctcctaggtaccagcactccacccaggccaccaccgcccccagtctcgtgtattttgagtacaatacgccgtcccgtcggacgggtcccgtagtcggttctcgtcgtcctaccgagtcgtcggaccaaaccgccggtccctccgtcgtaccgtccgtcgtcgggtcctcccgaggcctagaccgtagtcggagtcgttagtaactttacgttacgtgacgtaacgtcgtaccggtagttacgggaccggtaccttaaccgttagttacggtttacgtttccgggttaccggtttacggggaccgggtacggtaacccgtaggtacccgttccggtaaccccggttacgtaccgggttacgaacccggtacccgacgggtcccgttacccccgg

SEQ ID NO: 220025 - DNA, 273 bp, Homo sapiens
  misc_feature: GYAE6OF01EDBKJ.44.71.G05.1.454.CMB.1.raw
  modified_base (264)..(264): a, c, t, g, unknown or other
  misc_feature (264)..(264): n is a, c, g, or t
  modified_base (270)..(273): a, c, t, g, unknown or other
  misc_feature (270)..(273): n is a, c, g, or t
tcagacagtatatacacgaccggtgctcgatttagtgtcgtcgcaagagagaggggctcgtggatacagatatgacatgctctactccaatggtatggacgcctggggccaagggaccacggtcgccgtctcctcagcctccaccaagggcccatcggtcttcccctggcaccctcctccaagagcacctcgtggggcacagcggccctgggctgcctggtcaaggactacttccacgtctactgctgagcggctggcaaggcncatagnnnn

SEQ ID NO: 220026 - DNA, 725 bp, Homo sapiens
  misc_feature: GYAE6OF01CX1BX.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctcgccctggctcagcctccctcgtgtccgggtctcctggacagtcagtcaccatctcctgcactggaaccaacagtgacgtcggttcgttttgaccgtgtctccgtggtaccagcacgacccaagaaaccaccgacccccaaactctaatttattacgtcgacgtactaacgttcgttccgtccccttcggtcgtcctgacgtctcttcgtcgtcggtacagtctcgacaaccgaccgtccctccgtacgacctatcctcggtcggcctccgaggtcgtaggaacggtacgacggtactaggtaactttacgttcgtacgacgtactaccgtactaagttaacgtaaaccggttaagggttaaccggtaaacctttaccggttttaaacgttagggttaccccggggacgtaaccggtaaaccggggtaaccctaggtcccggttaacccggttaaccccgttaccgggttaaacggacccggtaaacccggacccccggtaaacggttccccggttaacccccggtcccccgttacccgggtcccctttaaccgttttaccccccgg

SEQ ID NO: 220027 - DNA, 644 bp, Homo sapiens
  misc_feature: GYAE6OF01CDOJJ.44.71.G05.1.454.CMB.1.raw
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (457)..(457): a, c, t, g, unknown or other
  misc_feature (457)..(457): n is a, c, g, or t
  modified_base (501)..(501): a, c, t, g, unknown or other
  misc_feature (501)..(501): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcacgccctccctcgtcgtccggtctccgtggacagtcacgtcacctatcctctgcactacggaaccaacgagtcgacgttcggttcgtttgaccgtcgtcctccgtcgtaccagccacgacccaagaaccnccgacccccaatctattattancgacgtactactcgttccgtcccgttccggtctccgtgacgtcgtcttcgtcgtcggtacaggtctcggaccaaccgacgtccctccgtacgacctattccgtccggtggtccctccgaggtcgtagggacggacgnggtcttagtatttagttgttgttcacttacagtctttggtccgntacgtacttactatttacgttcggtacgttacgggtaaggttccgggaaaccgtaggttacccgtacccggtaggttacggtccgacccggtacccgaacgtacccccgaaaccctcggtaccggtctaacccgtttacccgg

SEQ ID NO: 220028 - DNA, 632 bp, Homo sapiens
  misc_feature: GYAE6OF01BBRAL.44.71.G05.1.454.CMB.1.raw
  modified_base (191)..(191): a, c, t, g, unknown or other
  misc_feature (191)..(191): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctgactcagcctgcctccgtgtctgggtcncctggacagtcagtcaccatctcctgcactggaaccacagtgacgtcggtcgtttgaccgtgtctcctggtaccagcacgaccccagaaaccacgacccccaaactctattatttatgcggtacaattcgttccgtccccgtttccggtcgtccctgacgtccgtccttcctcgttcgggttacccaaggttcctcggaccaaaccgacccgggtccccttccccgtacgaaccctacttccgttccgtcgggcccttcccgacgggtcgtaggacgggaacggaggtctagtaagtttacttacgtcgacagtcctacattaactaacgtaagtacggtaaacttacgtttactacgttcggcgacgacgggtaaccaaggtctacggacccgtccgtacggtcaacggtcccaacggcctccgtcccccgtcggtaccc

SEQ ID NO: 220029 - DNA, 670 bp, Homo sapiens
  misc_feature: GYAE6OF01CCX7L.44.71.G05.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatcctctgcactcggaaccaacngtgacgtcggttcgtttgaccgttgtctcctggtaccagcacgacccagaacacgacccccaaactcattatttangacggtcaattcgttaccgtcccgttcgggtcgttcccgtgacgcgtccttcgtcgtcgggtacctaagttcgtacggaccaaaccgtcccgggtcccctcccgtacggtaaccctacgttccgttccggtcgggtccctacccgacgggtccgttagggaacgggaccggtaacgggtacctaggttaactttaacgttactcggtcgtaaggtccttactaattacgaacgtaaaggtacggtaacttacgttttaactacgttcggacgacggaacggaaccgagtctacggtacccgttagacgtcgacgtacccgaaggtccctcccggtacccccgttcggtccctccgttaccccg

SEQ ID NO: 220030 - DNA, 383 bp, Homo sapiens
  misc_feature: GYAE6OF01C4JK7.44.71.G05.1.454.CMB.1.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (300)..(302): a, c, t, g, unknown or other
  misc_feature (300)..(302): n is a, c, g, or t
  modified_base (305)..(306): a, c, t, g, unknown or other
  misc_feature (305)..(306): n is a, c, g, or t
  modified_base (308)..(383): a, c, t, g, unknown or other
  misc_feature (308)..(383): n is a, c, g, or t
tcagacagtatatacacgaccggtgctcgatttagtgtcgtcgcaagagagagggggctcgtggatacagatatgacatgctctactccaatggtatgggacgccctggggcccaagggaccacggtccgccgtctccctcacgcctccaccaagggcccacttcggtcttccccctggccaccctcctccaagcgccacctcgtgggggccacgacgcggccctgggctcgccctggtcaaggacttaccttccctcgatccgcgtctggaggcgggctggacaaggcncataagnagnnngcnntnnnnnnnnnnnnnnnnnnnnnnnnnnnnnnnnnnnnnnnnnnnnnnnnnnnnnnnnnnnnnnnnnnnnnnnnnnnn

SEQ ID NO: 220031 - DNA, 636 bp, Homo sapiens
  misc_feature: GYAE6OF01D2LMX.44.71.G05.1.454.CMB.1.raw
  modified_base (320)..(320): a, c, t, g, unknown or other
  misc_feature (320)..(320): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtccaccatcctcctgccactcggaaccaacaggtgacgttcggttcgttttgaccgtgtcctccgtggtaccagcagaccaccaagaaacaccgaccccaaactctatttatttacnggtcgtacagttcgttccgtccctttcggtctacccgtgacgtccgtcttctcgtcggtaccacgtctacggaccaaccgccggtccctccctagacctacttccgtcgtcggccgtccggcgtaggacggacgtacggtcgtcgtaacttacgttacgcgtcgtacctacttaactttacaacttcgttagacgttacggttgggttcggttcgggtacggtacggtacctaccgtaccgttcgtacccgttcgtacgtacgaccgcccgacgcccgtccgtccccgtacgtccctaccttccgtcccgtccccg

SEQ ID NO: 220032 - DNA, 668 bp, Homo sapiens
  misc_feature: GYAE6OF01B7LQ7.44.71.G05.1.454.CMB.1.raw
  modified_base (198)..(198): a, c, t, g, unknown or other
  misc_feature (198)..(198): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccgggtctcctggacngtcagtcaccatctcctgcactggaaccaacagtgacgttcggtcgttttgactagtgtctcctggtaccagcacgaccccagaaaccacgccccaaatcattattatgcggtactaatcgttccgcccttccggtgtcccctgacgccgtccttcgtcgttcggggtcctaagtccgtcggacctaacgccggtccctccgtcgacctatcctcgtcggcctcgcgcgtgacggacgaggtcgtagtattacgttacgtcgcgtacgtctactataactaacgtaacggtacgggtaaacttacgtttaacgttacgttacggaccgtaccggttaacggggaaccctaaacggtcccgtaacgggtaccccggttaacccggttacgggtacccgtaacccgggacccggtaaaccgggtcccgttaaccccggtccccccggttcccgggttacccgttaaccccgg

SEQ ID NO: 220033 - DNA, 697 bp, Homo sapiens
  misc_feature: GYAE6OF01CH5TQ.44.71.G05.1.454.CMB.1.raw
  modified_base (242)..(242): a, c, t, g, unknown or other
  misc_feature (242)..(242): n is a, c, g, or t
  modified_base (412)..(412): a, c, t, g, unknown or other
  misc_feature (412)..(412): n is a, c, g, or t
tcagacagtatatacacgaccggtgctcgatttagtgtcgtcgcaagagagagggggggggatctcaggaggcagctctctcggaatatctccaccatggcctgggctctgctcctcctcaccctcctcactcagggcacaggatcctgggctcagtctgccctggctcagccctcccgtccgtcgtccgggtctcccgtggacagtcagtccacctatcctctgcactacggaaaccaacngtcggtacgtcggttcgtttcgaccgttgtcctccgtggtaccagccaccgacccaagaaaccaccgaccccctaaactactatttacttagtcgtacggtactaagttcgttccgtccccgtttccggtacgtccctgacgtcgtccttcgtcgtcggtaccacgtcgnggaccaaccgcgtcccctccgtacgtaccctatccgtcgtcggcctccgagggtcgtacgggaggaccggagtctagtatttacgttcgcgtacgacgtctacgtaatacgtaaacggtaagggttaccgtaaacctttacgtttaaccgttacggttaccggaccggtaaccggtaaccggaaccggacgtccgttaccgggtacccgttaccggtacgggtacccaccggtacccggaccggttccgtaccccggtccccgtcggtccctcggtttcccccgg

SEQ ID NO: 220034 - DNA, 562 bp, Homo sapiens
  misc_feature: GYAE6OF01BFYFN.44.71.G05.1.454.CMB.1.raw
  modified_base (448)..(448): a, c, t, g, unknown or other
  misc_feature (448)..(448): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacacgacccccaaactcattatttatgcggtcaatgttcgcccttcggtcgtcccgtgacgcgcttctctcgggtccaagtctggcaacgccggccctccctgaccatcctctcgggtctccaggctggacggacgaggctggatttattactgcagtctcaattanacgaaggtacggtaactactttaactcgttcggcgtacgagggacccagtacctcgacccgttcgtaggtccacgacccgaacggcctccgaccccctcggtcctccgttcccg

SEQ ID NO: 220035 - DNA, 594 bp, Homo sapiens
  misc_feature: GYAE6OF01CN72F.44.71.G05.1.454.CMB.1.raw
  modified_base (309)..(309): a, c, t, g, unknown or other
  misc_feature (309)..(309): n is a, c, g, or t
  modified_base (454)..(454): a, c, t, g, unknown or other
  misc_feature (454)..(454): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaccaacagtgacgtcggttcgttttgaccgtgtctcctggtaccagcacgaccccagaaacacgacccccaaatcattatttangcggtcaatgttccgccctttccggtgtccctgacgcgtcttctcgtcgggtcctaagtctggaccaacgaccgggccctccctaggaccctattccgtcgtcgggcctaccgaggctacggaggacgaggctgtacttattacncgcacgctacaataactacaagggtacggtaaccttactttactacgttcggacgtacggacggaccaggtcctacggtaccgtaccgtaggtccacgtacccgaaggtccctccgacccccgttcgcctaccgttcccg

SEQ ID NO: 220036 - DNA, 686 bp, Homo sapiens
  misc_feature: GYAE6OF01B3S26.44.71.G05.1.454.CMB.1.raw
  modified_base (217)..(217): a, c, t, g, unknown or other
  misc_feature (217)..(217): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcaggcacaggatccgtgggctcagtctgccctggctcacgtcctccctcgtcgtccggtctccgtggacagtcagtcacatcctcngcacgtcggaaaccacgagtcgacggttcggttcgtttcgaccgtgtcctccgtacgtaccacgaccaacgacccgaagaaaccaccgaacccccaaacttctaatttactttagacggtacgtactaagttcggttccgtacccgtttcggtcgttccctaggacgtccgtaccttcgtacggttcggtacctagttcgtacggacctaaccgaccggtccctccgtagtaccctatccgtacgtccggacctccgacggtcgtagggacggtacggtacgtcttaacgttatttacgtactacgactacgtctactaattaacgtaacggtaacggtacgtaaccttaacgttacgtacgtccggacgtaacgtacggaactacgtacgtaaccggtccgtacgaacggtaccgaccgtaacccgacgtccccgtaccccgtaccccgtcgtaccttcccgttcccg

SEQ ID NO: 220037 - DNA, 740 bp, Homo sapiens
  misc_feature: GYAE6OF01BL5A2.44.71.G05.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
tcagacagtatatacacgaccggtgctcgatttagtgtcgtcgcaagagagaggggggggatctcaggaggcagctctctcggaatatctccaccatggcctgggctctgctcctctcaccctctcactcgaggcacaggatcctgggctcgagtctcgccctggctcgacgtccctcccgtcggtcggttaccgggtctccgtggactaggtcacgtccaacctntctcctgctacgtacggaaaccacgngtcgacgtcggttacgttttacggaccgttgtcctcgttcggacctagacctaacggaaccccaagaaaccgcccgtaacccctaaatcgttaaattttactttaggacgtccggtaactacgtttccggtacccggtcccgtttaccggtcgttaccctgggaacgtccttcgttaccgtggtacgggtacctaagtcggtgaaccgaaccgtccggtacccctacggtacgaccttacgttccgcgggtacggccttacgcggtacgttagggaacgacggtacggaccgttaggttactttaaccgttagtaccgactacgtccgtactaacgtacgtaacgtaaacggtaccggttaaactaacgtttactacgggttcgaccgttaacgacgggtactaacggttccacggtaccctacggtacgaccgacgtaacccgacggttcccacccggacccggttcgtaaccgtccgttaccccgg

SEQ ID NO: 220038 - DNA, 687 bp, Homo sapiens
  misc_feature: GYAE6OF01C34ZM.44.71.G05.1.454.CMB.1.raw
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (410)..(410): a, c, t, g, unknown or other
  misc_feature (410)..(410): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcacgcctccctcgtgtccggtctcctggacagtcagtcaccatctcctgcactacggaaccaacgagtgaccggttcggttcgtttttagaccggttgtccttccgtaggttaccagcaacgacccaagaaaccacgaccccaaatcattattactgcgtcatcgtcnccgttcgctccngcncgtctctcgtcggtacagtcgtgacacgcgtcctccgtacgactagtctcgacggctacgngtctaggaggacgtacggacttaggactttactacgtcgacgtacgtctataacgtaacttaacggtaacggttaccgggtaaacctttaacgttttaaccgtacgtttaaccgggaccgtaaccgggtaaaccgggaaccgtaaaccggtaccggttaccggtaacccggttacccggttaacgggttaaccgaacccgggttaaaccccgggaacggttacccggtaccccggttaccccccggttcggtaacccgttaacccgttttccccggg

SEQ ID NO: 220039 - DNA, 643 bp, Homo sapiens
  misc_feature: GYAE6OF01BQN5L.44.71.G05.1.454.CMB.1.raw
  modified_base (229)..(229): a, c, t, g, unknown or other
  misc_feature (229)..(229): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatcctcctgcactggaaccaangtcgacgtcggtcgttttgaccgtgtctcctggtaccagcacgaccccaagaaaccacgacccccaatcattattatcgcgtcaattcgtccgtcccgttcggtcgtccctgacgtccgtcttcgtcgtcgggtacctaagtcgtcggaccaacgccggccctcctacgaccctacttccgtacgtcgggtccttccgacggtcgtaggacgggacgacggtcgtagtaatttacttacgtgccgtagtctacaataacgtaacgtaaggtacggtaacttacgtttaacgttacgttccggacgtacggtaacgggaacctacgtccgtaccggtacccgttaccgtacggtccgaaccgtaccccgaacggtcccgtaccccggtcccccgttacggtccctccgttccccg

SEQ ID NO: 220040 - DNA, 766 bp, Homo sapiens
  misc_feature: GYAE6OF01E2ICK.44.71.G05.1.454.CMB.1.raw
  modified_base (145)..(145): a, c, t, g, unknown or other
  misc_feature (145)..(145): n is a, c, g, or t
  modified_base (204)..(204): a, c, t, g, unknown or other
  misc_feature (204)..(204): n is a, c, g, or t
tcagacagtatatacacgaccggtgctcgatttagtgtcgtcgcaagagagaggggggggatctcaggaggcagctctctcggaatatctccaccatggcctgggctctgctcctcctccaccctcctcactcagggcacgaggntcctgggctcgagtctgccctggctcacgccctccctccgtgtcccggtctcctggacngtcagtcaccatcctcctgccacgtacggaacccaacgagtcggaccggttcggttcgtttttcggaccgttgtccgtccgtcggtaccacgcaaccgaccccaagaaaccaccgaaccccccaactctaattactttaagcgtcgtcaatttcgttaccgtccccgtttcggtcgtccgtggacgccgtctttcctcgtcgggtacctacgtcgtacggaccaaccgaccggtcccttcccgtacgaccctacgttccgtccgttacgggcccttacccggacgggtccgtacggggaacgggtaacggtaacgggtccttagttaacgtttaacgttaccgtacgtccgaacggtcctaacgtaaattaaccgtaacgaacggtaccaagtaacccaccgtaaccccttaaccgttacgttaccgttaccggttaccggtaaacggttaccgggtaaacccggtaacggttacccgtaaccccggttcccgttacggacccgtaacccgggtaaccccgaacccggtaaaccccctaacccccgttagtcccgttacccc

SEQ ID NO: 220041 - DNA, 777 bp, Homo sapiens
  misc_feature: GYAE6OF01DDRXM.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgcctcctcctcaccctcctcactcagggcacaggatcctgggctcagtctgccctggctcacgtccctccctcgtgtccggtctccgtggactagtcagtccacctatcctcctggaccacgtaggaacccaagtaggtgtacggttcggttcgttttgaccgttgtcctcgtaggtaccagaccaccgaacccagaaaaccgaccgtacccccctaaaatccttaatttagtttacgcggtccggtaacctaacgtttcggttaccccgtcccggttttcccgggtactccccgtgtaccgtcccgttccgtttccgttccggttaggggtaacccttacggttaccgtcgggaacccgtaacccgtacccgggtacccctttccgacgtaaaccgttccttaccgttcccgggttacgggtccctcccggtaacgggcgttaagggaaccgggacggtacgggtacgttacgttaagtttacctttacggacgcgtaaccgtcttacgtaactaacgtaacggtaacgttaacggtaccttacgttttaaccggtcgttacccggacgtaccggtaacgaccgtagtcccgtacggttacccgtacgtacgtaccgaccgtaccgaccgtccgttcccggacccccgtttgtcccgtacgttcccg

SEQ ID NO: 220042 - DNA, 685 bp, Homo sapiens
  misc_feature: GYAE6OF01DMDAN.44.71.G05.1.454.CMB.1.raw
  modified_base (195)..(195): a, c, t, g, unknown or other
  misc_feature (195)..(195): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctctcactcagggcacaggatccgtgggctcagtctgccctggctcacgccctccctcgtgtcgtcgggtccncctggacaggtccggtcaccatcctcctgcactggacgccaggtcggtaattacttcgttagttactttaactttgtcctccttaggttactacaaactatacctaatacccgaacggttaaaaccgacccccctaaaactccaacttactacttacctaagtcggacggtaccttaagaacggacggtcccgtacggtacgggtttactacgtcgtcttcacgtcgacctccgaaggtcccgactaaacgcccggtacctccgtagacctaacgttccgtccggtcgggtcccgtacgacggtcgtaacgggtaacggaccggacgggtcttaggttaattttacgtttagtttggttaccgtctaacggacgttagttcggtttccgtcgtacgttactcgttacttacgtcgttacgttaccgggtagtcgggtaacctaggtccctacggccgttagccaacgacccacggacccaccgtgtaccg

SEQ ID NO: 220043 - DNA, 747 bp, Homo sapiens
  misc_feature: GYAE6OF01ELZKP.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgcctcctcctcaccctcctcactcagggcacaggatccgtgggctcagtctgccctggctcacgccctccctcggtcgtccgggtctccgtggacagtcagtccaccatcctcctgccacgtacggaaaccaacgagtcgtaccggttcggttacgttttcggaccgttcgtccttccgtacggtaccagaccgaacgaaccccaagaaaccaccgaaccccctaaactctattatttagcggcgtactatcgttccgtccgttccgtcgtccctggacgtccgtcttcgtcgtacggtctaacgtcgtacggaccaaccgccgtccctacccgtacgtacctactccgtccgtcgggtcctaccggaggtcgtagggacggtacggacggtcgtagttactttaactacgtcgactacgtcctagtaatacgtaaacgtaaggtaacggtaacctttaacgtttaaccgttacgttaccggacgtaacgggtaaccgggtaaccgtacggtaccgttaccgggtacccggttaccggttaaccggtacccggaacccgggtaaccccggtaaccgggtccccgttacccccgggtacccccccgggttaccgttacccccgtcccgtttacccccgg

SEQ ID NO: 220044 - DNA, 710 bp, Homo sapiens
  misc_feature: GYAE6OF01AT6L8.44.71.G05.1.454.CMB.1.raw
  modified_base (236)..(236): a, c, t, g, unknown or other
  misc_feature (236)..(236): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggactccgtgggctcagtctgccctggctcagcctcctcgtgtccggtctcctggacagtcagtcaccgtatcctccgtgcacgtcggaaaccacnggtcgacgtcggttcgtttcgacgttcgtctccgtgtaccagcacgaacccagaaacaccgaccccaatctaattattactcgcgtacaattcgtaccgtcccgttccggtcgtcctacggactccgtcttcgtacggtcggttaccaacgttcgtacggaccaaccggaccgtccctcccgtacgtaccctacgttccgtacgtccgggcttaccggagggcgtaacgggacggtaggacgggtctaaggttattaacgttacgtcgacgacggtccttaactaacgtaacttaacggtaaaggtacggtaaacctttaaaccgtttacgtaacggttccggtaccgaacggtaacgggtaaaccgtaacgcccggtttaccgtacccggttacgtaacggttacccgaaccgaccccggtaacgtcccgttaccccggacccccgtttacggttaccctaccgttaccccgg

SEQ ID NO: 220045 - DNA, 713 bp, Homo sapiens
  misc_feature: GYAE6OF01APWE8.44.71.G05.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
tcagacagtatatacacgaccggtgctcgatttagtgtcgtcgcaagagagaggggggggatctcaggaggcagctctctcggaatatctccaccatggcctgggctctgctcctcctcgaccctcctcactcgagggcacaggatccgtgggctcagtctgccctggctcagcctcctcgtgtccggtctcctggacagtcagtcacatctccngcactcggaaccangtcgtacgttcggttcgttttgaccgttcgtctccgtggtaccagccacgacccaagaacaccgaccccaaactcgtaattacttacgcgtcggtactaagttcgttccgtcccgtttccgggtccttacccgtggtaccggtcgttccgttccgtcggttacgggtaccctaacggttccgtacgggtacccgtaaccgtacccgggtcccttacccgtacggtaccctactttccgtacggttccgggtccttaccggacgggtcgtacgggacgggtaccggtacggtcgttagtaacgtttacgttacgtcgtactacgtcttactaacttaacgtaaccgtaacggttaacggttaaccttacgtttaaccgttcgtaccggccgtaacggacgggaccgtaaggccgtacggtacccgtacgacggtccgacgtacccgacggtcccgtacccgtccccgtaggtccgtacgttcccg

SEQ ID NO: 220046 - DNA, 734 bp, Homo sapiens
  misc_feature: GYAE6OF01BE6YW.44.71.G05.1.454.CMB.1.raw
  modified_base (277)..(277): a, c, t, g, unknown or other
  misc_feature (277)..(277): n is a, c, g, or t
  modified_base (542)..(542): a, c, t, g, unknown or other
  misc_feature (542)..(542): n is a, c, g, or t
tcagacagtatatacacgaccggtgctcgatttagtgtcgtcgcaagagagaggggggggatctcaggaggcagctctctcggaatatctccaccatggcctgggctctgcctcctcctcaccctcctcactcagggcacaggatccgtgggctcagtctcgccctggctcacgccctccctccgtcggtccggtctccgtggacagtcagtccacatctcctgcactggaaccactgtgacgttcggttcgtttcgaccgtgtcctccgtgtaccngacaccgaccctaacgaaccaccgacccccaactctacttattacgtacggcgttactaagttcgttccgtccccgtttcggtcgtaccccgtgacggtcgtcctttacgtccgttacgggaccctaacggttctacggtaaccaccggtacccgtccctacccgtacgtacccttacgtccttcggtcgggtcccttacgacgggtacgtacgggacgggtacgacggtctaagttacttacgttacttggacgtaccgcgtanaccgtttaagaacggttaacgtagggtaaacctttagtttaacccgtacgttaccggaccgtacggaaacgggctaacgggtaccttacccggttaacccgttacccggttaacggtcccgaacccggtaccggtaccggtaccccgttaccccggtcccccgggtcggtaccccctccggtttacccccgg

SEQ ID NO: 220047 - DNA, 685 bp, Homo sapiens
  misc_feature: GYAE6OF01EFIMT.44.71.G05.1.454.CMB.1.raw
  modified_base (126)..(126): a, c, t, g, unknown or other
  misc_feature (126)..(126): n is a, c, g, or t
  modified_base (573)..(573): a, c, t, g, unknown or other
  misc_feature (573)..(573): n is a, c, g, or t
tcagacagtatatacacgaccggtgctcgatttagtgtcgtcgcaagagagaggggggggatctcaggaggcagctctctcggaatatctccacatggcctgggctctgctcctcctcacctcctnactcagggcacaggactccgtgggctcagtctcgccctggctacactcccttccctccggttcggtccgggtctccgtggacacgtcagtcaccactctcctgcactacggaaaccacagtcgtacggtcggttcggtttcgaccgttgtccgttccgtcggtaccacgacaaccgacccaagaaaccgaccgacccccgtaaactaccttaatttacgtttacgtcggtacggttactaacgttcgttacccgttccggttacccggttcgtcccgtacggtacgtccgttcttcgtcggttacggtacctaacgtcgtcgacgaaccgccgtccctaccgttcgaacctcgttaccgttccgtacggtccgtaccgacggtacgtacggacgggacggtacggtacgtacgttactttacttacgtcgactacgtctactactanaacgtagtacggtaactacttacgtacgtcgcggacgacgacgacgacgtcgtaccgtagttacgtaccgacgaccgtaacgtccgtacccgtcccgtcgtccgtcttcccg

SEQ ID NO: 220048 - DNA, 683 bp, Homo sapiens
  misc_feature: GYAE6OF01EA6YL.44.71.G05.1.454.CMB.1.raw
  modified_base (233)..(233): a, c, t, g, unknown or other
  misc_feature (233)..(233): n is a, c, g, or t
  modified_base (513)..(513): a, c, t, g, unknown or other
  misc_feature (513)..(513): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctctcactcagggcacaggatcctggctcagtctgccctggctcagccctccctccgtgtccgggtctccgtgacagtccagtcaccatctcctgcactcggaaccaacngtgacgttcggttcgttttgaccgtgtctccgtggtaccagccaacgaccccaaagaaaccaccgtaccccccaaaatccaactttaatttactggtcggtactaacgttcgttccgtcccctttccggtcgttcccctagacgccgtctttcgtccgtcggtaccaacgttctacggcctaaacgcccgtccctcccgtacgacctacgtcctcgtcgggtccctccgtaggtcctaggtaacgggacgtcggtacttacggttaatttacgttaacgngtactacgtactactaagtactaacgtaaggtaccgggtaaacttaccttttaacgtacgttacggtacgaccgaacgggtaccaaacgttcgaacgtccctaacgttccggtacggtacccaacggttaccccaacggtccctaccccggtcccccgttgggtaccccc

SEQ ID NO: 220049 - DNA, 797 bp, Homo sapiens
  misc_feature: GYAE6OF01B3J2G.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcgaggcacaggatccgtgggctcagtctcgccctggctcagtccctccctccgtggtcccgggtctccgtggacagtcacgtcaccatcctcctgacctacgtacggaaaccaactagtggtaccgttcggttcgttttcggaccgttgtccgtccgttacggtaccgacgaccaccgaaccccgaaacggaaaacccgacccgaacccccctaaacgttacttaaacttttaagtttacgtcgggtaccgttaccgtaagtttcgtttccccggttccccgtttccgggtaccttcccgtagacgtccgtcctttcgttcggttcggtaccgtaacgtcgtcggactaaccggaccggtccccttacccgtaacggaccctacgttcccggttacgtcccggttaccctaccggtacgggtccgttaaggggaaccggtacggtaacggttacgtttaaatttaccgtttacgacggtcctaacgtccgttaacttaagttaaccgtaacgtaacggttaacggtaacctttaacgtttacgtaccgttcggccggtacgaacggtaacccgtaagtcctacggtcccttacggtaaccgtaccggaacgcccggtaaccgcccgttcccggaccccgttgtacccgtcccgtgtttaccccccg

SEQ ID NO: 220050 - DNA, 273 bp, Homo sapiens
  misc_feature: GYAE6OF02IANM7.44.71.G05.1.454.CMB.1.raw
  modified_base (270)..(273): a, c, t, g, unknown or other
  misc_feature (270)..(273): n is a, c, g, or t
tcagacagtatatacacgaccggtgctcgatttagtgtcgtcgcaagagagagggctcgtggatacagatatgacatgctctactccaatggtatggacgcctggggccaagggaccacggtcgccgtctcctcagcctccaccaagggcccatcggtcttccccctggcaccctcctccaagagcacctctggggcacagcggccctgggctgcctggtcaaggactacttcctatatactgtctgagcgggctggcaaggcgcatagnnnn

SEQ ID NO: 220051 - DNA, 509 bp, Homo sapiens
  misc_feature: GYAE6OF02IX2JU.44.71.G05.1.454.CMB.1.raw
tcagacagtatatacacgaccggtgctcgatttagtgtcgtcgcaagagagagggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacagcccccaaactcattattatgcggtcaatgttcgcccttcggtgtccctgagcgcttctctgggtcccaagtctggcaacacggcctccctgacccatctctgggctccaggctgaggacgaggctgattattactgcagctcatatacaagtggaactactttacatttcggacgcagggaccagctgaccgtctaggtcagcccaaggctcgcccctcggtcactc

SEQ ID NO: 220052 - DNA, 277 bp, Homo sapiens
  misc_feature: GYAE6OF02F7DY7.44.71.G05.1.454.CMB.1.raw
  modified_base (275)..(277): a, c, t, g, unknown or other
  misc_feature (275)..(277): n is a, c, g, or t
tcagacagtatatacacgaccggtgctcgatttagtgtcgtcgcaagagagaggggacctccaaggaacggttcgggaatcataaactactactatttgatggatgtctggggcagggggacgtcggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 220053 - DNA, 274 bp, Homo sapiens
  misc_feature: GYAE6OF02H67AB.44.71.G05.1.454.CMB.1.raw
  modified_base (271)..(274): a, c, t, g, unknown or other
  misc_feature (271)..(274): n is a, c, g, or t
tcagacagtatatacacgaccggtgctcgatttagtgtcgtcgcaagagagagggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggactacttccacgtctactgctgagcgggctggcaaggcgcatagnnnn

SEQ ID NO: 220054 - DNA, 272 bp, Homo sapiens
  misc_feature: GYAE6OF02IPEMF.44.71.G05.1.454.CMB.1.raw
  modified_base (269)..(272): a, c, t, g, unknown or other
  misc_feature (269)..(272): n is a, c, g, or t
tcagacagtatatacacgaccggtgctcgatttagtgtcgtcgcaagagagaggggctcgtggatacagatatgacatgctctactccaatggtatggacgcctggggccaagggaccacggtcgccgtctcctcagcctccaccaaggcccatcggtcttcccctggcaccctcctccaagagcacctctggggcacagcggccctgggctgcctggtcaaggactacttcctatatactgtctgagcgggctggcaaggcgcatagnnnn

SEQ ID NO: 220055 - DNA, 613 bp, Homo sapiens
  misc_feature: GYAE6OF02JESXQ.44.71.G05.1.454.CMB.1.raw
  modified_base (327)..(327): a, c, t, g, unknown or other
  misc_feature (327)..(327): n is a, c, g, or t
  modified_base (433)..(433): a, c, t, g, unknown or other
  misc_feature (433)..(433): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcggtcaccatctcctgcactggaaccaacagtgacgtcggtcgttttgaccgtgtctcctggtaccagcagaccccagaaacacgcccccaaactcattattatgcgtcaatgttcgcccttcggtntccctgacgcgcttctcgtcgggtccaagtctcggcaacgacggcctcctcgaccatcctctcgggacctccgaggctagacggacgacggctagacttattacgngcagtctcatactacgaagtagggaactacgtttactaacgtttcggacgtacgaacggggaacctaacggtcgttacggtaacccgttcccgttaagggtacctaaccggaccccgtaaacgggtccccttaccgggcccccccgttcgggtaccctaaccgttcccgtttaccccggg

SEQ ID NO: 220056 - DNA, 537 bp, Homo sapiens
  misc_feature: GYAE6OF02HYXJ3.44.71.G05.1.454.CMB.1.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
  modified_base (376)..(376): a, c, t, g, unknown or other
  misc_feature (376)..(376): n is a, c, g, or t
  modified_base (530)..(530): a, c, t, g, unknown or other
  misc_feature (530)..(530): n is a, c, g, or t
tcagacagtatatacacgaccggtgctcgatttagtgtcgtcgcaagagagagggggggatctcaggaggcagctctctcggaatatctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctctggtatcaanatcatcagtaaagccccaaatcatcatctatgacgcctataagacggcctcaggggtttcaatcgcttcactgcctacaagtccgcaacacggcctcctgacatctcnggctcagctgacggcgagctgattattattgtgcttcagtattgttcgtcgctatcctaattattgtaccgttacgggaaggttcgggaacctaaggttccaaccggttcccgtagggtccgaacgtccccgtaaacgggccctaacccccgtnttaccgg

SEQ ID NO: 220057 - DNA, 682 bp, Homo sapiens
  misc_feature: GYAE6OF02JFKBQ.44.71.G05.1.454.CMB.1.raw
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccaacagtgacgtcgtcgttttgaccgtgtctcctggtaccagcacgaccccagaaaccacgcccccaaactcattatttatgcggtcaatcgttccgccctttccggtcgtcccctgacgtccgctttctcgtcgggtccaaggttctcggaccaacgaccggtcccttccctggaaccctattcctcgtcgggccttccgagggcctaggacggaccgggaggccttaggtaacttttaacgttaacgttggacccgtaaggtcccttacgaactttaactaacgtaaaggttacggggaaaccttaaccgtttttaacctacgtttccgggaccgtaccgaacggggtaacccaacgtccgtacggtaaccccggttaccgttaacggtccgaacggtaccccgaaagggtccctacccggtaccccccggttcggttaccctacccgtttcccgg

SEQ ID NO: 220058 - DNA, 542 bp, Homo sapiens
  misc_feature: GYAE6OF02G8FAT.44.71.G05.1.454.CMB.1.raw
  modified_base (268)..(268): a, c, t, g, unknown or other
  misc_feature (268)..(268): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacagggtcctggggactgtctaccctgactcagccgccctcagtgtccgggactcctggtcagtcggtcaccatcttctgttcttccagcgacaattcccactggccctttaaagtctctatcatggtacncagtggtccggccgagccccaaagtcctctttacgacgtcctttcgcgggcttcggcagtccctggtccgttttcggcctcctagttctgaccacgcgcctcctgccatcaccaactccggctgagatgaggctcgacttacttttgtgtgcatattcgattcactcaaatntgtctggaagtgggacccgngtcaggctcctgcgtcacgcccaaggcccaaccccactcgtacacctcgtcgttccccacccttccgtcctactactactcg

SEQ ID NO: 220059 - DNA, 580 bp, Homo sapiens
  misc_feature: GYAE6OF02GYERG.44.71.G05.1.454.CMB.1.raw
  modified_base (458)..(458): a, c, t, g, unknown or other
  misc_feature (458)..(458): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacagggtcctgggcccagtctgccctgactcagccctccctccgcgtccggtctcttggacagtcagtcaccatctcctgcactggcaccagcagtgacattggtaggttattaactttgtctctgtaccaacaccaccagcaaacgaccccaaactcattacttttgacgtccagtgagcggccgtcaggttgtttactaatcgtcttctctggctacctaagtctcggccacgaccgtcctcgttagaactttaatttcgtcggtcccttcctcgtccctggaccgacggacggacccgtacttattagttgcttgctnatagtcgtccgggtacctagtattacgttgggttcgttcgggcggtacgggccgctcgaccgtcgtaggtccacgacccgaggtcctccggtcccctcggtaccaccttcgtcgttaccccg

SEQ ID NO: 220060 - DNA, 518 bp, Homo sapiens
  misc_feature: GYAE6OF02HT9E8.44.71.G05.1.454.CMB.1.raw
  modified_base (302)..(302): a, c, t, g, unknown or other
  misc_feature (302)..(302): n is a, c, g, or t
  modified_base (455)..(455): a, c, t, g, unknown or other
  misc_feature (455)..(455): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaacagccccaaactcattatttangcggtcaatgttcgcccttcggtcgtcctgagcgcttctctgggtccaagtctggcaacacggcctccctgaccatctctgggctccaggctgaggacgaggctgattattactgcagctcatatacaagtggaactactttactattcggcncgagggaccagctaggaccgtcctaggtcacgcccaaggcctcgccccctcggtccacttccg

SEQ ID NO: 220061 - DNA, 576 bp, Homo sapiens
  misc_feature: GYAE6OF02GN8AF.44.71.G05.1.454.CMB.1.raw
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctcctgcactggaaccaacagtgacgtcggtcgttttgaccgtgtctcctggtaccagcacgaccccagaaacncgacccccaaatcattattatgcggtcaatgttcgcccttcggtntccctgagcgcttctctgggtccaagtctggcaacgacggcctccctgaccatctcgtcgggcctccgaggctggacggaccgaggcctaggtactttattacgtgacagctacaattactaacgaaggtacggtaaacctaacttttaactagtttccgggcgtacgacgggaaccagcgtacggacccgttccgtaaggtccgacgacccgaacgggcctaccggccccctcggtaccaccttccg

SEQ ID NO: 220062 - DNA, 273 bp, Homo sapiens
  misc_feature: GYAE6OF02GQ1JG.44.71.G05.1.454.CMB.1.raw
  modified_base (269)..(273): a, c, t, g, unknown or other
  misc_feature (269)..(273): n is a, c, g, or t
tcagacagtatatacacgaccggtgctcgatttagtgtcgtcgcaagagagagggctcgtggatacagatatgacatgctctactccaatggtatggacgcctggggccaagggaccacggtcgccgtctcctcagcctccaccaagggcccatcggtcttccccctggcaccctcctccaagagcacctctgggggcacagcggccctgggctgcctggtcaaggctacttcctatatactgtctgagcggctggcaaggcgcatagnnnnn

SEQ ID NO: 220063 - DNA, 535 bp, Homo sapiens
  misc_feature: GYAE6OF02F48D6.44.71.G05.1.454.CMB.1.raw
tcagacagtatatacacgaccggtgctcgatttagtgtcgtcgcaagagagagggggggatctcaggaggcagctctctcggaatatctccaccatggcctgggctctgctcatcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaaccacgcccccaaaactcaattatttatgcggtcaatgttcgccctttccggtgtcccctgacgcgcttctctgggtccaagtctggcaacacgcctccctgaccatctctgggctccaggctgacggacgaggctgtattattactgcagtctacaatactaacaaggtaggaactacttttaactattcggcgcagggaccaagctcgaccgtccgtaggtcagcccaaggcctcgcccccgtggtcctaccg

SEQ ID NO: 220064 - DNA, 782 bp, Homo sapiens
  misc_feature: GYAE6OF02FH44T.44.71.G05.1.454.CMB.1.raw
  modified_base (189)..(189): a, c, t, g, unknown or other
  misc_feature (189)..(189): n is a, c, g, or t
  modified_base (240)..(240): a, c, t, g, unknown or other
  misc_feature (240)..(240): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctggctcagtctgccctgactcagcctgcctccgtgtctggttcnctggacagtcatccaccatctcctgcactgggtccagcaatgacattgganatactacctgtctctggtatacacacatccagacaaacgcccaactcattacttttagacgtccagtgacgcggccgtcgtacggttgtttacaattccgtactttcttacgtcggtaccttacccgtaaagttccgtacggtacctaaccgttaaccgacgggttacccttaccccgttacgggtacccctacgtttacccgtttacggaaactttccctacccgtaaacggtttccgttacgggtaacgggttaacgttcgggtaaccgggttaccgtttaacggttaaacgtttttaacccggttaacccgtttggggtttaaccgtacccgttaacgggtcccttaaaaggtttcgggggaaatttaccgggaaccggtaaccggggtaaccccggggtaaaccggggttcgggttccgggggttaccgggtttacccgggggaaccggggtaaaccggggttaccccgttaaacggggttttacccgggaacccccgggttttaccggttaacggggttaccccgtaaaccccgggg

SEQ ID NO: 220065 - DNA, 629 bp, Homo sapiens
  misc_feature: GYAE6OF02JDIXC.44.71.G05.1.454.CMB.1.raw
  modified_base (300)..(300): a, c, t, g, unknown or other
  misc_feature (300)..(300): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctctgcactgaaccacagtgacgtcgtcgttttgacgtgtctctggtaccagcacgaccccagaaacacgaccccaaaatcaattatttancgcggtacaattcgtcgtcccttccggtcgtccctgacgcgtcctttctcgtcgggtaccaacgtctggacaacgaccgtccctaccctcgaccacttcctccgtcgggtcctccacggtcgtacggacggaacgtacggtcttacggtatttaacgttacgcgtacgacgtcttacgattaacgtaaccgtaaggtagggaaaccttaacgttttacgtacgtttccggacgtaccgtaagggtaacccagtccgtacggaacccgttaccgtaaggtccgaacgacccgtaacggcctacccggaccccttcggtacctaccgtccg

SEQ ID NO: 220066 - DNA, 721 bp, Homo sapiens
  misc_feature: GYAE6OF02HR2XD.44.71.G05.1.454.CMB.1.raw
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctggctcagtctgccctggctcacgccctccctccgtgtccgggtctcctggacagtcagtccaccatctcctgcacgtggaaccacagtgacgtcggttcgtttgaccgtgtctccgtggtacctagccacgaccccaagaaaccacgacccccaaactcatttacttatgcgtactaatcgttaccgtcccgttcggtctcccgtgacgcgtccttctcgttcggtaccaagttccgtaggaccaacgaccggtccccttcccgtacggacccctagtcccgttaccgtcgggtcccttaccggacgggtccgttacgggacggtaacggacgggtccgttagtaagtttacgttacgtcggtacgtacgtaccttacgtaacttacgtaacgtaagggtacgggtaaaccttaccgttttaacttacgtttaccgggtacgaaccggtaacgggtaacccgtacgtacccggttaccggtaaccccggttaccggttacggtaccgaacccggtacccggtaacggtcccgttacccggtccccccgttacggttcccgtaccctttccccggg

SEQ ID NO: 220067 - DNA, 613 bp, Homo sapiens
  misc_feature: GYAE6OF02IAJYD.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcataggatcctgggctcagtctgccctggctcagcctccctcgtgtccggtctcctggacagtcagtcaccatcctcctgcactggaaccaacagtgacgtcggttcgtttgaccgtgtctctggtaccagcacgaccccagaacacgaccccaaatccaatttatttagcgtcggtctaatcgttccgtcccgttcggtcgtcccgtgacgcgtcttcgtcgtcgggtcctaagtctcggcaacgccgtccctcctacgactacttctcgtcggcctccgaggctaggacggacgagtcctaggtactttaactacgtgacgtatcctacaaattaacgtaaaagaacgacctaacgtacttagttaagttacgttaccggaggtaaccgggacctaacgtcgtacgtacccgtaccgtacggtaccacgacccgtacggcctcccggtcccccgttcggtaccctccgttacccg

SEQ ID NO: 220068 - DNA, 575 bp, Homo sapiens
  misc_feature: GYAE6OF02G4Q9D.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtccaccatcctcctgcactggaaccaacagtgacgtcggttcgttttgaccgtgtctcctggtaccagcacgaccccagaaaccacgacccccaaactcattatttatgcgtcaatcgttcgcccttccggtgtccctgagcgtcttctcgtcgggtccaagtctggacaacgccggccctccctgaccctactctcgtcgggcctccgaggctggacggacgaggctagtatttattactgcagtctacattataacgtaaggtaggaacttacgtttactagttccggcgacgacgggaccagccgtacgtaccgtccgtaggtccaacgacccgaacggcctccgcccccgtcggtacctacttcccg

SEQ ID NO: 220069 - DNA, 684 bp, Homo sapiens
  misc_feature: GYAE6OF02IGE30.44.71.G05.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctggctcagtctgccctggctcagcctccctcgtgtccgggtctcctggacagtcagtcaccatcncctgcactggaaccaacngtgacgtcggtcttttgaccgtgtctcctggtaccagcaacgaccccagaaacacgaccccaaactcaattatttatgcgtcaatcgttccgcccgtttaccgtctccctgacgtcgctttcctcgtcgggtccctaaggtccttagggacctaaaccgcccggtcccttacccgtacgaacccctaattcccgttacggttcgggccctaccgacggtacgtacggtacgggaaccggacggtcgttacgtaagtttaacgttaacgtcgacgtacgtactacgtaactaactaaccgtaaaggtacggtaaacttaccgtttaacttaaccgttccggacgtaccggtaacggtacccaagtaccgtaccgacccgttaacccgtagggtaccgacccgaccgtaacggtacctacccggtaccccccgttaggtcccctacctttaccccgg

SEQ ID NO: 220070 - DNA, 622 bp, Homo sapiens
  misc_feature: GYAE6OF02HQ8R7.44.71.G05.1.454.CMB.1.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctcctccgtgtccgggtctcctggacagtcagtcaccatctcctgcactgaaccaangtgacgtcgtcgtttgacgtgtctctggtaccagcacgaccccagaacncgacccccaaatcattattangcggtacaatcgtccgccttcggtntccctgacgcgcttcncgtggtcaagtctgcaacgcggcctcctgacctatctctcgggcctcgaggtctggacgacgagggtcctaggtactttactacgtgtcgtacgcgtactattaactacgaaggtcgggaaaccttacgtttaacgtaacgtttcgggacgtaccgtaagggtaaccctaaggtccgttaccgggaaccccggttaccgtaacggggtccctaaccgggtccccgtaaagggttcccgttacccggacccccccgtttacggggtaccctaccggttaccccgg

SEQ ID NO: 220071 - DNA, 533 bp, Homo sapiens
  misc_feature: GYAE6OF02GNNJD.44.71.G05.1.454.CMB.1.raw
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagacagtatatacacgaccggtgctcgatttagtgtcgtcgcaagagagaggggggggatctcaggaggcagctctctcggaatatctccaccatggcctgggctctgctcctcctcagcctcctcactcgagggcacagggtcctggggactgtctgccctgactcagcctgcctccgtgtctgggtcgcctggacagtcggtcaccatctcctgcactggagccagcggtaatattcttagtcttaactttgtctcctggtatcaacatcatccagtaaacgccccaaactcatcatctatgaggcctaataagacggccctacgagggtttctaatcgcttcactgcctcaagtccgacaacnccggcctcctgacatctctggctcaggcngaggacgagctgatttatactgcagctacattatacaaggtacggaaacttacgtttaactagttcggacgcgacggaccaagcctacggacccgttacgtaggtccacggcccgaaggccttcccgcccctccgg

SEQ ID NO: 220072 - DNA, 747 bp, Homo sapiens
  misc_feature: GYAE6OF02JG0AD.44.71.G05.1.454.CMB.1.raw
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatccgtgggctcagtctgccctgctcagcctccctccgtgtccggtctcctggacagtcagtcaccatcctcctgcactcggaaccaacagtcgacgtcggttcgtttgaccgtgtctccgtggtaccagcacgaccccaagaaaccacgaccccctaaactctaatttaactttacgtcgccggttactaaacgttcgtttcccgtcccgttccgggtacgttccccgtggtacgtccggtctttaccgtccgttcggggtacctaacgttcgttacggacctaaacgtacccgggtcccgttcccctacggaaccctacgtttccgtccggttcgggacctcccgaagggtccgttacggggaacggacgggaaccggtgtacggttaactttagttaccgtcgaccgtaagttcctaactaattaacgtaaacggttaaacggttaaccgggtaaaccttaaccgtttttaacgttaccgttacgggtaccgtaaccggacgggttaaacccgagtaccggtaccgtaacccggttacctaacggtaccgaccgacccggtacggccgttcccgtaccccggttcggtacccgtaccttcccgg

SEQ ID NO: 220073 - DNA, 646 bp, Homo sapiens
  misc_feature: GYAE6OF02FUUGO.44.71.G05.1.454.CMB.1.raw
  modified_base (387)..(387): a, c, t, g, unknown or other
  misc_feature (387)..(387): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaacacgcccccaaatcattattatgcgtacaatgttccgcccttcggtctccctgacgcgtcttctcgtcgggtccaagtctggcaacgccggcctccctgacctntctcgtgggcctccgaggctggacgacggaggctaggatttagttattggttcgtctcgtaagtacgttcggtttcgtaccgtactacttccttaacttttagttcgtttccgtttaacggggaacggtttcggggaacccgtaacgggttccccgtaacccgggttacccgttaacggggttcccaaccgggtacccccgtaaacgggtcccccctaaaaccccccgttagttacccggtaccctaaccgtttccccg

SEQ ID NO: 220074 - DNA, 720 bp, Homo sapiens
  misc_feature: GYAE6OF02JB5ID.44.71.G05.1.454.CMB.1.raw
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatcctcctgcactggaaccacngtgacgtcggtcgtttgaccgtgtctcctggtaccngcacgaccccagaaccncgaccccaactcatttattatgcggtcaattcgttccgcccgttcggtcgtcccctgacgcgtcctttctcgtcgggtaccaacggttcgtacggaccaaccgtaccgggtccctacccgtacgacccctatttcccgtcgtcggggtcctacccgtacgggccgtacgggaacgggaccgtacgggtccttacgtaacgttttaacgttacctacggtacctacggtcccttacctagtttaaacgtaaccgtaaggttacgggtaaacccttaacgttttaccgttaacgtttccgggaccgtacggaacggggtaaccctaacgtccgtaccgggtaacccgttaacccggttacgggtacccgaccggtacccgtaacgggtccctaccccggtaccccccggttaccgggttaccctaaccgtttccccgg

SEQ ID NO: 220075 - DNA, 721 bp, Homo sapiens
  misc_feature: GYAE6OF02F5YPY.44.71.G05.1.454.CMB.1.raw
  modified_base (322)..(322): a, c, t, g, unknown or other
  misc_feature (322)..(322): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagccctccctccgtcggtccgggtcctcctggacagtcagtcaccatctcctgccacgtcgaaccaacagtcgacgttcggttcgtttgaccgttgtcctccgtcggtaccacgcacgacccaagaaaccaccgaccccaactctaattattancgtacgtacaattcgttccgtcccttccggtcgttcccgtggactcgtccttctcgtcgggtccaacgttcgtcggaccaacgccggtccctcccgtacgacctactctcgtcggcctccgacggtctaggacgggacggacggtcgtaggtaactttacgttacgtgtacgtacgtcctaacgtaacttaaagtaaaccgtaagggtaacgggtttaaacccttaacgttttaaccgtaacggttaccggaccggtaaccggtaaccgggtaacccgaacgtaccgtacccgggtaacccgtttaaccggtaacggttaacccgaccggtaaccccggtaacggtccccgttaccccggtaccccccggttaccgggttaccctacccgtttcccccg

SEQ ID NO: 220076 - DNA, 795 bp, Homo sapiens
  misc_feature: GYAE6OF02FYM6B.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcacatctcctgcactggagccagcgtaatattcttagtcttaactttgtctcctgtatcaacatcatccagtaacgccccaaactcatcatctatgacggtcctaataacggacggccccttcgtaacgggggtttttacctaaacgttccggtacctttacctaaccgttccggtaccccttacccgaaacggttaccccgggaacctaaaacccgtacccggggtaccccttacccccgtacggtaaaccctaaaccgtttcccttacccggttcgggggtaccccttaccccggtaacggggtcccgttaggggaaaccggggtaacccgggtacggggtacctttaggttaaactttttaacgttttaaacgttttcggtttacggtcctttaccgaaggttacgtttcggttttaccgtccggtacctaagttacccttaacgttttagttcgttaccggtttaccggggtaaaggttaccggggtaaacccgttaacggttacccgtaaccccggtttaccgttaacgggttccgaaccggtaccccggtaaaccggtaccccctaaacccccgtacttacccgg

SEQ ID NO: 220077 - DNA, 673 bp, Homo sapiens
  misc_feature: GYAE6OF02ID0B3.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatcctcctgcactggcaccagcagtgactagttggttaggttaattaactttgtccttaccgtggtaacccaaccacccaaccctaggaccaaaaccgccccctaaattcaatctatttactgatgtactaagtagccgccctcgacgggtccagacgtcgtacttctcgtggctactaagtctcggacctacctcaacgtcccctccgcgaccatccgacgtcggcctccgacggtactaggaacgtagtaggtagggtattaacgtttacgttaaccgtgtaccgtaacgttacccgtaagtacggtaacgacgtaccgacgtacccgtacgttaagggttgggtttacggggttacgggtttcggggaacccggggttacgggaaacccggtaaggttcccgggttaccggtaaccggttacccggtacggggtaccgaacccggtacccggtaacccggg

SEQ ID NO: 220078 - DNA, 605 bp, Homo sapiens
  misc_feature: GYAE6OF02FOND5.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatcctcctgcactcggaaccaacgagtgaccgtcggttcgtttcgaccgtgtctcctggtaccagcagaccccagaaacacgccccaactcattattatgcggtcaatgtcgcccttcggtcgtcctgagctcttctctgggtaccagtctggacaacacggcctccctgacctactctacgtggtctccgaggctaggaggacggaggtcgtagaactttacttacgtgacgagctcaatactaacgaagttagggaaaccttacgtttaacttacgttccggacgtacgaaccgggaccaacgtacgtacggtaacccggtaccgttaacggtaccgaaccggcccgaacggtccttacccggtccccccggttcggtaccctaccgttccccg

SEQ ID NO: 220079 - DNA, 730 bp, Homo sapiens
  misc_feature: GYAE6OF02JHSIM.44.71.G05.1.454.CMB.1.raw
tcagacagtatatacacgaccggtgctcgatttagtgtcgtcgcaagagagaggggggggatctcaggaggcagctctctcggaatatctccaccatcggcctgggctctgctcctcctcaccctcctcactcgacgggcacaggatccgtgggctcacgtctcgcctggctcacgcctcctcgtcgtccggtctcctggacagtcacgtccacctatcctcctcgaccacgtaacggaaccaaacgacgtcgtaccggttcggttcgttttacggaccggttcgttccgtccggtacggtaccacgtaccgaaccgaaccccaacggtaaaccgaccgaaccccctaaactactaacgttttacttacgcgtaccgttactaacgttccggttaccctcccggtttccggttaccgtcccgtcggtacggtccttccttccggttacggtacgggttacctaacggttcgacgtaccgaaccggtcccgtacccgttcccgacgtaccgtactccgttacggtcggacctacggcgcgtacggaacggcggtagtacgttagtacgttacttcgagtactcgactacaagtactaaacgtacggtacgtaactttacgttactcgtacgacgacgtaacggtaccaggttaccgtaccggtaccgttaacggacgttacgaccggtaccgacggtccgtacccgtcccggtacgtaccgtcgttacccg

SEQ ID NO: 220080 - DNA, 755 bp, Homo sapiens
  misc_feature: GYAE6OF02JALDU.44.71.G05.1.454.CMB.1.raw
  modified_base (185)..(185): a, c, t, g, unknown or other
  misc_feature (185)..(185): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctcctcactcgagggccacgaggtactccgttcgggcttcgcgtcttcggccctggtcctcncggccctcccgttccgtcggttccgggtcttccgtcggtactgtcgtacgtccaacgtctcctcctgacacgtcggaaaccacgtcgtacgtccgttcggttcgtttcgaccgttcgtctaccgtacggtaccacgtacgtaccgtaacccgtaaggaaaccacccggacccctaaaacgtccgtaattttacgttatacggtacggttaactaacgttcggttcccgtcccgtttcgggtccgttccctaggacgtaccttccgttcgttacgtcgggtaaccaacgttcgtacggacctaaccgtccgtcctaccgtccggaacctcgtcctacgtcggtactccgtacggaccgtcggtaacgacggagtcgtacgtattacgtacgtcgacgtacgtcgtacaacttacgtaacgtaaggtacggtaaaccttacgtttaacgttccgtaccgaacgttacgaacgggtaactacggtaccgtaccgggacccttacgggtaccgtaacccgtaccggaaccgtaacggttcctacccgggtacccgttccggtacccttaccggg

SEQ ID NO: 220081 - DNA, 635 bp, Homo sapiens
  misc_feature: GYAE6OF02IPA0O.44.71.G05.1.454.CMB.1.raw
  modified_base (127)..(127): a, c, t, g, unknown or other
  misc_feature (127)..(127): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (463)..(463): a, c, t, g, unknown or other
  misc_feature (463)..(463): n is a, c, g, or t
tcagacagtatatacacgaccggtgctcgatttagtgtcgtcgcaagagagagggggggatctcaggaggcagctctctcggaatatctaccaccatggcctgggctctgctcctcctcaccctctnactcaggcacaggatcctggctcagtctgccctggctcagcctccctcgtgtccggtctccgtggacagtcagtcaccatctcgtagcactggaaccacagtcgacgtcggttcgtttgacgttgtctcctgtaccagcacgacccagaaacncgaccccaatctattattangcgtacaattcgtcgtcccgttccggtctcccgtgacgtcgtcttctcgtcggtaccagtcgtggacctaacgcggtccctaccgtacgaacctgtttcctcggtcggtccctaccggacggtcgtacggacggtacggacgtctaaggtactttaagtacgngtaccgacgtcctacgtaattacgaaacgtacggttaacggtaacctttacgttaacgttcgttaccggcgttaacgacggtaaccacgtcgttaccggtaccgttaccgtaacggtccgaaccgaccgtaacggtccgtaccccgtaccccggtcgttacccacttcccgg

SEQ ID NO: 220082 - DNA, 659 bp, Homo sapiens
  misc_feature: GYAE6OF02HVS02.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccgggtctcctggaccagtcacgtcacctatcctcctgactacgtcgaaccaacgtgtagtacggttcggttcgttttacgaccgttgtccttaccgttcggaccgtagacctacgaccccaagtaaaccaccgtaccccaaatctaattatttacgcggtacggtactaactcggttaccgtcccgtttcggtacgtcccgtagacgtccgtacttcgtcggtcggtacctagtcgtacggtacaaccgtcgtaccctccgtacgaccctatcctcggtcggtcctaccggtaacggcgtacgggacggacggtaacggtctagtactttaacttacgtcgacgacgtcttaacgataaagtaaacgtaacgactaactagttagtattaccgggtagcgggtagaccagtactcggaaccgttcgtaggacacggtaccacggtcctcccggtacccgttcgacctacgttcccg

SEQ ID NO: 220083 - DNA, 756 bp, Homo sapiens
  misc_feature: GYAE6OF02HPUGI.44.71.G05.1.454.CMB.1.raw
  modified_base (202)..(202): a, c, t, g, unknown or other
  misc_feature (202)..(202): n is a, c, g, or t
  modified_base (276)..(276): a, c, t, g, unknown or other
  misc_feature (276)..(276): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcaacaggatccgtgggctcagtctcgccctggctcagcctccctccgtgtccggtctccgtggacngtcagtcaccatctcctgcacgtacggaaccaacagtgacgtcggttcgtttcgccgttgtctccgtcggtacngccacgaaccccaagaaaccacgacccccaaactctaacttttaattactcggacgtactaacgttccggtttaccgccccggtttccggtccgtacccgttaggccgtccggttccttccgttaccggtcgggtacctaacggttcgtacgggaaccaaccggtacccggtcccttaccccgtacggaccctactttccgtaccggtcggacccgttacgacgggtcgtagggaccgggaggacggtcgtagtaacgttactacgtacgctacgctaactaattaaagtaaaacgaacgaacctaaagttacgttaggtttaacgttacggttaaccgggagggtaaccggtaacgtaacggtaaccgttaccgggtaacccgttaccggttaacgggtaccgttaaccgggaacccgttaacgggtccccgtaccccggtttacccccgtaccgggtttacccgtacccgtttcccgg

SEQ ID NO: 220084 - DNA, 729 bp, Homo sapiens
  misc_feature: GYAE6OF02JQUAE.44.71.G05.1.454.CMB.1.raw
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
  modified_base (478)..(478): a, c, t, g, unknown or other
  misc_feature (478)..(478): n is a, c, g, or t
  modified_base (539)..(539): a, c, t, g, unknown or other
  misc_feature (539)..(539): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctcctcactcagggcacaggacttccgtgggcctcacggtctgcccgtggcctcgacgccctccctccggttggtcccgggtcttcccgtagggacagttccaggtccacctatccgttcctagcctaactacgggaacccaacgagtacggtaccgtcggttccgttttagaccgtcgttcctcgtacggttaccgaacggccacgaccccaaggaaaccnccggaccccaaatcctatttattactcggtacgtacaacgttcgtacctcccgttaccggttcgtccctgacgtcnccttcgtacgtgtcctaagtctacggccaacgcgtccctccgtacgacctcgtaccngtccgggcctcgtacggctaggaacggtacgaggtctaggtacttaatacgtcgacgtacncgtaactagtaactacgaacggttacgtaaacgttctttacgtaacgttaccggtacgtaaccgggaacggtaccggttaacgaccggttaacccggtacccggtaggttaacccggttacgaacccggttacccgaacgggttccccggttccggtaacccccggtttccgggaaaccgtttaccccgg

SEQ ID NO: 220085 - DNA, 641 bp, Homo sapiens
  misc_feature: GYAE6OF02GAPHW.44.71.G05.1.454.CMB.1.raw
tcagacagtatatacacgaccggtgctcgatttagtgtcgtcgcaagagagagggggtgggatctcaggaggcagctctctcggaatatctccaccatggcctgggctctgctcctcctcaccctcctcactcagggcacaggatcctgggctcagtctgccctggctcacgccctccctccgtgtccgggtctcctggacagtcagtcaccatcctcctgcactacggaaccaacagtcgacgttcggttcgttttcgaccgtgtctccgtcggtaccagccacgaccccaagaaaccaccgacccccaaactactaattatttacgtcgtacggtactaagttcgttaccgtcccgtttaccggtcgtccctgacgtccgtcttactcgttcgggtactaacgttcgtacggaccaaccgtccgtcccttccgacgtaaccctacgtccgttcggtacggtcctaccgtacggtcgtacggaacgggtacgaggtctagtattactacgtacgcacgtctacatactaacgagtacgtaactacgtttacagtccgacgtacgaggaccgacgtccgtacgaccgtacgtacggtaccgacgacccgacggtcccgtccgtccccgtagaccctacccg

SEQ ID NO: 220086 - DNA, 682 bp, Homo sapiens
  misc_feature: GYAE6OF02JYICT.44.71.G05.1.454.CMB.1.raw
  modified_base (237)..(237): a, c, t, g, unknown or other
  misc_feature (237)..(237): n is a, c, g, or t
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
  modified_base (555)..(555): a, c, t, g, unknown or other
  misc_feature (555)..(555): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcacctcagggcacaggactcctgggctcagtctgccctggctcagcctccctccgtgtccgggtctcctggacagtcagtccaccatcctcctgccacgtggaaccaacngtcgacgtcgtcgtttgaccgtgtctcctggtaccngtccacgaccccagtaaccacggacccccaaacgtccaacttattacncgtccggtacaagttcgttaccgtccccgttaccggtcgttccccgtagcgtccgtaccttctccgtcgggtaccaacggttcgtaggccaaacgtccggtcccttcccgtacggtaccacgtttcctcgtcggggtcctaccgacggtctaacggcgggtaccgacggtctcgaacgttcttacgtcgcaaggtcctactaataaacgtaaaggaactactaaacgacgtttntaaatcggttacgaacgggtaagaccgacgtcgtaccgggtaaccgtaccgttaacgggtacgaacccgtacccggaacggtccggtaccccgtaccccggttcgggtacccaacccgtttccccgg

SEQ ID NO: 220087 - DNA, 1032 bp, Homo sapiens
  misc_feature: GYAE6OF02ILFIK.44.71.G05.1.454.CMB.1.raw
  modified_base (167)..(167): a, c, t, g, unknown or other
  misc_feature (167)..(167): n is a, c, g, or t
  modified_base (192)..(192): a, c, t, g, unknown or other
  misc_feature (192)..(192): n is a, c, g, or t
tcagacagtatatacacgaccggtgctcgatttagtgtcgtcgcaagagagagggggggatctcaggaggcagctctctcggaatatctccaccatggcctgggctctgctcctctcaccctctcactcagggcacaggatccgtggaccagtctagccctgacctnagcctgcctcgtgtacgtgggtccnccgtaggactaggtccggtcaccgtaagttcctccgtggtaccacgttagggaaaccgtccccgtaaagggtaccgggtttaaattaccgttttaccgttaaacggttaccgtttttaaaaacctttttcggttacccgtttaccccggtttacggggtttaaaccttacccggtaaaaaaccgtactttaaacccgtaaccggtttaaccccggtaaaaacggggtttaaaaacccccgtaaccccccccgttaaaaaacgttccccttaaagttaccccgttaaactttacccggtttaaagttaccgggtaaaccgggttacccttaaaaacggtaaacggtaacccgggttaccccggttaacggttaacgggggttttaaccttaaacgttccggttaccgttttaccgaaccgtttccgtaaaccccgttccgttaaacgggtcccgggtaaaccctaaacggtaccccggtaccctttaacccgacgttaaccgttaaactttccggtacccgtacgggtaccccgttacggaaacggttcccggtagggtaaacccggtcgggtaaccgttacggttaacgtttaacgtttaacggtttttaacgttcgggttacctaacggttaacgttacgggttaacgtttccggtttaaccggttaagtcccgtttaaaccgtttacgtttaaaccgtttaacgtcggttttaacccggtacgggttaaacggttcgggtaaaacccgttcggtaacccgttacccggttaccggttaacggtcccgtaaccggtaacccgttaacccggtacccctaaccggtaccgtttaacccgg

SEQ ID NO: 220088 - DNA, 667 bp, Homo sapiens
  misc_feature: GYAE6OF02GRNEO.44.71.G05.1.454.CMB.1.raw
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcaggcacaggatccgtggctcagtctgccctgctcagcctccctccgtgtccggtctcctggacagtcagtcaccatcctcctgactacgtacgaaaccaacgtagtcgaaccgttcggttcgttttcgaccgtgttcctcgtcggtaccagcaacgaccccaagaaaccaccgaccccaaactcaattaattcgngtacgtanaatcgttccgtacccgttcggtcgtcctgtacgtccgtcttctcgtcggtacctaagtcgtcggaccaacgtaccggtccctaccgtacgaacctcgtacgtcgtcggtcctaccgtacggcctaggacggaacgcggacgtagtacgtttaacgttacgtcgacgtacgtcctactaacgttaactaacgtaacggtacgtaaacttaccgttttaactacgtttacggaccgtaacggtacggaaccgtacgacgtacgtacccgttaccgtacggtaccaccgtaccgaacggtccgtacccgtccccgtacgttacccgacttcccgg

SEQ ID NO: 220089 - DNA, 692 bp, Homo sapiens
  misc_feature: GYAE6OF02FT65N.44.71.G05.1.454.CMB.1.raw
  modified_base (314)..(314): a, c, t, g, unknown or other
  misc_feature (314)..(314): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctcctcactcagggcacaggatcctgggctcagtctgccctggctcagcctccctccgtgtccggtctccgtggacagtcagtccaccatcctcctgcactggaaccacagtcgacgtcggttcgtttgacgtgtctccgtggtaccagcacgaccccaagaaaccacgaccccaaactcaattactttancgtacggtacaattcgttccgtcccgtttccggtcgtcccgtgagccgtactttcgtcgttcgggtaccctaaggtctaggaccaaaccgaccggtcccctacccgttcgaccctattccgtaccgtcgggcccttccgaggtcctgggtacgggaacggacggacgttagtacgtttaacttctacgtacgtacgtctactactaacgtaacgtaacgggttaggtaaaccttaacgttttaccttaacgttccggtacgaccgtagggtaaccctaaggacccgttcggtaacccggttacccgtaacgggtaccgaaccggtcccgaaacgggtccgttaccccggccccccgtttacgggtacccttaccccgg

SEQ ID NO: 220090 - DNA, 723 bp, Homo sapiens
  misc_feature: GYAE6OF02FKUPG.44.71.G05.1.454.CMB.1.raw
tcagacagtatatacacgaccggtgctcgatttagtgtcgtcgcaagagagaggggggtgggatctcaggaggcagctctctcggaatatctccaccatggcctgggctctgctcctcctcaccctcctcactcagggcacaggatcctgggctcagtctgccctggctcagcctccctccgtttccgggtctcctggacagtcagtcaccatctcctgcactggaaccacagtgacgtcggttcgtttgaccgtgtctcgtcggtaccagccacgaccccagaaacaccgacccccaaactctaattattatcggcgtacaattcgttccgtcccgttccggtcgtcccgtgacgtcgtcttcctcgtcgggtaccaagttcgtacggacaaccgtaccggtcccttcccgtacgaccctacgttccgtccggtcgggtcccgtacccgtacgggtaccggtacgggtaaccggggaaccggtacgggttaccttagggtaaaccttttaacgtttacccgtggtaccgtaccggtccttacgaactttaaacgttaaaccggtaaacgggttacgggtaaacctttaaccgttttaacgttacggtttaccgggccgtaacgaacggggtaaccacggcgtaccggtacccgtaccggtacggtaccgaaccgtaccgtaacggtccttcccggtaccccggtccggtactacccgttccg

SEQ ID NO: 220091 - DNA, 709 bp, Homo sapiens
  misc_feature: GYAE6OF02HM86D.44.71.G05.1.454.CMB.1.raw
  modified_base (235)..(235): a, c, t, g, unknown or other
  misc_feature (235)..(235): n is a, c, g, or t
tcagacagtatatacacgaccggtgctcgatttagtgtcgtcgcaagagagaggggggggatctcaggaggcagctctctcggaatatctccaccatggcctgggctctgctcctcctccacctcctcactcagggcacaggatccgtgggctcagtctgccctggctcacgccctcccgtcgtcgtccgggtctccgtggacagtcagtcacatctctgcactaggaaccaagngtcgacgtcgggttcgttttcggaccgttggtacctccgtcggtaccagccgtaacgaccccaagaaactccgaaccccaaaatcgtaattattagcgtacgtctaagtcgtaccgtccttcggtacgttcctagcgtaccgtctttcgtccgttacggtacctaaaggttccgttggaccctaaacggtccccggtcccttcccgtacgtaaccctagttccgtaccgtcggtaccctaccggacggtcgtacggaggtaccgacgggtctaggtacttaacggttactaggacagtactacgtaactacgtaaacggtaaggtacgggtaaactaccgttttacgtaacgttccggacgtaccgtaacggggaacctacgaccgtacggttaaccggaccctttaggaccgaccggtaacccgtaacgggtccctacccggtacccccggtcggtaccctaccgttacccgg

SEQ ID NO: 220092 - DNA, 726 bp, Homo sapiens
  misc_feature: GYAE6OF02HS5BP.44.71.G05.1.454.CMB.1.raw
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatccgtgggctcagtctgccctggctcagcctcctcgtgtccggtctcctggacagtcagtcaccatctcctgcactggaaccaacagtgacgttcggttcgttttgaccgttgtctctggtaccagcacgacccaagaaaccaccgaccccaaactctaatttatttacgtcggacggtactaagttcgttaccgtcccgtttacggtcgttcccctgacgtccgttcttccgtccggttacgggtacctaacggttccgtacgggacctaaacgtacccggtccccttacccgttacggacccttaagttcccgttacggtcgggtacccttccgaacgggtctagggacggtacggacgtctaggtatttaacgttcngactacgtactanaaacgttaaagaaaacggacgaacctaaaccgtactttaaggttaaccttacggttacggggaccgggtaacggaaccgaacgtccgtaaccggtaacccggtttaccgtacgggtaccgaacccggtacccggtaacggttcccgtaccccggttacccccgttggttaccccttacccggtttcccgg

SEQ ID NO: 220093 - DNA, 798 bp, Homo sapiens
  misc_feature: GYAE6OF02GW09E.44.71.G05.1.454.CMB.1.raw
  modified_base (289)..(289): a, c, t, g, unknown or other
  misc_feature (289)..(289): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcgagggcacaggatcctgggctcagtctcgtccctggctcagtccctcctcgtgtccggtctccgtggacctagtcacgtccacactcctcctgccactacggaaccaacgtgtcgacggttcggttcgttttcgaccgttgtcctcgtacggtaccncgaccacgaccccaagaaaccacccgaacccctaaacttctaattttactttagtcggtaccggtactaacgttcggttacccgtcccgttacggttccgttcccgtaggtaccgtccgttccgtttaccgttccgggtttaccggtaccctaacggttccgttacgggacctaaacccgggtcccgtaccctcccgtacgaaccctacgttaccgtccggtccggtcccgtccggacggtcggtagggaaccggtacggtacgggtacgttaggttacgtttaacttacgtacgtacgtacgtccgttatacgttaacgtaacggttaacggttacgggtaaacctttaacgtttacgttacgttaccggtaccggtaacggtaccggtaaccgtacgttccggtaccggttaacccggtaacggtaaccggtaccgaacccgggtaccgtaccgggtcccgttacccccggtaccccggttcgttaccccgtaccgtttcccccggg

SEQ ID NO: 220094 - DNA, 1067 bp, Homo sapiens
  misc_feature: GYAE6OF02HTR1I.44.71.G05.1.454.CMB.1.raw
  modified_base (221)..(221): a, c, t, g, unknown or other
  misc_feature (221)..(221): n is a, c, g, or t
tcagacagtatatacacgaccggtgctcgatttagtgtcgtcgcaagagagagggggggggatctcaggaggcagctctctcggaatatctccaccatggcctgggctctactcctcctcagcctcctcactcgagggcacagggtcctggggactgtcctaccctgactcacgccgcctcagtcgtccgggactccgtggtcagtcgtcaccatcttctnttctcagcgactacttccactcggtaccctttaaagtcctactactctagttacggtacgacgtaagggtccgggtccccggggtccgaaccccgacccccgtaaaacgttccctttaccgtttttaaccggtaaccggtttcccgttttcggtaccgggttaccgtttcgggtactaccggttcccgttaccgggtttccccggttttttccgggcccctttaccgttacggtttcccgttacgtaaccccgtaacccggtcccgggtaccccttaccccggttacggtaaacccctaccgttaccccgaaaaaccccttaaaacccgggtccccgggtaccccttacggggaaacgggttaaaccggttggtaaaccgggtccggttaacgtttaacccggtttttaacgttttttcggtttacggtacggttaccgttaacgtttaaccgtttttaccggttaaaccttttacctaaaacccgttaaccttaaaaaagtttccgtttacgtttttacccggttttaaacggggtaaaccggggtttaccggggtaacccccggggttaacgttcccgtaaacgggttacccggtttacccgtttccgggtaacccggtttaaaccgtaaccccgggttaaaccccccggaaacccggggttaaaccccccctaaaaacccccccggttcggtttaccccgggtttaaaacccttaaccccccggttttacggttttcccccccgtttaaacccccccccggtttaacccctttttaccccccggttttaaactttaaaaaccccccgggttttactttaaacccccgggggtttttaccccgg

SEQ ID NO: 220095 - DNA, 689 bp, Homo sapiens
  misc_feature: GYAE6OF02GA4WL.44.71.G05.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatccgtgggctcagtctgccctggctcagcctcctccgtgtccggtctcctgacngtcagtcaccatctcctgcactcggaaccaanagtgacgtcggtcgtttgaccgtgtcctccgtaggtaccngccacgaccccagaaacaccgaccccaactcaatttactttatacgtcggtactaacgtgttacccgtccgttcggtcgttcccgtgacgtcgtccttcgttacgtggtacctaacgtcncgtacaacgtacccggccttccgcgtacctacttcgtcgcggtcctcggtagcggtagacggacgtcggtcgtacgtaattcttacgtcgactacgtcgtactaacgttacgttaaacgaacggttacggtaacccgtttaacgtttaccgttaacgttaccggacggtaccgggtaacgggtaacccgaggttacccgtacccgggtaaccggttcccgttaaacgggttccccaaccggaacccgttacggaccccggttcccgtaccccccgtcgttacccgtcccgttttacccgg

SEQ ID NO: 220096 - DNA, 624 bp, Homo sapiens
  misc_feature: GYAE6OF02GYN2L.44.71.G05.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (417)..(417): a, c, t, g, unknown or other
  misc_feature (417)..(417): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggcctcagtctgccctggctcagccctccctcgtgtccggtctcctggacagtcagtcaccntctcngcactgaaccanagtnacagttggtagttataactntgtctctgtaccaacaaccnccagacaaacgcccccaaactcatcgaacttcgaatgtactgtacaagtaactccggcccttggtagggtttctcggtctcctttctcgtcggtctccgtaacggttctcggacctaaccgtccggtccccttccgtacgaaccctnttccgttcggtcgggccttacccgaggtccgtaggacggacgtacggtctaacgtacttactacgtcgacctagcctacgtaataaagaaaacgagtaaccaacgttaccttagttaactaccggttacggacggtacggaactaccggtacgtaccgaccgttcgtaacgccgtaacggcccgtaaggtcccgacccgtcccccgg

SEQ ID NO: 220097 - DNA, 641 bp, Homo sapiens
  misc_feature: GYAE6OF02FM3QA.44.71.G05.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
tcagacagtatatacacgaccggtgctcgatttagtgtcgtcgcaagagagagggggtgggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccattccncctgccactgaaccaacgngtcgacgttcggttcgttttgaccgtgtctcctgtaccagcacgaccccaagaaacncgaccccaaatctattatttangcggtactaattcgttccgtcccttcggtctccgtgcgcgtcttctcgtcgggtaccagtcgtcggacctaacgaccgtcctacccgtacgaacctactacgttcgacgggtacctcgacgggtctagggacggtacgacggtcctagttactttactacgtcgaccacgtacttacaacttaaagtaaaacgcgtaaccgtaacttacgtttaacgttactacggttaccgggacgggacggtaaccgagtaccggtacgacccggttcgtacggtaccgaccgtaccggtaacggttccgccgtaccccgtaggtactacccgg

SEQ ID NO: 220098 - DNA, 738 bp, Homo sapiens
  misc_feature: GYAE6OF02GNS6I.44.71.G05.1.454.CMB.1.raw
  modified_base (257)..(257): a, c, t, g, unknown or other
  misc_feature (257)..(257): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctcctgcactcggaaaccaacagtcgacgtcggttcgtttcgaccgtntcctctggtaccagtcacgaccccaagaaacacgaccccaaactctaattacttatgcgtactaattcgttccgtccgttccgtcgtccctgacgtcgcttcctcgtcggtacctagtctacggactaaactaccggccctacccgtgaacctaacttctaccggtcgggtacctccggtaagccgtacggtaacggaccgaacggtccgtaggttaaactttaacgtttaatttcggtttacgtaccgttaccgaagttaacgtttcggttttccggtaccgttacgaaccgtttccgttaaacgttttagttaccggtttaccggtttaacggggttaacggttaaccggggtaaccgttaaacggggttaaccggtaacccccggtttaccgttaagggttaccccgaaacgggttccccgtaaacggaccccccgtaaaaccctaccggttaccgttaccgtacccgtttaccccgg

SEQ ID NO: 220099 - DNA, 709 bp, Homo sapiens
  misc_feature: GYAE6OF02F2J2H.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatccgtgggctcagtctgccctggctcacgcctccctcgtcgtccggtctccgtggactagtcagtcaccatcctcctgcctacgtacggaaaccaacgtagtcgacgttcggttcgttttcgtacctggggggtcctccgtcgtaccgagctacgacccaagaaacgaccgaccccaactacattacttacgtacgtcgtactaatcgtccgtccgttaccgtcgtcctgacgtcgtcttcgtcgtcggtactaacgtcgtacgaccgaacgaccggtcctacccgtcgtaacctacttccgttacggtacggttccgtaccgtacgggtccgtaaggtaccgggacggtaacggtccgttaggtaacgttatttaaccggtgtaccgtacgtaccgtactaacgtaacgtaacgtaaacggtacggtaaaccgttactttaacgttacgttaccggtacgtacgtaacggaaccgtacgtacgtacggtaaccgtaaccgtacgttacccgacgtaacccgtacgccgtacccggtacccgtccggttacgtcccgtttaccccg

SEQ ID NO: 220100 - DNA, 796 bp, Homo sapiens
  misc_feature: GYAE6OF02HBEFH.44.71.G05.1.454.CMB.1.raw
  modified_base (153)..(153): a, c, t, g, unknown or other
  misc_feature (153)..(153): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagacagtatatacacgaccggtgctcgatttagtgtcgtcgcaagagagagggggtgggatctcaggaggcagctctctcggaatatctccaccatcggcctgggctctgctcctcctcaccctcctcactcgagggcacgaggactccgnggctcagtctcgccctggtacctcgacgtccctcccgtccggtcggttccgggtcctccgtggacngtcngtaccactacgttcctcctgactacgtacggaaacctaacgacggtacggtacggttacggtttcggtttccggaccgttcgttacccgttaccgtaccgggtaaccacggtaccaacccggaaccccgtaaacgtaaaccaccccgtaacccccgtaaacttacttaagtttaacttacggtacggtaccggtacttaacgttccggttaccccttccggttccggttacccgtccgtacggaccgtcgtaccttcggttaccgtcgggttaacctaccgttcggtacggtaacctaccggtaaccgttcccaccggtaccgtacctctccgtacgtccggtacctaccggtacggtcgtaacggtcgggacggtacggtgttaacggttaacttaccggttcgacgtcgtaactacgtaacgtacgtaaaccgtaacggtaaccggttacgaactttaccgtttaacgtaccggttcggaccgtaaggtaccgaacgtagtcccgtaggtaccggtaccgtaacgtccgtaccgaacgtacccgacccaccgtaccgtcgtaccgttcccg

SEQ ID NO: 220101 - DNA, 698 bp, Homo sapiens
  misc_feature: GYAE6OF02GUVPG.44.71.G05.1.454.CMB.1.raw
  modified_base (199)..(199): a, c, t, g, unknown or other
  misc_feature (199)..(199): n is a, c, g, or t
tcagacagtatatacacgaccggtgctcgatttagtgtcgtcgcaagagagagggggggggatctcaggaggcagctctctcggaatatctccaccatggcctgggctctgctcctcctcaccctcctcactcagggcacaggatcctgggctcagtctgccctggctcagcctccctcgtgtccgggtctcctggacngtcagtcaccatcctcctgcacgtcggaaccaacagtgacgtcggttcgtttcgacgtgtcctccgtgacagcacgaccccagaacacgaccccaactctacttattatgcggtacaattgttaccgccttccggtctaccctgcgcgtcttctcgtcgggtacctaagtctcggactaaccgaccggtcccttcccgtacgaccctacgtttacctccggttcgggaccctacccggagggtcccgttagggaacggaacgggtacgggtacgttaggtaaacttttacggtttaaccgtcggtacctaccggttaccctaccgtaaactttaaccgaacgtaaacggggttacgggtaaaccttaaccgtttttactaacgggttacccgcggtaacggtaacggaccaggtcccgtacggtaaccccgttacgacgggttaccacggtacccgaacggtcccgtccccgtcccccggtcgtaccgacctttcccgg

SEQ ID NO: 220102 - DNA, 788 bp, Homo sapiens
  misc_feature: GYAE6OF02GZ62J.44.71.G05.1.454.CMB.1.raw
  modified_base (149)..(149): a, c, t, g, unknown or other
  misc_feature (149)..(149): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
tcagacagtatatacacgaccggtgctcgatttagtgtcgtcgcaagagagagggggggatctcaggaggcagctctctcggaatatctccaccatggcctgggctctgctcctcctcaccctcctacactcgaggcacgaggatccgngggctcagtctcgccctagactcacgccctcctcgccgtccggtctcttggaccagtcngtccacgtatcctcctgctacncggacacctagctaaggcacgtagttcggttagttagttaacgtttcgttccgttaccgttacggtaacccaacctacccgaacccgtacggaaccaaaacccgtaccccctaaaatttaccgaacttaccgtaacttttacgacgtaacgttcgtaaccgtaacggtaaacggtccggtaccccctccgggtaaccgggttccccgtaggtacccgttcctttaccgttccgttccgttcggtaccgttaccgtaaggttaccggacggtaaccgtacccgtaacccggtcccgtttcccgtacgttaccccggtacgttcggtcggtcccttaccggacgtcgtacgtaacggtagtcggacggttacgacgtcgtttacgtccgttacgacccttcgtacacggttacgtcgaccggtacgtaccgttacgtttacgttaccgtgttacccggttaggtaaacccgttcgggaaacccgtttacggtcccgttacccggttaccgtaacgttacccggacccggtaacccgtaaaccgggccccttaacccggtc

SEQ ID NO: 220103 - DNA, 684 bp, Homo sapiens
  misc_feature: GYAE6OF02GEPKM.44.71.G05.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (443)..(443): a, c, t, g, unknown or other
  misc_feature (443)..(443): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccgggtctcctggacngtccagtccaccatcctcctgcactcggaaccacagtcgacgtcggtcgtttgaccgttgtcctccgtgtaccagtccacgaccccagaacncgtaccccaactcattattancgtcgtacaagtcgttccgccgtttcggctccgtgacgtcgtcttctcgtcgggtctagtcgtaggaacctccggtccctcctacgacctacgttccacggtcggccctcggacgtcgtaggacggtaccgnggtacgtgttaacttacgttaccgtgaccgtacgtccttacgtaataacgttaacgtaaggtaccggtaaacctttacctttaaccgttaccggttccgggaccgtacggtaaaccgggacctaaggtacccgttacggtaccccgtaccggttaacggttcccgaaccggttaccccggtaacggtccccgttacccgacccccggttacgtaccccgttaccgttccgtttaccccccg

SEQ ID NO: 220104 - DNA, 682 bp, Homo sapiens
  misc_feature: GYAE6OF02IR77R.44.71.G05.1.454.CMB.1.raw
tcagacagtatatacacgaccggtgctcgatttagtgtcgtcgcaagagagaggggggggatctcaggaggcagctctctcggaatatctccaccatggcctgggctctgctcctcctcaccctcctcactcgacgggcaacgaggactccgtgggctcacgttctcgccccgtggtctacacggtccctccccgtcgttcggtccggtcctccgtggactgtcacgtccactactcctcctgctactacggaaccacgtagtacgacggttccggttcgtttacggaccgttgttcctcccgtacggtaccgaagcctaaccgccccgaaagaaaccgtaccgaccccctaaactgtactttaagttgtacgacgtactaacgttcgtaccgtcccttccggtctcctgaccgtctcttcgtggtccggtacctagtcgtacgcgtaccgacgcccttcacggcctagctcgtcgcctccgagtcgtagacgggagtacggctttagactttacgtcgtcgtacctagtacccacgttaattaccgtaacgtacgggttaaccgaacctttacgtttaacgtacgtcccggacgacgtaaccggtactacgccgtaacgtccggtaccgtaacgcgtaacctaccgggacttcccgtaccgtcccgttcgacctcgtcccg

SEQ ID NO: 220105 - DNA, 731 bp, Homo sapiens
  misc_feature: GYAE6OF02JXO98.44.71.G05.1.454.CMB.1.raw
  modified_base (277)..(277): a, c, t, g, unknown or other
  misc_feature (277)..(277): n is a, c, g, or t
tcagacagtatatacacgaccggtgctcgatttagtgtcgtcgcaagagagaggggggggatctcaggaggcagctctctcggaatatctccaccatggcctgggctctgctcctcctcaccctcctcactcgagggcacaggactccgtgggctcagtctgccctggctcagccctccctccgtgtccggtctcctggacagtcagtccaccatcctcctagcactacggaaccaacagtgacgttcgttcgtttagccgtgtcctcgtggtaccngcacgaccccagaaaccacgaccccctaaactctaattactttagacggtacggttacaagttcggtttaccgtaccccgttttcccgggtcgttccccgtaggacgtcccggttacctttccgttacccgggttacgggtaccctaacggttccgtcgggtaccctaaacggtacccgtccccgtttaccccgacggtaacccctacgttccgttccgtccgggtccttacccggacggtccgttacggacgggtaccgaacgggtcctagtacgttacttacgtcgacgtacgtctacgtaacttagtacgtacggtaggaaccttacgtttaccgtagttaccggctaccgaacgggtacctacggtaccgttacggaacccggtttacctacgggtaaccaccgtacccgacggtcgtccccgtaccccggtcggtaccctaccgttccg

SEQ ID NO: 220106 - DNA, 709 bp, Homo sapiens
  misc_feature: GYAE6OF02INKZL.44.71.G05.1.454.CMB.1.raw
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (342)..(342): a, c, t, g, unknown or other
  misc_feature (342)..(342): n is a, c, g, or t
  modified_base (665)..(665): a, c, t, g, unknown or other
  misc_feature (665)..(665): n is a, c, g, or t
tcagacagtatatacacgaccggtgctcgatttagtgtcgtcgcaagagagaggggggggatctcaggaggcagcttctctcggaatatctccaccatggccgtgggctctgctcctcctcaccctcctcacctcgagggccaacaggatccgtgggctcagtctcgccctggcctcacgcccttcccgtccggtcggtccggtctcctgacacgtcagtcaaccntctcngcactcggaaccacgagtcgaccggttcggttcgttacggacccgttggtcctacggtcgtacccagcctacgaacccaagtaccaccgacccaaacttctattacgttcncggtacgtactatcgttacccgtcccgttacggtccgttcgacggtccgtccgttccttccggtcggttacggtaacctaccgtacgtcggaaccgtaccgtaccgtcccgttccctagaacccgttcgttaccgtcggttcccgggcccttaccgggcggtaacccggttcggaaccgggtaactaagggtcgtttacgtacttttaacgtacgtccgaacgtactcgttacgtaacttggacccgttaaaggggtaccttaccttacgtttacgtacggttacgacggtacgtacgaccgttagcgtacgtaaccgttacnccgtagaccgtacgtcgccgtccgcccgtcgctacccgttccgg

SEQ ID NO: 220107 - DNA, 756 bp, Homo sapiens
  misc_feature: GYAE6OF02G34FG.44.71.G05.1.454.CMB.1.raw
  modified_base (208)..(208): a, c, t, g, unknown or other
  misc_feature (208)..(208): n is a, c, g, or t
tcagacagtatatacacgaccggtgctcgatttagtgtcgtcgcaagagagaggggggtgggatctcaggaggcagctctctcggaatatctccaccatggcctgggctctgctcctcctcaccctctcactcgagggcacaggactccgtcgggcccagtcctcgccctgacctcacgcctcgtccctccggtgtccgtggggtccnccgtacggactacgggtccgtacacctacttcctcctgcgtacgtggacgccaggtacggttaattacgttacttacgttactttaacttcgttaccttccgttagtactactaacgtactactactaccgaacggtaaaccgtaccccgtaaactaccgtactacctacgtacttacgtacgtacggtactaagtaacggaccgtccgtacggtacggtttactaacgtcgtactaccgtacgtcgtacctaccgtacgtaccgaccaccgaccggtaccctaccgtacgaactaccgttccgtacggtccgggtctccggacgtacggtacggaaccgggcggtacggtacgtacgtttatttaacgtttcgtttggtacgtctacggtacgttaccgtttcgggttcctaccgtactaccggttacttaacggttcttaccgggtttacggtaacggtaacgggtcggtaacggtacccggtacgttaacccggtaccgtacggtaccgtacccggtaacccggacccggtaccctacccgtacg

SEQ ID NO: 220108 - DNA, 828 bp, Homo sapiens
  misc_feature: GYAE6OF02GNYSG.44.71.G05.1.454.CMB.1.raw
  modified_base (169)..(169): a, c, t, g, unknown or other
  misc_feature (169)..(169): n is a, c, g, or t
  modified_base (182)..(182): a, c, t, g, unknown or other
  misc_feature (182)..(182): n is a, c, g, or t
  modified_base (712)..(712): a, c, t, g, unknown or other
  misc_feature (712)..(712): n is a, c, g, or t
tcagacagtatatacacgaccggtgctcgatttagtgtcgtcgcaagagagagggggtgggatctcaggaggcagctctctcggaatatctccgaccatcggccgtgggctcgtgctcctcctcaccctctcaactcgaggtcacaaggactccgtgggtccctagtcncgtccctgacctnacgtctacgtcctccgtgtacgtcgggtccacgtcggacaggtccgtcacctacgtcctcgcgtacgtacgcggacgacctaggtacgtaactttacttaccttaacgttaactttacgtttcgtaccgttacgttaacgttaactacctataacttacgtaaccgttaaccggaaaaccggttaaaaccccgaccccttaaagtccttaacctacgtttaacctacttaacgggtaacgtaacggttaacctaacggttaacggaccccggtaccgtacgggttttaaaccggtttacctaacggttacgtcccgttaacctacgtacccggaacccgttcgtaaaccgggtacccgaaacctaaccgggttaccccggtcccctttaaccgacgtaaccttacgtccgttacggaccgtacccggtaccggcgtacggtaggtaccgggaccggtagttaccggtagtttaaacgtttacgttagttccggtattcgtaaccgtagttagtccgttacgtaccgtacnggttaccagttacgttacggtacgttaaccgggtagggtaacgttaccggtaaaccgtccgttaaccgtaccggtaacgacgaacccggaccggtaaccctacccggaccttacgg

SEQ ID NO: 220109 - DNA, 378 bp, Homo sapiens
  misc_feature: GYAE6OF02IDRYH.44.71.G05.1.454.CMB.1.raw
  modified_base (316)..(378): a, c, t, g, unknown or other
  misc_feature (316)..(378): n is a, c, g, or t
tcagacagtatatacacgaccggtgctcgatttagtgtcgtcgcaagagagagggggacctccaaggaaacggttcgggaatcataaactactactatttgatggatgtctggggcaggggggacgtcggtcaccgtctcctcagcttccaccaaggcccagtcggtcttcccccctggccgccctgctccgaggagccacctcgtcgggggcacgacggccggcccgtggggctgcgtcggtacaacggaccttacttcctattactactgtactgaacgtcgggacgtggaccaaggtcgccaagttaaaggcnnnnnnnnnnnnnnnnnnnnnnnnnnnnnnnnnnnnnnnnnnnnnnnnnnnnnnnnnnnnnnn

SEQ ID NO: 220110 - DNA, 335 bp, Homo sapiens
  misc_feature: GYAE6OF02G5959.44.71.G05.1.454.CMB.1.raw
  modified_base (285)..(335): a, c, t, g, unknown or other
  misc_feature (285)..(335): n is a, c, g, or t
tcagacagtatatacacgaccggtgctcgatttagtgtcgtcgcaagagagagggggacctccaaggaaacggttcggggaatcataaactactactatttgatggatgtctggggcagggggacgtcggtcaccggtctcctcagcttccaccaagggcccatcggtcttccccctggcgccctgctccaggagcaacctcgtgggggcacagcggccctgggctcgcctggtcaaggctacttccatagtactgtctgagcgggctggcaacggcgacagtgnnnnnnnnnnnnnnnnnnnnnnnnnnnnnnnnnnnnnnnnnnnnnnnnnnn

SEQ ID NO: 220111 - DNA, 783 bp, Homo sapiens
  misc_feature: GYAE6OF02I87XU.44.71.G05.1.454.CMB.1.raw
  modified_base (140)..(140): a, c, t, g, unknown or other
  misc_feature (140)..(140): n is a, c, g, or t
  modified_base (148)..(148): a, c, t, g, unknown or other
  misc_feature (148)..(148): n is a, c, g, or t
  modified_base (545)..(545): a, c, t, g, unknown or other
  misc_feature (545)..(545): n is a, c, g, or t
tcagacagtatatacacgaccggtgctcgatttagtgtcgtcgcaagagagaggggggggatctcaggaggcagctctctcggaatatctccaccatggcctgggctctgtctcctcctcaccctctcactcaggcacgngactccgngggctcgatccgtcgcctggctcgagtccctccgtcgtgtcttcggttctccgtggactagtctacttacacctacttccttcctcgtccgtaccggttccgggtactacggactaagtcgtacgttaggttcggggaattaattaaccttaaccgttcggtaccgttccgttagggttaactaaaccgaaacgtaaccgtacttaacccgggaagtaaccgtaaaaccccggtacccccctaaaaacggttccctttaacttttaaccggtttttttaccggaaccgtttaaccctaaggtttaccgggtaacgggtcccgggtacccggtacgttaacggtttcgttttaccgacgtttccgtaactttccgtagttccgtactacaacggttcncggtaccctacgtaccgttcctccgtacgtcacgttcgtaacgtcggtaccgtccgtctagggacgtaggtaccgtcgttaaactacgttacgtgttacggcccggtattaccgttcgtaacgttccgtttcgtatcggtttagtcggtttcggtccggaggttacgtccggtcccttcggaaccctcgttaccgtaccgtgtacccggtacgaccgtcttacccggccccgtaacgg

SEQ ID NO: 220112 - DNA, 152 bp, Homo sapiens
  misc_feature: GYAE6OF01AU8OS.40.27.C05.1.454.CMB.1.raw
  modified_base (151)..(152): a, c, t, g, unknown or other
  misc_feature (151)..(152): n is a, c, g, or t
tcagtctagcgactcacgaccggtgctcgatttagacgcgatcgaaggtttgggaagaggaagactgacggtcctgccacagcggccctgggctgcctggtcaaggactacttccagtcgctagactgagcgggctggcaaggcgcatagnn

SEQ ID NO: 220113 - DNA, 487 bp, Homo sapiens
  misc_feature: GYAE6OF01B96EM.40.27.C05.1.454.CMB.1.raw
  modified_base (477)..(487): a, c, t, g, unknown or other
  misc_feature (477)..(487): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacgggaggggatggccccaaatctgcctactttgaccactggggccagggaaccttggtcaccgtctcctcagcctccaccaagggcccatccggtcttcccccgtggccgccctgctccaggacgcaccgtccgagagcacaggccggccctggggcctgcctggtcaaggactacttccagtcgctagactggagcgggctggcaaggcgcatagnnnnnnnnnnn

SEQ ID NO: 220114 - DNA, 482 bp, Homo sapiens
  misc_feature: GYAE6OF01BZEWO.40.27.C05.1.454.CMB.1.raw
  modified_base (265)..(265): a, c, t, g, unknown or other
  misc_feature (265)..(265): n is a, c, g, or t
  modified_base (367)..(367): a, c, t, g, unknown or other
  misc_feature (367)..(367): n is a, c, g, or t
  modified_base (472)..(482): a, c, t, g, unknown or other
  misc_feature (472)..(482): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacgggnggggatggccccaaatctgcctactttgaccactggggccagggaaccttggcaccgtctcctcagcctccaccaagggcccatcggtcttccccctggccnccctgctcccaggacgccacctcccgagacgcacagccggccctggggcctgcctggtccaagactaccttcagtcgctagactgagcggctggcaggcgcatgnnnnnnnnnnn

SEQ ID NO: 220115 - DNA, 591 bp, Homo sapiens
  misc_feature: GYAE6OF01CX83F.40.27.C05.1.454.CMB.1.raw
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (566)..(591): a, c, t, g, unknown or other
  misc_feature (566)..(591): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctaccaacccccccctctacaacccctccctcaagagtcgggtcaccatatctatagacacgtccaacagtcaattctccctggacttgacctctgtgaccgccgcagacacggctgtatattcctgtgccgacccgacgggaggggactcggaccccaaatcctgacccttacgtttgaaccctacggtcgggggaccaacggggtaacctttgggtccacccggttctcccgtcacgccctaccaaccgaacgggccccagttcccggtccctttcccccgnggccgccctggcctccgaggacncccaccgtccgagacgccaacgacgggcccggtccctaggggcctacgcccgtaggtaccgaacggtacttaccttccgacgttccgactagacgtggacggccgggctcgggacgaagggccacgacgtagcnnnnnnnnnnnnnnnnnnnnnnnnnn

SEQ ID NO: 220116 - DNA, 573 bp, Homo sapiens
  misc_feature: GYAE6OF01BGBQQ.40.27.C05.1.454.CMB.1.raw
  modified_base (396)..(396): a, c, t, g, unknown or other
  misc_feature (396)..(396): n is a, c, g, or t
  modified_base (545)..(545): a, c, t, g, unknown or other
  misc_feature (545)..(545): n is a, c, g, or t
  modified_base (549)..(558): a, c, t, g, unknown or other
  misc_feature (549)..(558): n is a, c, g, or t
  modified_base (560)..(573): a, c, t, g, unknown or other
  misc_feature (560)..(573): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacgggaggggatcggccccaaatctgcctactttgaccactggggccagggaaccttggtccaccgtctcctcagccctccaccgaacgggcccagtccggtccttccccccgtggccgcccctgcctccagggacnccaccctcgagagccacgaggccggcccgtggggctcggcccgtggtaccgaacgggtaccttaccgttcccgaggttccgtacgttacggaccttgggaacgggcccggggcttacgggaccgaacggggccgacgaacgttaggacngagnnnnnnnnnngnnnnnnnnnnnnnn

SEQ ID NO: 220117 - DNA, 545 bp, Homo sapiens
  misc_feature: GYAE6OF01CAYEI.40.27.C05.1.454.CMB.1.raw
tcagtctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgacgacccccgggagcaggttaccgtctcttgttctggaagcagctccaacatcggaatattctgtatactggtaccagtgcctcccaggaaccggcccccaaacttctcgtctatagggattatcagcggcccttaggggtccctgaccgattctctggctccaggtctggcacctcagccctccctggccatcagtcgggcctccggcccgaggatgaggcgattattattgtgtgtcagtggatgacagaatgaatggtcgtgttcggcggagggacgaggctgaccgtccgtaggtcagcccgaaggccgtcgcccccgtcggtccaccgtcttcgttccccgcccttcctctcgtccgtcg

SEQ ID NO: 220118 - DNA, 548 bp, Homo sapiens
  misc_feature: GYAE6OF01BWKD2.40.27.C05.1.454.CMB.1.raw
tcagtctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgacgaccccccgggagcaggttaccgtctcttgttctggaagcagctccaacatcggaagttaattctgtatactggtaccagtgcctcccaggaaccggcccccaaacttctcgtctataggattatcagcggcccttaggggtccctgaccgattctctggctccaggtctggcacctcacgcctccctggccatcagtcgggctcccggcccgaggactggaggtcggatttagttattgtgtgtcagtggatgacagatgaatggtcgtgtcggcggaggacaggctgaccgtcgtaggtcacgcccaaggcctcgtccccctcggtccaccttcgtccgttccccgcccttcctcacgtcgtcg

SEQ ID NO: 220119 - DNA, 532 bp, Homo sapiens
  misc_feature: GYAE6OF01CGH7H.40.27.C05.1.454.CMB.1.raw
  modified_base (196)..(196): a, c, t, g, unknown or other
  misc_feature (196)..(196): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagcccaccctcagcgtctgacgaccccccgggnagcaggttaccgtctcttgttctggaagcagctccaacatcggaagtaattctgtatactggtaccagtgcctcccgaggaaccggcccccaaacttctcgtctatagggatatcagccggcccttaggggtccctgaccgtattctctggctccgaggtctggccacctcagccctccctggccatcagtgggcctccggcccgaggatggaggcggtattacgttattgtgtgtcagtggatganagatgagtggtcggtgtcggnggacggcgaggctcgcgtcgtagtcncgccgagcgcgcccctgcnctctcgtcccncctcncngcgtc

SEQ ID NO: 220120 - DNA, 548 bp, Homo sapiens
  misc_feature: GYAE6OF01BWXST.40.27.C05.1.454.CMB.1.raw
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
  modified_base (537)..(537): a, c, t, g, unknown or other
  misc_feature (537)..(537): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctggcccagtctgtgctgactcagccaccctnagcgtctgacgacccccgggnagcaggttaccgtctcttgttctggaagcagctccaaacatcggaataattctgtatactggaccagtgcctccaggaaccgcccccaaattctcgtctatagggattatcagcggtcccttaggggtcccngaccgtattctctggctccaggtctggccacctnacgccctccgtggccatcaggtcggctcccggcccgaaggactggaggccggtaattagttattgtgtgtcagtggatgacagaatgaatggtccgtggtcggcggaggaccaggctgacccgtctacggtcacgccgaaggcctcgccccctcggtcactctccgtccccaccctcnctgtccgtacg

SEQ ID NO: 220121 - DNA, 702 bp, Homo sapiens
  misc_feature: GYAE6OF01D39SN.40.27.C05.1.454.CMB.1.raw
  modified_base (173)..(173): a, c, t, g, unknown or other
  misc_feature (173)..(173): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagccaccctnagcgtctgacgacccccggnagcaggttaccgtctcttgtcnggaagcagcctccaanatcggaatattctgtatactggtaccagtgccctccgaggaaccgaccccctaaacttctcgtctaagtaggattatacacgcgggtccctttacgggggtccctcgaccgtatttctcgtcggctccaggtctggccactcacgcctccctggccatcgaggttcgggccctccgggcccgaggagtggacgggtacggtatttaagttacgttaggttggttgtactaggtacgggtagtagtaacgaggtaacgttagtaaacggttcggggttcccgggttggttaccggggtacggggtaacgggaacccggtagggtaccgtacggttaaccccggttacggttaccggtacgtaacccggacccggaacgggtccgtaccccggtccccccggttcggttccctacccgttccgttaccccgtttcccccgtacccccttcccgtaccgtccgtcggtaacccg

SEQ ID NO: 220122 - DNA, 738 bp, Homo sapiens
  misc_feature: GYAE6OF01AQGHX.40.27.C05.1.454.CMB.1.raw
  modified_base (172)..(172): a, c, t, g, unknown or other
  misc_feature (172)..(172): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
tcagtctagcgactcacgaccggtgctcgatttagacgcgatcgaagggtttgggggtgggagaagacaggattcaggccaatctccagcatggccggcttccctctcctcctcaccctcctcactcactgtgcaggtcctgggcccagtctgtgctgactcagccaccctnagcgtctgacgacccccgggnagcaggttacccgtctcttgttcnggaancagctccaanatcggaatatctgtatactggtaccagtgcctccgaggaaccgccccaaacttctcgtctagtagggactttancgaacgtccggaccctttagggggtcccctggtaacccgtatttccgtcgtgggtcccttccgaggtttccgttcggacctacccgttacaaccggtccccttaccccgtggacccctaagttccgacgggtcgggccctcccggggtccccgaagggtactcgggtacggtacggtaagtttaacgtttagtttcgtaggttcgttacgtagttcgggagtcggaacgtacgtaagtaggtaagttcgggtacgggttcggtttaccggggacgggtacgggtaccgtaacggggtctaacgggtacccggttaccgtacgggttaccgacggtacccggaaccggtaccggtcccggtaccccggttccggtcccgtaccttcccgtcccgttaccccgtcccccttcgttcccgtacgtcgttacccgg

SEQ ID NO: 220123 - DNA, 557 bp, Homo sapiens
  misc_feature: GYAE6OF01EXYZX.40.27.C05.1.454.CMB.1.raw
  modified_base (194)..(194): a, c, t, g, unknown or other
  misc_feature (194)..(194): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagccaccctcagcgtctgacgacccccgggnagcaggttaccgtctcttgttctggaagcagctccaacatcggaataattctgtatactggtaccagtgcctccaggaaccggcccccaaacttctcgtctatagggattatcagccggtccttacggggtccctggaccgtattcctcgtgcctccaggtctcggcacctcgacgccctccgtggcccatcaggtcgggcctccggacccgaggatggaggcggtattacttagttgttgtgtcagtgggatgacagaatgtagtcggtcggtgttcggcggaggacgtagtcgcgacgtcgtaggtcacgccgaggctcgcccctggtccacgtctccgtcccgccctctcgcgtcgtacg

SEQ ID NO: 220124 - DNA, 927 bp, Homo sapiens
  misc_feature: GYAE6OF01DMQR2.40.27.C05.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
tcagtctagcgactcacgaccggtgctcgatttagacgcgatcgaaggggtttggggggtggagaagacaggattcaggccaatctccagcatggccggcttcccctctccctcctccaccctcctcactcactgtgcgagggtcctcgggcccagtctgtgctgacctcacgcccaccctcacggtccgtcgtacggaccggaccccccgggnacggccgtaacggtttacccgtccttcgtttagttccgagggaacnccgacgtcctaaccaaacagttacgggtaaattaacttcgtagttaataccggttacggtaacctagtccggtaccccctacccgaaacggggtaaaccccggacccccttaaaacttcccgtacgttacttacggtaagggtaactttactccgacggtacccgggttcccggttaaccgggtcctacggtaaccgtcttccgtcgtggcccttccggtaggttcccgacggtccaaccgtccacgtcccctccgtacgcctaacgtcgacgggtccggcccggtaccggacccggaggtacgtacggggacggtaccgttaaaggttttcgtttaggtttaggtggtttaccggtacggaagggttacgggaacgtacggtaacgaaaggttaacgttaagggtaacgggtttccgggggtttaaccgggtccggggtttacggggaacccggggaacggggtccccgtaaggggtacccgttacggggttaccccgttacgggtaaacggtcccgaccggggaaccccgtaagggttcccccggtaccccgggttaccccccggtacggttacccccttaccccggtttacccccggttaccccttacccccccgttaaccctttcccgggtaacccccggttaaggttccccggtaaaccggg

SEQ ID NO: 220125 - DNA, 637 bp, Homo sapiens
  misc_feature: GYAE6OF01B7RDL.40.27.C05.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagtctagcgactcacgaccggtgctcgatttagacgcgatcgaaaggggtttagggggggtggagaacgacaggatttcaggtcccaactcctccagcatggccggcttccctcgtcctccgtcacccgtcctcactcactgtgcagggtcctgggcccagtctgtgctgactcagcccaccctcagcgtctgacgacccccgggnagcaggttacctctcttgttctggaagcagctccaanatcggaagtaattctgtatactggtaccagtgcctccaggaaccggcccccaaaattctcgtactatagggattactcagcggtcccttaggggtcccctgaccgattcnctggctccaggtctggcactcagcctcccngtccatcagnggcnccgccgagntgagcgattatatgtgtntcgatggatcgaagagaaagtgaactgggttccgggttagttcggggacgggtacgggaacccgtagggacgttacggtaaccggttccgtaacgggttccgaacggccccgtaaaagggcccgtaccggtccccccgttacgggttacccaacccgttcgttacccggtttcccccggccccctttacccgtccgtccgtaccggtaccg

SEQ ID NO: 220126 - DNA, 805 bp, Homo sapiens
  misc_feature: GYAE6OF01CA965.40.27.C05.1.454.CMB.1.raw
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
  modified_base (726)..(726): a, c, t, g, unknown or other
  misc_feature (726)..(726): n is a, c, g, or t
tcagtctagcgactcacgaccggtgctcgatttagacgcgatcgaagggtttggggggtggagaagacaggattcaggccaatctccagcatggccggcttcccctctcctcctcaccctcctcactcactgtgcagggtcctgggcccagtctggtgctgactcagcccacctcagcgtctggaccgacccccgggnagcgtacggtttaccgtcttctttgttccgtagggaacgcagcctaccaaactagtacgggaaattacttcgtagtaatactcggtaccagttcgccctaccgaaggaacccgaccccctaaactttcgtcgtactagtagggtaacttancgacggccggtcccgttacggggtccctaggaaccgtnttcgtcgtcggcctccgaggttcctcggcctaccctcgaccgtccccgttcccgtaggtcccctaaacgttccggtaacgggtccggggtcccgttaacccccgggggtcccggaagggttaacggtacgggggaacgggttaccgggttaaatttttagtttaacgtttcgggttacgttggttaccgaaggtttgggtaactggtaaaaccgtaaggtaaagttacggtaacggttccggggtttacgggttgggtaccgggggaacgggaacgggtaccggacggtcgttacgggtaccccgtgtacggtccgaccggacccggtaacgggtcccncccggttccccgtacgggttcccaccgtttcccggttaccccttacccctcccgttaacccgtctacggtcctaaccgg

SEQ ID NO: 220127 - DNA, 655 bp, Homo sapiens
  misc_feature: GYAE6OF01BDUMQ.40.27.C05.1.454.CMB.1.raw
  modified_base (194)..(194): a, c, t, g, unknown or other
  misc_feature (194)..(194): n is a, c, g, or t
  modified_base (645)..(645): a, c, t, g, unknown or other
  misc_feature (645)..(645): n is a, c, g, or t
tcagtctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagcccaccctcagcgtctgacgacccccgggnagcaggttacctctcttgttctggaagcagcctaccaacatacggaagttattctgtatcgtgtaccagtcgcctccgaggaaccgaccccctaacttctcgtctagtacggtattatcgaggccggtcccgttaacggggtccctacggaccgtactttcctacgtcggtccttacccgagggtttccgtcggacctaccctccgacgtccccttcccgtcggacctacgtccgaggtcggggtcccgtacccgggaccccggtagggagtcgggacgggtcgggttaactttagttagtttggttgtcgttatagtgggatgacgagatgaacgtggtccgtggtcggacggacggaccagtacgtcggtacctacggtagtccgacggcccaggtccctccgtccccgtcggtcctaccgtccgttaccgtcccctaccctcctacgngtcctaccgg

SEQ ID NO: 220128 - DNA, 787 bp, Homo sapiens
  misc_feature: GYAE6OF01EZBEK.40.27.C05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
tcagtctagcgactcacgaccggtgctcgatttagacgcgatcgaagggtttgggggggtggagaagacaggattcaggccaatctccagcatggccggcttccctctcctcctcaccctcctcactcactgtgcgaggtcctgggccagtctgtgctgactcacgtcccaccctcacgtcgtctcggaccggacccccgggnagcgtaacggttacctcttcgttgttcgtaggaancgacgtcctaccaactagtacggtaagttaattcgtagtatacgtggtaccagtccgccctacccgaacggaacccgtacccctaacttccgtacgtacgtaacgtaggtaacttacgcgacggtcccggttacccggttaccggggtaccctacggaccgttctttcgtaccgtcggtacctccggtaggtccgtcggtaccctaccgtaccgtaccgccccttaccggtcggaccctacgtcggtacgggtccgggtccccggtacccggacccggaaggtacggttacgggacgggtacgtttaatttagttacggtttggtagttcgtacgtaggtaggtactacgaacgtaaggtagttaacggtacgggttccgggtcggttcggggtcgggaggggtaccggaaccgtaggtccgtaccgtacccggtacgtacgggtaccgaaccggtacccgtacggtcccgtaccccggtcccgttaccggttccacccgtttcccgtaccccgttcccgtaccctttaccggcctcggtcccgtaacg

SEQ ID NO: 220129 - DNA, 678 bp, Homo sapiens
  misc_feature: GYAE6OF01BYBPZ.40.27.C05.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagcccaccctcagcgtctgacgacccccgggnagcaggttaccgtctcgttgttctggaagcagctccaanatcggaatattctgtatactggtaccagtgcctcccgaggaaccggccccctaaacttctcgtctagtagggattatcagccggtcccgttacggggtccctagaccgtattcctcgtgcctcgaggtctcggccacctcacgccctcccgtggccctatcaggtcgggccttcccggcccgaggagttcgggagggaccggtaatttagttagtttaggtgttgtctaggttgggattcgaacgtagtaaagtggtaacgttcgggttacccgggttggttccgggacggggtacgggaaccgtgggtccgtcgggtacccgttccggtacggtccgaccggtcccgaagggtcccgtcccggttacccccggtttggtccctaccgttcccgttcccgttccccctaaccccgttcccgtaccgtaccgttccgtaacccgg

SEQ ID NO: 220130 - DNA, 845 bp, Homo sapiens
  misc_feature: GYAE6OF01CIWGG.40.27.C05.1.454.CMB.1.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
tcagtctagcgactcacgaccggtgctcgatttagacgcgatcgaagggtttgggggggtggagaagacaggattcaggccaatctccagcatggccggcttcccctctcctcctccaccctcctcactcactgtgcgagggtcctgggcccagtctgtcgctgactcacgccaccctnagcgtctcgacggcccccggnacgcgtacggttaccgtctcttggttctaggaacgcaagtcctaccaaactacgtaacgggtaaattaatttcgtagttaacttacgtcggtaaaccgtacgtaccggtccctaacccggaacgggaaaccccggtaacccccctaaaaccgtttccgtaccgttaccgttaaaggttacgggtaactttacgtaccgacgggtcccggtacccggttacgggttcccgtacggtaaccgtactttctcgtcggcccttccgtaacggttccgtcggacctacctacgccgtcccgtacccgtcggaccctacgtaccggtacgggtccgggtacccgtcccggaccgggtaggtacgtacgggacggtacggtaactttagtttaagttcggtgttacggtgtacggtagggtagtacggtaacgtaagtaacgtagggtaacggtttcgggttacccggggttaggttaccgggggacgggaaccgggaccggtaacggtccgtacgggttacccgtacggttaacggaccgaccggtaaccccggtaacgggtccccgtaccccggttccccgttacggttaaccccttccgtacccggttccccgtacccctaccgttacccgccgtacggtcccgtaacg

SEQ ID NO: 220131 - DNA, 834 bp, Homo sapiens
  misc_feature: GYAE6OF01EAX4R.40.27.C05.1.454.CMB.1.raw
  modified_base (179)..(179): a, c, t, g, unknown or other
  misc_feature (179)..(179): n is a, c, g, or t
  modified_base (203)..(203): a, c, t, g, unknown or other
  misc_feature (203)..(203): n is a, c, g, or t
  modified_base (447)..(447): a, c, t, g, unknown or other
  misc_feature (447)..(447): n is a, c, g, or t
tcagtctagcgactcacgaccggtgctcgatttagacgcgatcgaaggggtttgggggggtggagaaagacaggattcaggccaatctccagcatggccggcttccctctcctcctcaccctcctcactcactgtgcagggtcctgggcccagtctggtgctgactcacgcccaccctnagcgtctggaccggacccccgggnaggccgtacgggtttaccctcttcgtttaggtccgtaggaaacgcctaacggtccctaacccgaaactacggtacgggtaaaattactttcgtgttaacgttacggtcggtaaccgtagtccgcccctacccggaacgggtaacccccggtaaccccctaacgttccttccgttacttaacggtaacgggtatttacgtacgacgggtaccgggtcccggtttacggggtccctacgaaccgtntttccgtcgtgtccgtcgtacgggtcgtcggacctcccgcaccgtccccgttcccggtcggacctaacggtccgtacggggtcccgggtccggtacccccggaccgggaggtacgggacgtacggggttacgttaagttttaacgtttgttacggttggtcgtaacgtaggtagggtactaggaacggaagtaagtcggttaacggttccggggttcgggttacggtcgggaacggggtacgggaaccgtgggtaccgtccgggtaccgttacgggacggttaccgaccggtaccgtaccgggtcccgtcccggttacccccgtcgttacccgaccgtttcccgtacccgtttcccccgaacccttccgtacgtaccgcgtaaccgg

SEQ ID NO: 220132 - DNA, 698 bp, Homo sapiens
  misc_feature: GYAE6OF01BW0W5.40.27.C05.1.454.CMB.1.raw
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (484)..(484): a, c, t, g, unknown or other
  misc_feature (484)..(484): n is a, c, g, or t
tcagtctagcgactcacgaccggtgctcgatttagacgcgatcgaagggtttgggggtggagaagacaggattcaggccaatctccagcatggccgcttccctctccctcctccaccctcctcactcactgtcgcgacgggtcctcgggcccagtctgcgactcgactcgctcccacctgacgtcncgngaccgaccccggntagcgtacggttacctcgtcgtttacggttcaggaacgccgtaacgtctacccgaaatacggttaacggaaagttcttacgtaagtaccgttaagttccggaaccgtacgttccgacccgtaccggaacggtaaccggtaacccccttaacttacgttaccgtacgtacgtaggtacttaacgtcgacggaccggttccgtacgggttccacggtacctcggtcctacgtcgccgttacgacggttcaacggcctactccgccgtactccgagacatacggntccgggtccgacggacggtaggtacgtacgacggtagtcgttagtacgttgcgtagacggtgagacagtaacagtacgagtagtggtaccgtgggtccgtagggaccgagtccgacgtacgtccggtactacgcgtaacggcgtacgtcccgccgttaccgactccggaacctttccgtaccgcccccgttctaccctcgttccgagttacccg

SEQ ID NO: 220133 - DNA, 759 bp, Homo sapiens
  misc_feature: GYAE6OF01EBTPO.40.27.C05.1.454.CMB.1.raw
  modified_base (200)..(200): a, c, t, g, unknown or other
  misc_feature (200)..(200): n is a, c, g, or t
  modified_base (695)..(695): a, c, t, g, unknown or other
  misc_feature (695)..(695): n is a, c, g, or t
tcagtctagcgactcacgaccggtgctcgatttagacgcgatcgaagggtttgggggggtggagaagacaggattcaggccaatctccagcatggccggcttccctctcctcctcaccctcctcactcactgtgcgagggtcctgggcccagtctgtgctgactcagcccaccctcagcgtctcggacggacccccgggnagcgtacgggttacccgttcttcgtttgttcgtagggaaacgccgaagcctaccaaacctagtaccgggaaatttacttcgtagtactaccgtggtaccagtcgccctacccgaacggaacccgaccccctaaacttcctacgttactaagtagggtattacgtcgacggcccggtacccggtttacggggtccctacggaccgtattccgtcgtcggtcctccgtacggtcgtccggacctccctacgaccgtccccttcccggtcggccctaacgtcgtacgggtccgggcccggtcccgggacccggtaggtacgtcgggaggtccggttaattttagtagtttcggtggttcgtacgtaggttagggacttaggaactaaggtaagtacggttaaggttccggggttcgggttcgggtcggggacggtacggaccggtacggtcgttaccggcccgttacggtaccggacgaccggaccgacgggttcccncccggtaccccgttcggtccctccgtccgttccccgtcccgtaccctcgtccgccgtccgtacg

SEQ ID NO: 220134 - DNA, 724 bp, Homo sapiens
  misc_feature: GYAE6OF01CBTJJ.40.27.C05.1.454.CMB.1.raw
  modified_base (132)..(132): a, c, t, g, unknown or other
  misc_feature (132)..(132): n is a, c, g, or t
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
  modified_base (700)..(700): a, c, t, g, unknown or other
  misc_feature (700)..(700): n is a, c, g, or t
tcagtctagcgactcacgaccggtgctcgatttagacgcgatcgaagggtttgggggtgagaagacaggattcaggccaatctccagcatggccggcttcccctctcctcctcaccctcctcactcactgtncacggtcctcggcccagtctgtgcctgactcacgcccaccctnagcgtctggaccgaccccccgggnagtccgaggtttacccgtcttctttgttcctaggggaactcaacgtcccttacccaaatacgttaccgggtaaattaactttctaggttaactaccggttaggtaccctagtccgtccccgtacccgaacggaaccccggaccccctaaacttcctcgtactagtacggtattcgacgacgcccggtaccgttacggggtccctgaccgttactccgtacgtcggacctacgtacgtccgtagacctaccgcgtaccgtcccgtaccgtcgactacgtcgtaggtccggcccgtcccggaccggtaggacgttacggacggtccgttaatttatcggttcgtgtacgtcgtagttacggatacgtagtacgaagtacgtacggttggtacgttcgggtcggacgggtacggccgaggtcgaccgttaccggtccgtaggtccgacgtacccggagtcccgtcccggcccgttcgtacctcccgtcgtacccccgttccccncccgtaccgtcctggcccgtaacg

SEQ ID NO: 220135 - DNA, 895 bp, Homo sapiens
  misc_feature: GYAE6OF01D21T9.40.27.C05.1.454.CMB.1.raw
  modified_base (205)..(205): a, c, t, g, unknown or other
  misc_feature (205)..(205): n is a, c, g, or t
tcagtctagcgactcacgaccggtgctcgatttagacgcgatcgaagggtttgggggggtggagaagacaggattcaggccaatctcagcatggccggcttccctctcctcctcaccctcctcactcactgtgcgagggtcctgggcccagtctgtgctggactcgacgcccaccctcgacgcgtcgtggaccggacccccgggnacgcgtaacggttaccgtcttccgtttggttccgtaggaacgccacgtacctaaccaaacgtacgtaacgggtaaagttaacttcgtaagttacgttaacgttccgggtaacctacggttctacccgtacccggaacggaacccccggtaacccccttaaacgttccttacgtaccgttaagtaacgggttaacttaccgtacgtaccgggtcccgggtttaacccggttttaccggggggtacccttaccggtaccggttaaccgttttccgttaccgttccggtaccgttccggaacgggttccgttaccgggaccctacccgtacggtacccgttccccgtaccccggtcggtccctaaggtcccggtggggaacccgggtccccggtaccccgggaccgggtaaggagggttaccgggtaacgggttcggttaaactttaacggttttacggttcgggtactttacggtaccgttaagggtacgggttaagtttacgaacgttaaaggtacggtacggttaacgggttcgggtccgggtttaggtccgggggaacgggtacgggaccgttacggacggttccggtaaccgttccggtaaccgacggtaccgtaccggccgtaccgtcccgtcccggtcacccgtcgttacccgtcccgtaccccgtcctacgccgtgtcggtccgg

SEQ ID NO: 220136 - DNA, 476 bp, Homo sapiens
  misc_feature: GYAE6OF02FZD6W.40.27.C05.1.454.CMB.1.raw
  modified_base (465)..(476): a, c, t, g, unknown or other
  misc_feature (465)..(476): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaaccccccctctacaacccctccctcaagagtcgggtcaccatatctatagacacgtccaacagtcaattctccctggacttgacctctgtgaccgccgcagacacggctgtatattcctgtgcgacccacgggaggggatggccccaaatctgcctactttgaccactggggccagggaaccttggtcaccgtctcctcagcctccaccaagggcccatcggtcttccccctggcgccctgcctccaggagcacctccgagagcacagcggccctgggctgcctggtcaaggactacttccagtcgctagctgagcggctggcaaggcgcatagnnnnnnnnnnnn

SEQ ID NO: 220137 - DNA, 527 bp, Homo sapiens
  misc_feature: GYAE6OF02IKHDA.40.27.C05.1.454.CMB.1.raw
  modified_base (193)..(193): a, c, t, g, unknown or other
  misc_feature (193)..(193): n is a, c, g, or t
  modified_base (246)..(246): a, c, t, g, unknown or other
  misc_feature (246)..(246): n is a, c, g, or t
  modified_base (519)..(519): a, c, t, g, unknown or other
  misc_feature (519)..(519): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagccaccctcagcgtctgagacccccgggnagcaggtttaccgtctcttgttctggaagcagctccaacatcggaataattcngtatactggtaccagtgcctcccaggaaccggcccccaaacttctcgtctatagggattatcagcggcccttaggggtccctgaccgattctctggctccaggtctggcactcagcctcctgccatcagtggctccggccgaggatgaggcgattattattgtgtgtcatgggatgacagaatgaatggtcgtggttcggcggaggaccgaggctgaccgtcgtaggtcagcccaggctcgcccctcggtcactctcgttcccaccctcctcncgtcgtcg

SEQ ID NO: 220138 - DNA, 547 bp, Homo sapiens
  misc_feature: GYAE6OF02GTUMT.40.27.C05.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (545)..(545): a, c, t, g, unknown or other
  misc_feature (545)..(545): n is a, c, g, or t
tcagtctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggnagcaggttaccgtctcttgttctggaancagctccaacatcggaatattctgtatactggtaccagtgcctccaggaaccggcccccaaacttctcgtctagtaggattatcagccggcccttaggggtccctgaccgattctctggctccaggtctggccacctcacgccctccctggccatcaggtcgggcctcccgggcccgaggactggaggcggtatttagttattggtgtgtcagtgggatgacagatgatggtcgtgtcggnggaggcnggctgaccgtcgtagcacgccaggtcctcggcccctggtccactccgtccgttccccaccgtccctcgtacggtccncg

SEQ ID NO: 220139 - DNA, 730 bp, Homo sapiens
  misc_feature: GYAE6OF02JEUN4.40.27.C05.1.454.CMB.1.raw
  modified_base (300)..(300): a, c, t, g, unknown or other
  misc_feature (300)..(300): n is a, c, g, or t
  modified_base (500)..(500): a, c, t, g, unknown or other
  misc_feature (500)..(500): n is a, c, g, or t
tcagtctagcgactcacgaccggtgctcgatttagacgcgatcgaaggttttgggggtcggtggggtaccgccggcccccagggaaggggtcgtcggagtgggaacttgcggaagcccatactattattgattcgacgagcgccccttctacgaacccccccctcctacaacccctcctccaaacggagtacgggttcacccataactctaatagaccaacgtcccaaaccagttccaattctccctgggacttagacctctcgtgaccgccgcgacgacacggctgtaatagtttccgngtcgtccgtaacccacggagggggtaacctacggaaccccaaatccgtcgacctaccttttcgaccaaccgttcggggccaagggtaaccctttggtccgtaaccgttctcccttctacgcccgtcccaaccgtaacggggcccctacgtccggtaccgttttcccccagggccgcccctggtccgttcccaggggaacnccgacccttccgagtacgccaacaagccggaccctcgggctcgccgtaggtcccgaaaggactttacgttaccgttaagttccgtctacgacgtcgaacggcgggtaccgtcgggacctaacgggcccgtacgaacgttaccgggcgacgacgaggcgacagacgaacgactagtacgcgcgacacgtacgtacgtacgtcgtacgtacgtaccgtaccgtacgtactcg

SEQ ID NO: 220140 - DNA, 488 bp, Homo sapiens
  misc_feature: GYAE6OF02GHV0Q.40.27.C05.1.454.CMB.1.raw
  modified_base (258)..(258): a, c, t, g, unknown or other
  misc_feature (258)..(258): n is a, c, g, or t
  modified_base (397)..(397): a, c, t, g, unknown or other
  misc_feature (397)..(397): n is a, c, g, or t
  modified_base (465)..(465): a, c, t, g, unknown or other
  misc_feature (465)..(465): n is a, c, g, or t
  modified_base (472)..(488): a, c, t, g, unknown or other
  misc_feature (472)..(488): n is a, c, g, or t
tcagtctagcgactcacgaccggtgctcgatttagacgcgatcgaagggtttggggctgggtccgccggcccccagggaaggggctggagtggattgcgagcatatattatgatgagagcgcccctctacaaccccccccctctacaaccccctccctcaagagtcgggtcaccatatctatagacacgtccaacagtcaattctccctggactttgaccctctgtgacccgccgcagaccacggctgtatattcccngtgcgaccccacgggaggggatggcccccaaatctgcctacttgaccactggggccagggacctgtcaccgtctcctcagcctccaccaacgggcccatcggtcttccccctggcgccctgctccagagcacctcgagngcacagccggccctgggctgcctggtcaaggctacttccagtcgctagactgagcgggctggcaggcncagtagnnnnnnnnnnnnnnnnn

SEQ ID NO: 220141 - DNA, 539 bp, Homo sapiens
  misc_feature: GYAE6OF02HXO61.40.27.C05.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
tcagtctagcgactcacgaccggtgctcgatttagacgcgatcgaagggtttggggggtggagaagacaggattcaggccaatctccagcatggccggcttcccctctccctcctcaccctcctcactcactgtgcagggtcctgggcccagtctgtgctgactcagccaccctcagcgtctgacgaccccccgggnagcaggttaccgtctcttgttctggaagcagctccaacntcggaataattctgtatactggtaccagtcgcctccaggaaccggccccctaaattctcgtctataggattatcagccgtcccgttagggtccctgaccgtattctgtcggcctccgagtctggcacctcgacgtccctccgtggcccagtcaggtcggtcctcccggcccgaggactggaggcgtattattagttgtgtgtcagtggatgacagatgagtggtcgtgtcggnggacgcnggctcgccgtcgagtcacgccaggctccgccctgccncgtctctcccncctcnctcgtctacg

SEQ ID NO: 220142 - DNA, 618 bp, Homo sapiens
  misc_feature: GYAE6OF02GAPB0.40.27.C05.1.454.CMB.1.raw
  modified_base (195)..(195): a, c, t, g, unknown or other
  misc_feature (195)..(195): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagcccaccctcagcgtctgacgacccccgggnagcaggttaccgtctcttgttctggaagcagctccaacatcggaaataattctgtaatactggtaccagtcgcctccaggaaccgccccaaattctcgtctatagggattatcagccggccgttacggggtccctgaccgtattctcgtcggctccgaggtcctcggctacctcacgtccctcccgtggccatcgaggtcgggcctccgggacccgaggatcggagggcggtatttagttagttggttgtcgtcgtagtgggattgaacgtagtaatgaagttgggtccggttggttcgggacgggaggaccgagggtcctcggtaccgtcgtaggtaccgacggtaccgaaggtccgtccggtcccccgtcggtcctaccgttccgtccgtttccccgacccgttccgtcgacgtccgtacg

SEQ ID NO: 220143 - DNA, 806 bp, Homo sapiens
  misc_feature: GYAE6OF02IVXSQ.40.27.C05.1.454.CMB.1.raw
  modified_base (132)..(132): a, c, t, g, unknown or other
  misc_feature (132)..(132): n is a, c, g, or t
  modified_base (170)..(170): a, c, t, g, unknown or other
  misc_feature (170)..(170): n is a, c, g, or t
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
tcagtctagcgactcacgaccggtgctcgatttagacgcgatcgaagggtttgggggtggagaagacaggattcaggccaatctccagcatggccggcttccctctcctcctcaccctcctcactcactgtncagggtcctggcccagtctgtgctgactcagccacctnagcgtctgacgacccccgggnagccaggttacccgtctcgttgtctggaagtccagtcctaccaaacntcgggaataacttcagtactactggtaccagtcgcctccgaaggaccgccccaattcctcgtactagtacggtattacgtcaggtccggtcccgttagggtccctaggaacccgtattccgtccgtggtcctaccggtaggttccgtcgggtcctaaccttcgaacgtcccttacccgtcgggtaccctacgttcgtaacgggttccgggtcccgtacccgggcccggtaagggaacgttcgggaacgggtaccggtttaactttaacgtttacggtttggtacggttcgttaccgaaaggttcggggtaacttacggaaccggtaaagtaacggttaacggaacggtttcgggtacccggggtttggttaaccggggtacggggtaacgaccggttaagggccgttaaccgtacccggttcggtaaacgtccgtaaccggtaccccggtaaggtcccgttccccgggtaacccccgtttggtaccccgtaaccgtttcccggttaccccggtttaaccccccgtaccccgttaccggttacccggtaccggttccccggttaaccgg

SEQ ID NO: 220144 - DNA, 670 bp, Homo sapiens
  misc_feature: GYAE6OF02IG5AK.40.27.C05.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
tcagtctagcgactcacgaccggtgctcgatttagacgcgatcgaagggtttggggggtggagaagacaggattcaggccaatctccagcatggccggcttccctctcctcctcacccctcctcactcactgtgcagggtcctgggcccagtctgtgctgactcagcccaccctcagcgtctgacgaccccccgggnagcaggttaccgtctcttgttctggaacgcagctccaacatcggaagttaatctgtatactggtaccagtcgcctccgaggaaccgacccccaaacttctcgtctagtaggtattancagcggtcccgttaggggtccctgaccgtattcctcgtggcctccgaggtctcggacacctcacgtccctcccgtggccctatcgtaggtcgggcctccccgggacccggaagggcgtggaacgggtacgggtaatttacgttagtttagtcgttgtcgtagtgggtataggtaacagaatagtaagttgggtccgggtggttcggggacgggacgggaccgagggtcctacggacccgtacgtacggtccgacggacccgtaagggtcccgtcccggtcccccgtacgggtcctacccgttccgttccggttaccccctacccccgttcccgtaccgtaccggttcccgtacccg

SEQ ID NO: 220145 - DNA, 623 bp, Homo sapiens
  misc_feature: GYAE6OF02JQW2O.40.27.C05.1.454.CMB.1.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
tcagtctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaancagctaccnacactacgtaagtaattactagtatacgtacggtaccgtacgtcgccgtaccgacggaaccgacccaaccttctcgtacgtataggtatatcgacgtcggtccgttacggtccgtcgaccgtactctcgtcgtcgtcgtacgtcgtcgcactcacgtccgtccgtcgctactcgtacgtcggtccggtccggaccggacggacgtacggtacggtacggtaacgtttagttagttgttgtgtacgtagtaggtagtagagagtaagtagtagtcggtcggtcggtacggtcggacggacgtacgtacgtcgtacgtacgtacgtacgacgaccgacggcgtccgtcccgtccgtccgtaccgtccgtccgtcccgtcccgtccgtccgtcgtcg

SEQ ID NO: 220146 - DNA, 716 bp, Homo sapiens
  misc_feature: GYAE6OF02IRQUV.40.27.C05.1.454.CMB.1.raw
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagccaccctnagcgtctgacgacccccgggnagcaggttaccgtctcttgtctggaagcagctccaacatcggaataattctgtatacgtggtaccagtgcctcccaggaaccggcccccaaacttcctcgtctagtacgggtattactcagccggtcccgtttaggggtccctgaccgtattctctggctccaggttctggctacctcacgccctccctggccatccgacggtcggggtccttcccgggcccggagggtacgtggacgggtcgggtaatttacgtttaagtttggttggttggttacgtaagttcggggtaattggaaacgtaacggtaaattacggtaaagttcggggtacccgggtttgggtttaccgggacgggggtaccggggaaccgtacggggtaccgtacggtacccggttacgtaccggtaccgtacggacccgaagggtcccgtacccggtcccccggttacggtacccttaccgttccgtttcccggttcccccggttccctaccccgttacggtccggttcccgtaccggg

SEQ ID NO: 220147 - DNA, 636 bp, Homo sapiens
  misc_feature: GYAE6OF02HJQSR.40.27.C05.1.454.CMB.1.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (609)..(609): a, c, t, g, unknown or other
  misc_feature (609)..(609): n is a, c, g, or t
tcagtctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgacgaccccccgggnagcaggttaccgtctcttgttctggaagcagctccaanatcggaagtaattctgtatacgtggtaccagtcgccctaccgaggaaccggacccccaaacttctcgtctaagtagggattancaggccggtcccgttagggccctgaccgtnttctcgtggctccgaggtcncgccacctcacgcccttcctggccatcgtaggtcgggtcctcccggggacccgaggtcgtaggacggtacggtaatttacgttagtttgttgttgtactaggtggatgaacgtagtagtagtaagtcgggtcggttcgggttacgggcgggtaacgggaccgtacggcgttacggaccgttcgtacgtacgacgacccgaggtccctccggtccccctggtacctccgtccgttcccgttcccnccccgttccgtacgtccgtccgtaccg

SEQ ID NO: 220148 - DNA, 553 bp, Homo sapiens
  misc_feature: GYAE6OF02IK3BV.40.27.C05.1.454.CMB.1.raw
  modified_base (142)..(142): a, c, t, g, unknown or other
  misc_feature (142)..(142): n is a, c, g, or t
  modified_base (526)..(527): a, c, t, g, unknown or other
  misc_feature (526)..(527): n is a, c, g, or t
  modified_base (530)..(553): a, c, t, g, unknown or other
  misc_feature (530)..(553): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaaccccccccctntacaacccctcctcaagagtcgggtcaccatatctatagacacgtccaacagtcaattctccctggacttgacctctgtgaccgccgcagacacggctgtatattcctgtgcgacccagggaggggatcggaccccaaatctgccttactttcgaccacgtggggccagggtaaccttggtcaccgtctcctcacgccctccaccgaacgggccctatccggtccttcccccgtggcccgtccctcgcctccgaggcgccacctcggagacgcacgacggccggcccgtgggcctcgccgtgggtaccaaacggtaccttaccgttcctagtccgcgtaacgctggacggcgggtcgtacggacgaacgggcgacgtagtagcnncgnnnnnnnnnnnnnnnnnnnnnnnn

SEQ ID NO: 220149 - DNA, 779 bp, Homo sapiens
  misc_feature: GYAE6OF02GY88Q.40.27.C05.1.454.CMB.1.raw
  modified_base (195)..(195): a, c, t, g, unknown or other
  misc_feature (195)..(195): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagcccaccctcagcgtctgacgacccccgggnagcaggttaccgtctcttgttctggaagcagctaccaacagtaccggaagttaacttcgtgttatacgtggtaccagtcgccctaccaggaaccggcccccaaacttctcgtctagtagggattactcgagccggtcccgttacggggtccctcgaccgtattctctggcctccgaggtcgtggccacctcacgtccctcccgtggccacgtccgaggtcgggcccgtcccgggcccggaagggacgtcgggacgggtacgtaacttttaagtttacgtttggtggtttcgtcgtaaggtcggggtaattcggtaacgagtaaagttaggtaaaggtttccggggttaccgggttacgggtttaccgggggacggggtaaccgggggaacctacgggggtaccgttacccgggtaacccgggttccgttaacgggtacccgtacgggacccccggtaagggtccccgttcccgggacccccccggtttacgggtacccgttaacccgtttcccggtttcccccgggtttccccccgttacccccgtttcccgtaacccggttcgggttaccccgttaacccggg

SEQ ID NO: 220150 - DNA, 619 bp, Homo sapiens
  misc_feature: GYAE6OF02GTQES.40.27.C05.1.454.CMB.1.raw
  modified_base (194)..(194): a, c, t, g, unknown or other
  misc_feature (194)..(194): n is a, c, g, or t
tcagtctagcgactcacgaccggtgctcgatttagacgcgatcgaagggtttggggggtggagaagacaggattcaggccaatctccagcatggccggcttccctctcctcctcaccctcctcactcactgtgcagggtcctgggcccagtctgtgctgactcagccaccctcagcgtctgacgacccccgggnagcaggttaccgtctcttgtctggaagcagctccaacatcggaagtaattctgtatactggtaccagtgccctcccgacggaaccgccccctaaacttctcgtctataggattatcacgcggtcccgttaggggtccctgaccgtattctctggctccgacggtctcggccacctcacgtcccctcccgtcggcctatcgaggtcgggcctcccgggcccgaggagtcggacggcggtattatttagtgtgtgtcgtagtggactgaacgagaagtagagttcggtccggttggttcggcgggtacggacgtacggcgtcgaccgttcgtacggtcgacgccgaacggtccgtcggcccccgttcggtccctaccgttccgttacccggttccccgtcccttcccgtacgtccggttccgtaccg

SEQ ID NO: 220151 - DNA, 584 bp, Homo sapiens
  misc_feature: GYAE6OF02HW0QZ.40.27.C05.1.454.CMB.1.raw
  modified_base (555)..(555): a, c, t, g, unknown or other
  misc_feature (555)..(555): n is a, c, g, or t
  modified_base (557)..(560): a, c, t, g, unknown or other
  misc_feature (557)..(560): n is a, c, g, or t
  modified_base (564)..(564): a, c, t, g, unknown or other
  misc_feature (564)..(564): n is a, c, g, or t
  modified_base (567)..(571): a, c, t, g, unknown or other
  misc_feature (567)..(571): n is a, c, g, or t
  modified_base (573)..(584): a, c, t, g, unknown or other
  misc_feature (573)..(584): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaaccccccccctctacaaccccctccctcaagagtcgggtcaccatatctatagacacgtccaacagtcaattcctccctggacttgacctctgtgaccgccgcagacacggctgtatattcctgtgccgacccacgggaggggatcggacccccaaaatctcgcctacttttgacctacgtggggccagggaaccttggtccacccgtctcctcacgccctcccacgaacgggccccatccggtcccttcccccgtggcccgtcccctcgcctcccgaggacgccaccctccggagacgccacgcggccgggccccgtggggcctgccgttcggtacgaacgggtccttaaccgttccgaacgttccggaccttacggactacggacgggtccgggcgtagggcgaacgggccgacgagtacggncnnnngcangcnnnnncnnnnnnnnnnnn

SEQ ID NO: 220152 - DNA, 488 bp, Homo sapiens
  misc_feature: GYAE6OF02FWB1H.40.27.C05.1.454.CMB.1.raw
  modified_base (141)..(141): a, c, t, g, unknown or other
  misc_feature (141)..(141): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (460)..(461): a, c, t, g, unknown or other
  misc_feature (460)..(461): n is a, c, g, or t
  modified_base (464)..(469): a, c, t, g, unknown or other
  misc_feature (464)..(469): n is a, c, g, or t
  modified_base (471)..(488): a, c, t, g, unknown or other
  misc_feature (471)..(488): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaacccccccctntacaacccctccctcaagagtcgggtcaccatatctatagacacgtccaacagtcaattctccctggacttgaccctctgtgaccgccgcagacacggctgtatattcctgtgccgacccacgggaggggatggcccccaaatctgcctactttgaccactggggccagggaccttggtcaccggtctcctcagcctcaccaggcccatcgtctcccngcncctgctcnggncacctccgagcgcacagccggcccgtgggctgcctggtcaaggctacttccagtcgctagctgagcgggctggacaggcgcagtagnngtnnnnnncnnnnnnnnnnnnnnnnnn

SEQ ID NO: 220153 - DNA, 564 bp, Homo sapiens
  misc_feature: GYAE6OF02HXTGS.40.27.C05.1.454.CMB.1.raw
  modified_base (399)..(399): a, c, t, g, unknown or other
  misc_feature (399)..(399): n is a, c, g, or t
  modified_base (535)..(547): a, c, t, g, unknown or other
  misc_feature (535)..(547): n is a, c, g, or t
  modified_base (553)..(564): a, c, t, g, unknown or other
  misc_feature (553)..(564): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacgggaggggatcggccccaaatctgcctactttcgaccacgtcggggccagggtaaccttggtccaccgtctcctcacgccctccaccgaacgggcccagtccggtccttcccccgtggccgccctgcctccgaggcnccacctccgagacgcacgacggccggcccgtggggcctcggcccgtcgggtaccgtaacggtaccttaccgttccgacggttccgcgttaacgacgtcggaggccgggtctacgggacgaacgggcgacgagtagnnnnnnnnnnnnngggggnnnnnnnnnnnn

SEQ ID NO: 220154 - DNA, 716 bp, Homo sapiens
  misc_feature: GYAE6OF02IBVBV.40.27.C05.1.454.CMB.1.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (238)..(238): a, c, t, g, unknown or other
  misc_feature (238)..(238): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (677)..(677): a, c, t, g, unknown or other
  misc_feature (677)..(677): n is a, c, g, or t
  modified_base (691)..(691): a, c, t, g, unknown or other
  misc_feature (691)..(691): n is a, c, g, or t
tcagtctagcgactcacgaccggtgctcgatttagacgcgatcgaagggtttggggctgggtccgccggccccagggaaggggctggagtggattgcgagcatatattaatgatgagagcgccctctacaaccccccctntacaaccctcctcaagngtcgggtcaccatatctaatagacacgtccaaactagtcaaattcctccctggacttgaccttctgtgacccgcgcagacncggctgtatagttcctgtacgcgtacccgaggacggggactacggacccctaaagttcgtaccgaccttacgtttacgaacctacggtcgggtaccgagggtaacccgttggtaccacccggttacctccgttacgaccgtccctaccgaaaccgaaccgggtccctaagtcccgggttcccttacccccggtggaccctccgtagtaccctccggaagggaccgtcctaaccgtacggaacgacgtccgaacaaccgggtccggcccgttaagggtcctcggtaccgttacggtaccgaaacggttacctaaccgttaccggagttcccgtaacggttaacggtacgtacgggacggtccggtcggtacgacggtaacggctacgtaacgtgacngtacgntagcgtacgcgtgtcgacgtactcggacgagttccgngtaacgcgttacgngtaacctcggtactaccgtgtaacg

SEQ ID NO: 220155 - DNA, 694 bp, Homo sapiens
  misc_feature: GYAE6OF02J21F7.40.27.C05.1.454.CMB.1.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
tcagtctagcgactcacgaccggtgctcgatttagacgcgatcgaagggtttggggctgggtccgccggccccagggagggctggagtggattgcgagcatatattatgatgagagcgtccctctacccaaccccccctctaccaacccctcctacaagtacggtcggtaccaccatatactanacgacaccgtaccaacntacaacttcctcccgtaggacttcgacctctggacgaccgcgacacgacgacgctatatacttcngtcgaccgaccgacgggagggactcggaaccctaagtcctacgccttacgttacgacccgtaggtcggggtacctacgggtacccttggccctacccggtctctaacgcgtacccacgacgaacggccctaggtccgtaccctcccgtggcctcccggtagaccgcgtaacgccgaccgttaaccgccgaaagttacccggcttaaaccggccgggtacccggttcccgggagggtcccttacggccgtttaacggaccgttaacgtacgtacccgtacggtaacgtccggtaactacggtacgtaccggcggacgtaccggtacgacggtacgcgaacactcggntacngttacacgtctacgcgacgtacgtacgacgacgacgacactactacgtacgtacgacgtacgacgactacgtactacg

SEQ ID NO: 220156 - DNA, 777 bp, Homo sapiens
  misc_feature: GYAE6OF02I8LZS.40.27.C05.1.454.CMB.1.raw
  modified_base (179)..(179): a, c, t, g, unknown or other
  misc_feature (179)..(179): n is a, c, g, or t
  modified_base (686)..(686): a, c, t, g, unknown or other
  misc_feature (686)..(686): n is a, c, g, or t
  modified_base (717)..(717): a, c, t, g, unknown or other
  misc_feature (717)..(717): n is a, c, g, or t
tcagtctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctacaagagtcggtcaccatatctanagacacgtccaacagtcaattcctcccgtaggacttgaccttctgtacgaccgccgcagaacgcggtctgttaactacttcctgtacgaccgacccgagggaaggggtactcggacccctaaatcgtgaccctttattcgaaccgtacgtggggaccgaacgggaacccgttggtaccacgttccttacctcaacgtcccttacccaaccggaaccgggtcccaacgtttccggttcccccttttacccccgcggggtaccccgttcccctacggtccctaacccggtaaaccggctacccgtaacccgtaacccgggaacgtaacgacaaccgaccggccccgggttacccgtacggggccttccggttacccgtacgggaacccggttaaacggaaccctttaacgttcccggttaacgttacccggtactaacgggaccttacggaccgggaccggggtcggtaccgtaaacggggtaacggcccgtacgaaaggtttaccggnacgtagtctaaggtccgtagtacccgagtanacgacgtacgacgacgtagtagtacgacgtaacgacggtagtacgtacgtagtacgtacg

SEQ ID NO: 220157 - DNA, 881 bp, Homo sapiens
  misc_feature: GYAE6OF02HVWGQ.40.27.C05.1.454.CMB.1.raw
  modified_base (180)..(180): a, c, t, g, unknown or other
  misc_feature (180)..(180): n is a, c, g, or t
tcagtctagcgactcacgaccggtgctcgatttagacgcgatcgaagggtttgggggggtggagaagacaggattcaggccaatctccagcatggccggcttccctctcctcctcaccctcctcactcactgtgcagggtcctgggccccagtctgtgctgacctcgacgccctaccctnagccgtctggaccgacccccgggagcctacggttcctctcgtttgttacgtaggaagcagtcctaccaaacgtagtaccgggtaaattacttctgttaataccgttacggtacctagtccgcccctaccgaacgggaaccccggtacccccctaaacgttcctcgttacttaaggtacggtaatttacgtacgacggcccggttaccccggttccgggttccccgtaggaaccccttgttcctcggttaccggccttaccggtaggtccgtcggccctacctcgaccgtcccctccggtcggaccctagtacgagggttcccggccgtacccgggcccggtaaggacgtacgggacgggtacgttaacgttttagtttaaggttcgttagggtgttacggtaggttagggtaatcggaaggttaaacgtaacgggttaaggtaacggtttcggggtttacccgggtttagggtttacccggggacgggggtaaccggggtaaccgtacggggttacccgggttaacccggtttacccggggttaccgttaaccgggtacccgacccggtaacccgggtaccggtacccggttcccccgttcccccggttccgtaccgttacccgttttccccgggttaccccgtttaccccccggttaccccttaccccgggtttacccgtaccgggttccgtaacccggg

SEQ ID NO: 220158 - DNA, 680 bp, Homo sapiens
  misc_feature: GYAE6OF02FK3WP.40.27.C05.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (427)..(427): a, c, t, g, unknown or other
  misc_feature (427)..(427): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
  modified_base (521)..(521): a, c, t, g, unknown or other
  misc_feature (521)..(521): n is a, c, g, or t
tcagtctagcgactcacgaccggtgctcgatttagacgcgatcgaagggtttgggggggtggagaagacaggattcaggccaatctccagcatggccggcttccctctcctcctcaccctcctcactcactgtgcgagggtcctgggcccagtctgtgctggactcacgccctaccctgagtcgtctggaccggacccccggnaggccacggtttaccgtcttacgttgttcngggtaacncaggtccttaccgaagtataccgggtaataactttcgtagtaattccgtacggtacgtagtaccgcccgtccgaacggtaacccggaccccctaaacgttcctcgttacttaaggtacggtacttacgtacgcgtccggtaccggttaccggtccgtgaccggtacttctacgtcggtacctccgnggtcctggtccaccgtcacgtccctccgtagcctagcaggtcggcctccgggccgaggtcgaggngngtattacgtntgtgtgtcgtagtaggngagtagtagtagtagtagtacgggtcgttccggtcggcggacggccgtagtcggtacgtaccggttcgtaccgtagtacgccgaacgggctacccggtcccgtcggttactacccgtcggttaccccgttccctaccgttccgacgtcgtacgttacgg

SEQ ID NO: 220159 - DNA, 848 bp, Homo sapiens
  misc_feature: GYAE6OF02H5U4D.40.27.C05.1.454.CMB.1.raw
  modified_base (215)..(215): a, c, t, g, unknown or other
  misc_feature (215)..(215): n is a, c, g, or t
tcagtctagcgactcacgaccggtgctcgatttagacgcgatcgaagggtttggggctgggtccgccggccccagggaagggctggagtggattgcgagcatatattatgatgagagcgccctctaccaaccccccctctacaacccctcctcaagagtcggtcaccatatctatagacacgtaccaacagtcaattctccctggacttgacctntgtgaccgcgcagacacggctgtatacgttcctgtcgacgacccgagggaggggtactccggacccctaaaagttcgtacgtccttaacgttttcgacctaacggttcggggaccgtaacggggtaacccgtttcggtaccgtaaccccgtttccgttcccgttaccgaaccgtcccttacccgaacccggaaacgggggtaccccttacggttcccgggttccccgtttcccccggtcggggtccccgtccccgttcggtacccgttcccggaaggttaccggacccttacccggtacccgaacggaaccgtccgaaccgtaccggacccggggttccccggtacggggtccgttacccgggtccgttaccgggtaaacccggaaaccgggtttaacccttaacccgggttttacccgtaacgggttaccccggtaccggtttaaaccgggtaaccggtttacggggaaacccggggttccggggttaaccgggtaccggggttaaccgggaaacggggtacccggtaaccggttaaacggtaacgggtcgtacgtcgtaacgggccgtcgacgtacgtacgtcgtacgcgtacgtacgcgacgtcgtcgcgcgacgcgcgacgacgtagcg

SEQ ID NO: 220160 - DNA, 151 bp, Homo sapiens
  misc_feature: GYAE6OF01EMLCX.51.42.D09.1.454.CMB.1.raw
  modified_base (150)..(151): a, c, t, g, unknown or other
  misc_feature (150)..(151): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnn

SEQ ID NO: 220161 - DNA, 150 bp, Homo sapiens
  misc_feature: GYAE6OF01EKXBC.51.42.D09.1.454.CMB.1.raw
  modified_base (150)..(150): a, c, t, g, unknown or other
  misc_feature (150)..(150): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagn

SEQ ID NO: 220162 - DNA, 153 bp, Homo sapiens
  misc_feature: GYAE6OF01C29TO.51.42.D09.1.454.CMB.1.raw
  modified_base (150)..(153): a, c, t, g, unknown or other
  misc_feature (150)..(153): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnnn

SEQ ID NO: 220163 - DNA, 188 bp, Homo sapiens
  misc_feature: GYAE6OF01BUJEG.51.42.D09.1.454.CMB.1.raw
  modified_base (153)..(188): a, c, t, g, unknown or other
  misc_feature (153)..(188): n is a, c, g, or t
tcagcgatcgtatacacgaccggtgctcgatttagacacatacgcagggaaagggaaggtggaaatcaaacgaactgtggctgcaccatcctgtcttcatcttcccgccatcgtgatcgtagcactctgagcgggctgggcaaggcgcatagnnnnnnnnnnnnnnnnnnnnnnnnnnnnnnnnnnnn

SEQ ID NO: 220164 - DNA, 155 bp, Homo sapiens
  misc_feature: GYAE6OF01EMZD9.51.42.D09.1.454.CMB.1.raw
  modified_base (150)..(155): a, c, t, g, unknown or other
  misc_feature (150)..(155): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnnnnn

SEQ ID NO: 220165 - DNA, 152 bp, Homo sapiens
  misc_feature: GYAE6OF01D9BCT.51.42.D09.1.454.CMB.1.raw
  modified_base (150)..(152): a, c, t, g, unknown or other
  misc_feature (150)..(152): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnn

SEQ ID NO: 220166 - DNA, 151 bp, Homo sapiens; identical to SEQ ID NO: 220160
  misc_feature: GYAE6OF01CLSLO.51.42.D09.1.454.CMB.1.raw
  modified_base (150)..(151): a, c, t, g, unknown or other
  misc_feature (150)..(151): n is a, c, g, or t

SEQ ID NO: 220167 - DNA, 150 bp, Homo sapiens; identical to SEQ ID NO: 220161
  misc_feature: GYAE6OF01CMSZQ.51.42.D09.1.454.CMB.1.raw
  modified_base (150)..(150): a, c, t, g, unknown or other
  misc_feature (150)..(150): n is a, c, g, or t

SEQ ID NO: 220168 - DNA, 164 bp, Homo sapiens
  misc_feature: GYAE6OF01AY9GB.51.42.D09.1.454.CMB.1.raw
  modified_base (150)..(164): a, c, t, g, unknown or other
  misc_feature (150)..(164): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnnnnnnnnnnnnnn

SEQ ID NO: 220169 - DNA, 208 bp, Homo sapiens
  misc_feature: GYAE6OF01BX9II.51.42.D09.1.454.CMB.1.raw
  modified_base (136)..(136): a, c, t, g, unknown or other
  misc_feature (136)..(136): n is a, c, g, or t
  modified_base (152)..(152): a, c, t, g, unknown or other
  misc_feature (152)..(152): n is a, c, g, or t
  modified_base (158)..(208): a, c, t, g, unknown or other
  misc_feature (158)..(208): n is a, c, g, or t
tcagcgatcgtatacacgaccggtgctcgatttagacacatacgcaggggaaagggaaggtggaaatcaaacgaactggtggctgcaccatctgtcttcgactcttcccgccatctggatccgtagcactctggancgggctggccaaggcncatagnnnnnnnnnnnnnnnnnnnnnnnnnnnnnnnnnnnnnnnnnnnnnnnnnnn

SEQ ID NO: 220170 - DNA, 118 bp, Homo sapiens
  misc_feature: GYAE6OF01BF40G.51.42.D09.1.454.CMB.1.raw
  modified_base (118)..(118): a, c, t, g, unknown or other
  misc_feature (118)..(118): n is a, c, g, or t
tcagcgatcgtatacacgaccggtgctcgatttagacacatacgcagggaaagggcagcgtcactctgttcccaccctcctctcgtagcactctgagcgggctggcaaggcgcatagn

SEQ ID NO: 220171 - DNA, 171 bp, Homo sapiens
  misc_feature: GYAE6OF01DUH0E.51.42.D09.1.454.CMB.1.raw
  modified_base (151)..(171): a, c, t, g, unknown or other
  misc_feature (151)..(171): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggctaaggcgcatagnnnnnnnnnnnnnnnnnnnnn

SEQ ID NO: 220172 - DNA, 118 bp, Homo sapiens; identical to SEQ ID NO: 220170
  misc_feature: GYAE6OF01DTTOH.51.42.D09.1.454.CMB.1.raw
  modified_base (118)..(118): a, c, t, g, unknown or other
  misc_feature (118)..(118): n is a, c, g, or t

SEQ ID NO: 220173 - DNA, 150 bp, Homo sapiens; identical to SEQ ID NO: 220161
  misc_feature: GYAE6OF01B0FL2.51.42.D09.1.454.CMB.1.raw
  modified_base (150)..(150): a, c, t, g, unknown or other
  misc_feature (150)..(150): n is a, c, g, or t

SEQ ID NO: 220174 - DNA, 122 bp, Homo sapiens
  misc_feature: GYAE6OF01AXOCN.51.42.D09.1.454.CMB.1.raw
  modified_base (118)..(122): a, c, t, g, unknown or other
  misc_feature (118)..(122): n is a, c, g, or t
tcagcgatcgtatacacgaccggtgctcgatttagacacatacgcagggaaagggcagcgtcactctgttcccaccctcctctcgtagcactctgagcgggctggcaaggcgcatagnnnnn

SEQ ID NO: 220175 - DNA, 159 bp, Homo sapiens
  misc_feature: GYAE6OF01B6B06.51.42.D09.1.454.CMB.1.raw
  modified_base (151)..(159): a, c, t, g, unknown or other
  misc_feature (151)..(159): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctggagcgggctggcaaggcgcatagnnnnnnnnn

SEQ ID NO: 220176 - DNA, 151 bp, Homo sapiens; identical to SEQ ID NO: 220160
  misc_feature: GYAE6OF01ACPR1.51.42.D09.1.454.CMB.1.raw
  modified_base (150)..(151): a, c, t, g, unknown or other
  misc_feature (150)..(151): n is a, c, g, or t

SEQ ID NO: 220177 - DNA, 156 bp, Homo sapiens
  misc_feature: GYAE6OF01DB2J4.51.42.D09.1.454.CMB.1.raw
  modified_base (150)..(156): a, c, t, g, unknown or other
  misc_feature (150)..(156): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnnnnnn

SEQ ID NO: 220178 - DNA, 136 bp, Homo sapiens
  misc_feature: GYAE6OF01C6FPQ.51.42.D09.1.454.CMB.1.raw
  modified_base (118)..(136): a, c, t, g, unknown or other
  misc_feature (118)..(136): n is a, c, g, or t
tcagcgatcgtatacacgaccggtgctcgatttagacacatacgcagggaaagggcagcgtcactctgttcccaccctcctctcgtagcactctgagcgggctggcaaggcgcatagnnnnnnnnnnnnnnnnnnn

SEQ ID NO: 220179 - DNA, 183 bp, Homo sapiens
  misc_feature: GYAE6OF01CG1FV.51.42.D09.1.454.CMB.1.raw
  modified_base (149)..(183): a, c, t, g, unknown or other
  misc_feature (149)..(183): n is a, c, g, or t
tcagcgatcgtatacacgaccggtgctcgatttagacacatacgcgagggaaggaaggtggaaatcaaacgaactgtggctgcaccatctgtcttcatcttcccgccatctgatcgtagcactctgagcgggctggcaaggcgcatagnnnnnnnnnnnnnnnnnnnnnnnnnnnnnnnnnnn

SEQ ID NO: 220180 - DNA, 158 bp, Homo sapiens
  misc_feature: GYAE6OF01BCIK3.51.42.D09.1.454.CMB.1.raw
  modified_base (150)..(158): a, c, t, g, unknown or other
  misc_feature (150)..(158): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnnnnnnnn

SEQ ID NO: 220181 - DNA, 117 bp, Homo sapiens
  misc_feature: GYAE6OF01BNSJ6.51.42.D09.1.454.CMB.1.raw
tcagcgatcgtatacacgaccggtgctcgatttagacacatacgcagggaaagggcagcgtcactctgttcccaccctcctctcgtagcactctgagcgggctggcaaggcgcatag

SEQ ID NO: 220182 - DNA, 150 bp, Homo sapiens; identical to SEQ ID NO: 220161
  misc_feature: GYAE6OF01APSLW.51.42.D09.1.454.CMB.1.raw
  modified_base (150)..(150): a, c, t, g, unknown or other
  misc_feature (150)..(150): n is a, c, g, or t

SEQ ID NO: 220183 - DNA, 118 bp, Homo sapiens
  misc_feature: GYAE6OF01CEXW0.51.42.D09.1.454.CMB.1.raw
  modified_base (118)..(118): a, c, t, g, unknown or other
  misc_feature (118)..(118): n is a, c, g, or t
tcagcgatcgtatacacgaccggtgctcgatttagacacatacgcagggaaagggcagcgtcactctgttcccgccctcctctcgtagcactctgagcgggctggcaaggcgcatagn

SEQ ID NO: 220184 - DNA, 160 bp, Homo sapiens
  misc_feature: GYAE6OF01D11D5.51.42.D09.1.454.CMB.1.raw
  modified_base (151)..(160): a, c, t, g, unknown or other
  misc_feature (151)..(160): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggctaaggcgcatagnnnnnnnnnn

SEQ ID NO: 220185 - DNA, 152 bp, Homo sapiens; identical to SEQ ID NO: 220165
  misc_feature: GYAE6OF01E3SEB.51.42.D09.1.454.CMB.1.raw
  modified_base (150)..(152): a, c, t, g, unknown or other
  misc_feature (150)..(152): n is a, c, g, or t

SEQ ID NO: 220186 - DNA, 157 bp, Homo sapiens
  misc_feature: GYAE6OF01AFH5S.51.42.D09.1.454.CMB.1.raw
  modified_base (150)..(157): a, c, t, g, unknown or other
  misc_feature (150)..(157): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggcaaggcgcatagnnnnnnnn

SEQ ID NO: 220187 - DNA, 151 bp, Homo sapiens
  misc_feature: GYAE6OF02IC1I8.51.42.D09.1.454.CMB.1.raw
  modified_base (148)..(151): a, c, t, g, unknown or other
  misc_feature (148)..(151): n is a, c, g, or t
tcagcgatcgtatacacgaccggtgctcgatttagacacatacgcagggaagggaaggtggaatcaaacgaactgtggctgcaccatctgtcttcatcttcccgccatctgatcgtagcactctgagcgggctggcaaggcgcatagnnnn

SEQ ID NO: 220188 - DNA, 149 bp, Homo sapiens
  misc_feature: GYAE6OF02H7CB8.51.42.D09.1.454.CMB.1.raw
  modified_base (148)..(149): a, c, t, g, unknown or other
  misc_feature (148)..(149): n is a, c, g, or t
tcagcgatcgtatacacgaccggtgctcgatttagacacatacgcagggaagggaaggtggaatcaaacgaactgtggctgcaccatctgtcttcatcttcccgccatctgatcgtagcactctgagcgggctggcaaggcgcatagnn

SEQ ID NO: 220189 - DNA, 162 bp, Homo sapiens
  misc_feature: GYAE6OF02GA57E.51.42.D09.1.454.CMB.1.raw
  modified_base (147)..(162): a, c, t, g, unknown or other
  misc_feature (147)..(162): n is a, c, g, or t
tcagcgatcgtatacacgaccggtgctcgatttagacacatacgcgagggaaggaaggtggaatcaaacgaactgtggctgcaccatctgtcttcatcttcccgccatctgatcgtagcatctgagcgggctggcaaggcgcatagnnnnnnnnnnnnnnnn

SEQ ID NO: 220190 - DNA, 151 bp, Homo sapiens; identical to SEQ ID NO: 220160
  misc_feature: GYAE6OF02H0NY6.51.42.D09.1.454.CMB.1.raw
  modified_base (150)..(151): a, c, t, g, unknown or other
  misc_feature (150)..(151): n is a, c, g, or t

SEQ ID NO: 220191 - DNA, 149 bp, Homo sapiens
  misc_feature: GYAE6OF02G6FHI.51.42.D09.1.454.CMB.1.raw
  modified_base (149)..(149): a, c, t, g, unknown or other
  misc_feature (149)..(149): n is a, c, g, or t
tcagcgatcgtatacacgaccggtgctcgatttagacacatacgcagggaaagggaaggtggaatcaaacgaactgtggctgcaccatctgtcttcatcttcccgccatctgatcgtagcactctgagcgggctggcaaggcgcatagn

SEQ ID NO: 220192 - DNA, 116 bp, Homo sapiens
  misc_feature: GYAE6OF02F821Q.51.42.D09.1.454.CMB.1.raw
  modified_base (96)..(96): a, c, t, g, unknown or other
  misc_feature (96)..(96): n is a, c, g, or t
tcagcgatcgtatacacgaccggtgctcgatttagacacatacgcagggaaagggcagcgtcactctgttcccgcctcctctcgtagcactctgancgggctggcaaggcgcatag

SEQ ID NO: 220193 - DNA, 116 bp, Homo sapiens
  misc_feature: GYAE6OF02JE3TI.51.42.D09.1.454.CMB.1.raw
  modified_base (116)..(116): a, c, t, g, unknown or other
  misc_feature (116)..(116): n is a, c, g, or t
tcagcgatcgtatacacgaccggtgctcgatttagacacatacgcagggaagggcagcgtcactctgttcccgcctcctctcgtagcactctgagcgggctggcaaggcgcatagn

SEQ ID NO: 220194 - DNA, 151 bp, Homo sapiens; identical to SEQ ID NO: 220160
  misc_feature: GYAE6OF02IZ2R0.51.42.D09.1.454.CMB.1.raw
  modified_base (150)..(151): a, c, t, g, unknown or other
  misc_feature (150)..(151): n is a, c, g, or t

SEQ ID NO: 220195 - DNA, 157 bp, Homo sapiens; identical to SEQ ID NO: 220186
  misc_feature: GYAE6OF02HG237.51.42.D09.1.454.CMB.1.raw
  modified_base (150)..(157): a, c, t, g, unknown or other
  misc_feature (150)..(157): n is a, c, g, or t

SEQ ID NO: 220196 - DNA, 118 bp, Homo sapiens; identical to SEQ ID NO: 220170
  misc_feature: GYAE6OF02IVC4U.51.42.D09.1.454.CMB.1.raw
  modified_base (118)..(118): a, c, t, g, unknown or other
  misc_feature (118)..(118): n is a, c, g, or t

SEQ ID NO: 220197 - DNA, 150 bp, Homo sapiens; identical to SEQ ID NO: 220161
  misc_feature: GYAE6OF02GHI9B.51.42.D09.1.454.CMB.1.raw
  modified_base (150)..(150): a, c, t, g, unknown or other
  misc_feature (150)..(150): n is a, c, g, or t

SEQ ID NO: 220198 - DNA, 149 bp, Homo sapiens; identical to SEQ ID NO: 220191
  misc_feature: GYAE6OF02FY3JS.51.42.D09.1.454.CMB.1.raw
  modified_base (149)..(149): a, c, t, g, unknown or other
  misc_feature (149)..(149): n is a, c, g, or t

SEQ ID NO: 220199 - DNA, 150 bp, Homo sapiens; identical to SEQ ID NO: 220161
  misc_feature: GYAE6OF02IIJVQ.51.42.D09.1.454.CMB.1.raw
  modified_base (150)..(150): a, c, t, g, unknown or other
  misc_feature (150)..(150): n is a, c, g, or t

SEQ ID NO: 220200 - DNA, 158 bp, Homo sapiens
  misc_feature: GYAE6OF02GHX2Z.51.42.D09.1.454.CMB.1.raw
  modified_base (151)..(158): a, c, t, g, unknown or other
  misc_feature (151)..(158): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctgggcaaggcgcatagnnnnnnnn

SEQ ID NO: 220201 - DNA, 151 bp, Homo sapiens; identical to SEQ ID NO: 220160
  misc_feature: GYAE6OF02HLNLM.51.42.D09.1.454.CMB.1.raw
  modified_base (150)..(151): a, c, t, g, unknown or other
  misc_feature (150)..(151): n is a, c, g, or t

SEQ ID NO: 220202 - DNA, 165 bp, Homo sapiens
  misc_feature: GYAE6OF02FTTPN.51.42.D09.1.454.CMB.1.raw
  modified_base (152)..(165): a, c, t, g, unknown or other
  misc_feature (152)..(165): n is a, c, g, or t
tcagcgatcgtatacacgaccggtgctcgatttagacacatacgcaggggaaagggaaggtggaaatcaaacgaactgtggctgcaccatctgtcttcatcttcccgccatctgatcgtagccactctgagcgggctggcaaggcgcatagnnnnnnnnnnnnnn

SEQ ID NO: 220203 - DNA, 160 bp, Homo sapiens
  misc_feature: GYAE6OF02HZJVX.51.42.D09.1.454.CMB.1.raw
  modified_base (151)..(160): a, c, t, g, unknown or other
  misc_feature (151)..(160): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgagcgggctggccaaggcgcatagnnnnnnnnnn

SEQ ID NO: 220204 - DNA, 151 bp, Homo sapiens
  misc_feature: GYAE6OF02HWHS2.51.42.D09.1.454.CMB.1.raw
  modified_base (129)..(129): a, c, t, g, unknown or other
  misc_feature (129)..(129): n is a, c, g, or t
  modified_base (150)..(151): a, c, t, g, unknown or other
  misc_feature (150)..(151): n is a, c, g, or t
tcagcgatcgtatacacgaccggtgctcgatttagacacatacgcagggaaagggaaggtggaaatcaaacgaactgtggctgcaccatctgtcttcatcttcccgccatctgatcgtagcactctgancgggctggcaaggcgcatagnn

SEQ ID NO: 220205 - DNA, 157 bp, Homo sapiens
  misc_feature: GYAE6OF02IMCVL.51.42.D09.1.454.CMB.1.raw
  modified_base (153)..(157): a, c, t, g, unknown or other
  misc_feature (153)..(157): n is a, c, g, or t
tcagcgatcgtatacacgaccggtgctcgatttagacacatacgcagggaaagggaaggtggaaatacaaagaaccccctgtggctgcaccatctgtcttcatcttcccgccatctgatcgtagcactctgagcggctggcaaggcgcatagnnnnn

SEQ ID NO: 220206 - DNA, 153 bp, Homo sapiens; identical to SEQ ID NO: 220162
  misc_feature: GYAE6OF02H6UQ8.51.42.D09.1.454.CMB.1.raw
  modified_base (150)..(153): a, c, t, g, unknown or other
  misc_feature (150)..(153): n is a, c, g, or t

SEQ ID NO: 220207 - DNA, 151 bp, Homo sapiens; identical to SEQ ID NO: 220160
  misc_feature: GYAE6OF02HG1MR.51.42.D09.1.454.CMB.1.raw
  modified_base (150)..(151): a, c, t, g, unknown or other
  misc_feature (150)..(151): n is a, c, g, or t

SEQ ID NO: 220208 - DNA, 279 bp, Homo sapiens
  misc_feature: GYAE6OF01DXWZ4.41.37.D04.1.454.CMB.1.raw
  modified_base (221)..(221): a, c, t, g, unknown or other
  misc_feature (221)..(221): n is a, c, g, or t
  modified_base (227)..(279): a, c, t, g, unknown or other
  misc_feature (227)..(279): n is a, c, g, or t
tcagtctatactatcacgaccggtgctcgatttagtagcatactgttggggtttggggggaagaggaagactgacggtcctcccaggagttcgaggtgcgtggggccacctttgggcgacgggggaggtggtgtccacaagtatttgggctctgggcacagcggcctgggctgcctggtcaaggctacttctatatactgtctgagcgggctggcaaggcncatagnnnnnnnnnnnnnnnnnnnnnnnnnnnnnnnnnnnnnnnnnnnnnnnnnnnnn

SEQ ID NO: 220209 - DNA, 626 bp, Homo sapiens
  misc_feature: GYAE6OF01A1AJR.41.37.D04.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
tcagtctatactatcacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtacgggccaggtcggagttgttgactaagtacctagccgtaggtaaccaaacaacgaaaccgtggccgaggcctcccgaggcctcctnatctatgatgcataccaacgngggtcacgtggaccaccccgagactacgggttcaggtggctagggttcgggcgtgggacnggtacctttcactccgtcaccgtnacgactaactgtacgagccgtagaagttagttttcgacgttaagttttattacttgtcgagtcgtacgtccgttacctccgcggtccctcgtccgttacgggtttccggggaccgggggtaacgtagggtcggagtacgtacgtacggaacgacggttcggtaggcgtcgaccaactcgtacttcggttaccttcttccgttccgttccccg

SEQ ID NO: 220210 - DNA, 525 bp, Homo sapiens
  misc_feature: GYAE6OF01AW871.41.37.D04.1.454.CMB.1.raw
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
  modified_base (499)..(499): a, c, t, g, unknown or other
  misc_feature (499)..(499): n is a, c, g, or t
  modified_base (523)..(523): a, c, t, g, unknown or other
  misc_feature (523)..(523): n is a, c, g, or t
tcagtctatactatcacgaccggtgctcgatttagtagcatactgttgggtttgggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgtgacgacgacttagcctggtaccaacagaagcctggccaggctcccagacctcctcatctatgatacttctaggtacgggcctctggcactcccaggcccctcttcaggtggcaggttcggggtctggggactagacttcacttctcaccatcaccagcctagacncctagaagtatttgctagtttatactntactacacgtaagacgtgcctcatattctacgttcgcctggactaagtgatancaaagactgtgcgtgcactntctgttccttcacttcctccgctntc

SEQ ID NO: 220211 - DNA, 660 bp, Homo sapiens
  misc_feature: GYAE6OF01DBMJF.41.37.D04.1.454.CMB.1.raw
  modified_base (148)..(148): a, c, t, g, unknown or other
  misc_feature (148)..(148): n is a, c, g, or t
  modified_base (353)..(353): a, c, t, g, unknown or other
  misc_feature (353)..(353): n is a, c, g, or t
  modified_base (446)..(446): a, c, t, g, unknown or other
  misc_feature (446)..(446): n is a, c, g, or t
  modified_base (545)..(545): a, c, t, g, unknown or other
  misc_feature (545)..(545): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
  modified_base (611)..(611): a, c, t, g, unknown or other
  misc_feature (611)..(611): n is a, c, g, or t
  modified_base (644)..(644): a, c, t, g, unknown or other
  misc_feature (644)..(644): n is a, c, g, or t
  modified_base (651)..(651): a, c, t, g, unknown or other
  misc_feature (651)..(651): n is a, c, g, or t
tcagtctatactatcacgaccggtgctcgatttagtagcatactgttgggtttgggggaggcgtggtccagcccgggaggtccctgagactctcctgtgtagcctcgtgggttctcattcgatagattttggtttgcacgtgggtccnccgaggctccgaggacaagggggccggtagtggggtgcagtcatcgtccgagagtggaagtgaagaagttacttactcgagactccgtaggaaggcctattccaccatctccagacaactaattaccgaagaattatcgcttgttacttgaacaaagtcgaaacagtcgtagagtggttcaacgactacgtcttagtttaatcgngtggacgggtacgggtacctagaaacgggtaacggtttcggaatacgaacttaaaactcgttaatagtttagaaagttggaacttggtacggngggggtaccggagggggttaaccgtcggtaccgaccgttcctcccgttacacgtcccttacccgacgaacccggtcctacgttcgtcccctttccccgnggacccgtcccngtacccncgaagccgtaccacgtcgggacggccacgccgttccgccggtgccgngcgtaaacggtcagttactcgttctatacgtcncgttagngcggtgcgg

SEQ ID NO: 220212 - DNA, 592 bp, Homo sapiens
  misc_feature: GYAE6OF02HV6GN.41.37.D04.1.454.CMB.1.raw
  modified_base (203)..(203): a, c, t, g, unknown or other
  misc_feature (203)..(203): n is a, c, g, or t
tcagtctatactatcacgaccggtgctcgatttagtagcatactgttgggtttgggggaggaactgctcagttaggacccagacggaaccatggaagccccagctcagcttctcttcctcctgctactctggctcccagataccaccggagagattgtgttgacgcagtctccagccaccctgtctttgtctccaggggaaanagccaccctctcctgcagggccagtcagagtgttagcagctacttagcctggtaccaacagaaacctggccaggctccaggctcctcatctatgatgcatccaacagggtcacgtggccacccagacaggttcagtgcaggtgggctgggacagacttcactctcaccgtcagcaatcgtacacgtcctagaagtattttgctagttttattactgttcagtcacgtcgttcccgtcgacggtcccgtcgtacctacggtttccggggaccggggggtaccaaagggttcgggaaggtacgttacgaaggtacccggtaacgttcgggtacggaccgttacggaccctaccgtaacttccgttacggtttcctttacgtactttccccg

SEQ ID NO: 220213 - DNA, 533 bp, Homo sapiens
  misc_feature: GYAE6OF02HOZIP.41.37.D04.1.454.CMB.1.raw
  modified_base (190)..(190): a, c, t, g, unknown or other
  misc_feature (190)..(190): n is a, c, g, or t
  modified_base (303)..(303): a, c, t, g, unknown or other
  misc_feature (303)..(303): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagtctatactatcacgaccggtgctcgatttagtagcatactgttgggtttgggggggtcacaagatgcagcgctctcgggacgtctccaccatggcctgggctctgctgctcctcactctcctcacccaggacacagggtcctgggcccagtctgccctgactcagcctgcctccgtgtctgggtcncctggacagtcagtcaccatctcctgcactggcaccagcagtgacattggtggttataactttgtctcctggtaccaacaccaccaggacaaacgccccaaatcatcatttangatgtcagtaacgcggccctcgacgggtccctgactcgctttctctcggctccaagtctggacaaccgaccggcctcccgtgacccgtctcgtcgggcctccgaggctaggaggatggaggctgacttattcngccttcncatntgcaggtccataggtttctgttcttcggaacgtcgggaacctaggtcaccgtcctacgtcgacgacccgtaacgcccaccctatcg

SEQ ID NO: 220214 - DNA, 703 bp, Homo sapiens
  misc_feature: GYAE6OF02F3JEF.41.37.D04.1.454.CMB.1.raw
  modified_base (200)..(200): a, c, t, g, unknown or other
  misc_feature (200)..(200): n is a, c, g, or t
tcagtctatactatcacgaccggtgctcgatttagtagcatactgttgggtttgggggaggaactgctcagttaggacccagagggaaccatggaagccccagctcagcttctcttcctcctgctactctggctcccagagatcaccggagatattgtgttgacacagtctccaggcaccctgtctttgctccgaggganagagccaccctctccgtgtacgggcctagtcggagttgttgactaagtacctagcctaggtaccaactacgaaacctggccaggcctacccagacctcctacattctatcgaattcttcgtaaggtacgggtcccttgtacggctacctcccgacggtccccgtcttaccgaggttcgactaggttcgggtcgttagggactagtaccgttctactctacacccgtatacccacgtacgaccgtaggaccgtccgtagaacgttactttgaccgttagtttataccgttagtacgagtactacgttccgttcccgtacgtacgggtcccgaattacccgttaccgggtttaccggggacccgggggttaaccgaggggttacgaacggtaactccggaacggtaccgtaacgttcgggtaacggtccgtacggtaaccctaccgttacggtttacccgttacgttaccccttacgttaccccgttcccgttacccccgttacg

SEQ ID NO: 220215 - DNA, 770 bp, Homo sapiens
  misc_feature: GYAE6OF02GOF1X.41.37.D04.1.454.CMB.1.raw
  modified_base (205)..(205): a, c, t, g, unknown or other
  misc_feature (205)..(205): n is a, c, g, or t
tcagtctatactatcacgaccggtgctcgatttagtagcatactgttgggtttgggggaggaactgctcagttaggacccagagggaaccatggaagccccagctcagcttctcttcctcctgctactctggcctcccagagatcaccggagatattgtgttgacacagtctccaggccaccctgttctttgtctccgaggggangacgcccaccctctcctggacggccaggtcggagtgtgctaagttacctaggcctggtaaccaacgaacgaaaccgtcggaccgacggcctaccccgaggtcctccctcactctatgatcgctactaccgaacggtcggtacaccgtcggacccaaccccgaggtaaccgtagggttacaggtccggtacgtacggggttcgggtacgtacggggaactacgttaccttaccaacctttccgtaccgacccgttacgaccggtacaacgtttcggaacctacgtccgttaagttaacgttacgttttcgtacgtttaacgttttacgttacgttagttaccaggttccgtaccgtttacccgtttcccgacccgggtacgtccccgttacgttacccgggtttaccgggttccgggggggaaccccgggggtaaacacgggggttaacggtacgttaaccgtacggaacggtaaccggttaacggttcgggtaaccggttccacggtaacccgtcgttacgtttcgttcgtttaaccccttgtaccccgtttaccccgttcccgg

SEQ ID NO: 220216 - DNA, 573 bp, Homo sapiens
  misc_feature: GYAE6OF01C886X.30.33.C11.1.454.CMB.1.raw
  modified_base (517)..(517): a, c, t, g, unknown or other
  misc_feature (517)..(517): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttaggggtcgactcaccctgcccgattaacgttggacaggaacccttggtcttccggcgagcgggcttttcacccgtctttatcgttacttatgtcagcattcgctacttctgatacctccagcatcgcctcacagcacaccttcacagcttacacgaacgcctcccctaaccaacaacgcaataacgcgtcgctcgccgcacgcttcggngcagttcggttacgtccccgttacactccttccgcgcgaggcccgcgtccgaaccg

SEQ ID NO: 220217 - DNA, 656 bp, Homo sapiens
  misc_feature: GYAE6OF01C6EHE.30.33.C11.1.454.CMB.1.raw
  modified_base (419)..(419): a, c, t, g, unknown or other
  misc_feature (419)..(419): n is a, c, g, or t
tcagcacgctacgtcacgaccggtgctcgatttagagtgagctcgttgggtttggggtacgatttgatgttacctgatgcttagaggtcttttcctggaagcgagggctatttgttgcttcagccaccgtagtcgcctcgtcatcacgcctcagtccttgtacttttccggatttcgcctaggaaaaccagcctacacgtaccgttaaaaccgggacaaccgtccgcccggaccaaacatacgcccttcctccccgttccccccttcgcaagtaaccaccaagtacaaggaattacttaacctcgttccatcgactaccgtcctttcggcctcgtccgttaggggtccactcaccctcgcccgtatttacgtgacacggtaccttggtccttccggcgagtcgggtctttcgacccgtnttactcgttacttagtcgtcagctattccgctacttctagtactacctcagcacgtcgcctacacacgcactaccttcacgtacggtcttaacgacgaccgtccctacccctaaccaacacgacagtaacgcgtcgctcgccgcgacgtccgttcggctacgtacgttcggttacccgtacccgtttacaccgttccgttacccggcgtaccgacgggtccctacgtccgtaaccgg

SEQ ID NO: 220218 - DNA, 569 bp, Homo sapiens
  misc_feature: GYAE6OF01DXD85.30.33.C11.1.454.CMB.1.raw
  modified_base (180)..(180): a, c, t, g, unknown or other
  misc_feature (180)..(180): n is a, c, g, or t
  modified_base (353)..(353): a, c, t, g, unknown or other
  misc_feature (353)..(353): n is a, c, g, or t
  modified_base (496)..(496): a, c, t, g, unknown or other
  misc_feature (496)..(496): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatagccttctccgtcccccttgcagtaacaccaagtacaggaatattaacctgttcccatcgactacgcctttcggcctcgccttaggggtcactcacctgcccgattaacgtgacaggacccttgtctcggngagcggctttcaccgtcttatcgttacttatgtcagcattcgctacttctgactacctcagcatcgcctcacacgcacaccttcacacggtcttacagaacgcctacccctaaccaacaacgcaatacgcgtcgctcgccgcncgtcgtcggtgcgtagttcggtttacgccccgttacacgttccgttccgcgacgacggtcccgacgtcgaccg

SEQ ID NO: 220219 - DNA, 690 bp, Homo sapiens
  misc_feature: GYAE6OF01DAEU8.30.33.C11.1.454.CMB.1.raw
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgatttttccggatttgcctaggaaaaccagcctacacgcttaaaaccgggacaaccgtcgcccggccaacatacgccttcctcccgtccccccttcgcaagtaacaccaagtacaaggaatattaacctgtttcccatcgactacgcctttcggcctcgtccttaggggtcgactcaccctgcccgtattaacgtggacagtaccttggtcttcggcgagcgggtctttcacccgtctttatcgttacttatgtcagctattccgctacttctgactacctccagtcatcgccctacacacgtccacgtaccttacaaccacggtaccttaacgacgaaccgtcccttaccccctaacccaaccaaccgccgtaacgtaaacgtccggtcgaccgtcggtaccccgctacgtccgtttcggtcgtacctaacggttaccgggttttaacccgacccccgttttaacgtaaccgtttcccgtttacccggacccggtaccgtaaccgggtaccccggaccgttacccggtaaacccgg

SEQ ID NO: 220220 - DNA, 658 bp, Homo sapiens
  misc_feature: GYAE6OF01DMYNV.30.33.C11.1.454.CMB.1.raw
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgcttaaaccgggacaaccgtcgcccggacaacatacgccttcctcccgtcccccttcgcagtaacaccaagtacagaatactaactgttcccatcgactacgccttcgcctcgccttaggggcactcacccctgacccgtattaaccgtggacacggaacccttggtcgttccggcgagtccgggtccttttccacccgtctttatcgtttacttatgtcagctattcgctacttctgactacctccaancatcncctacacacacacctaccttacactacggtacttaaccgacgtaaccgtccctacccccaacccaaaccgaaccgactaaactaacggtccgtacgtccgtcggacccgacgtaccggtcttccgggtagccgtacgtttaccggttaccgttaccccgttactaccgttcccgtaccggtccgacggtaccggacccgaccgtccgaaccgg

SEQ ID NO: 220221 - DNA, 866 bp, Homo sapiens
  misc_feature: GYAE6OF01B9FYT.30.33.C11.1.454.CMB.1.raw
  modified_base (661)..(661): a, c, t, g, unknown or other
  misc_feature (661)..(661): n is a, c, g, or t
  modified_base (682)..(682): a, c, t, g, unknown or other
  misc_feature (682)..(682): n is a, c, g, or t
  modified_base (802)..(802): a, c, t, g, unknown or other
  misc_feature (802)..(802): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagtccttgtacgtttttccggattttcggcccttagggaaaaaccctacggcccttaacgaacggtacccgtttaaaaacccgggggaacctaaacccggttccggcccccgggaccaaacctagtaaccggtcccctttccgttcccccgttcccccccctttcggacctaacgttaaaaccaacccgaaacgtaaccgaagggtaaaactttaacgtttaaacccttcggttttaccccaattccggaaccttaccggtcccttttccgggtccccgttccggtacccgtttaacggggggtaccgtaacctcccgtaaccccgttccgacccccgttaaagtttaaccggttcggaaccgtaaccgggtaacccctttcggggttcccgtttccgggcggtaacgggtccgggttaccttttccgaaccccgttcgttttaacgttaccgtttaacttagttcgtacaagtcctacgttccgactacctttcgtacgcttaaccctccganctacgtccgacctaccgaacncgaccctactaccgtttaccacgtacggtaccttacggaccgaaccgtcccttacccccaaccaacctaacgacccgtataaccggtcctacggactcgacccggtcacgtcggtacgtnccgttacgttcggttacgtcccttatctttcccacggtccgacgtaccggctcccgtagaaccg

SEQ ID NO: 220222 - DNA, 898 bp, Homo sapiens
  misc_feature: GYAE6OF01CMVFK.30.33.C11.1.454.CMB.1.raw
  modified_base (191)..(191): a, c, t, g, unknown or other
  misc_feature (191)..(191): n is a, c, g, or t
tcagcacgctacgtcacgaccggtgctcgatttagagtgagctcgttgggtttggggtacgatttgatgttacctgatgcttagaggtcttttcctggaagcagggctatttgttgcttcagccaccgtagtcgcctcgtcatccaccgcctcagtccttgtacttttccggtatttcgcctaggaaaccngtacctacacgaccgttaaaccgggacaacccgtccgcccgacaactactacgtcccttcctccccgttcccccttacgactaacgtaaccaacctaaagtaacgaaggtaaactttaacttaacccgtttcgtttaccccagttaccgtaaccgttaccgttccccgttttccggcccgttccggttacccggtttacgggggtacccaccgttacccctacccccgttccggaacccccgttaagtttaaccggttcgggaaccgtaaccggttaaccccgtttgggttcccgtttacccgggacggttaccggtcccgggtttaccttttacccgaccccggtttacttttacgtttaccgttttacttacgttctactcgtactacgttcctacttaccttctacgtacttacccgtacgagtcctactcgccctacgaacctacgaccctacctacctacgtaaccgtaccgtaccgtaaccaacgtaaccccgtaccccttaacccccaaccgtaaacccgaaccgtaaccgtaaacgtacccgtaccggtccgtacctccggacccgtacgtaccggttccgttaccggacggttacccgttacggttttacccggttacccgttaccctttacccgtccgtttacccgtccccggtaccgtaccggtacccggtccggtaaaccctccgggtaaacccg

SEQ ID NO: 220223 - DNA, 829 bp, Homo sapiens
  misc_feature: GYAE6OF01ARXTM.30.33.C11.1.454.CMB.1.raw
  modified_base (463)..(463): a, c, t, g, unknown or other
  misc_feature (463)..(463): n is a, c, g, or t
  modified_base (514)..(514): a, c, t, g, unknown or other
  misc_feature (514)..(514): n is a, c, g, or t
  modified_base (538)..(538): a, c, t, g, unknown or other
  misc_feature (538)..(538): n is a, c, g, or t
tcagcacgctacgtcacgaccggtgctcgatttagagtgagctcgttgggtttggggtacgatttgatgttacctgatgcttagaggcttttcctggaagcagggcatttgttgtcttcagcaccgtagtcgcctcgtcatcacgcctcagccttgtactttttccggattttcgccttagggaaaaacctacgacctaaccaccgtaccgttaaaacccggggaacaaacccggtccgcccccgggaccaaacataacgccctttcctcccgttccccccttcgacacgtaaccaccaagtacaaggtaataattaacctgtttcccatcgacctacgccttttccggcctcggtaccttaggggtccacgtccaccctcggccccgtagtttaacgttggaactaacggtaacccgttggtccttccgggacgtacgtaccgggtcttttcccacccggtnttttaccgtcgttaactagtacgtctacgtcgtacttcgactacgtttccngtaacttaccctcacacgtctccnccgtaccactacgaccctaaccttacccgtcaaccgacggtacctttaaccaacggtaaaccctccccttacccccgtaaaccaaaccctaaacgaccgtaacttaaacgcccggtaccccgcttaaccggcccccgtaacgtcggttaaccccgtttggggtaccttaccgtaaaccggtttcgggttttaaccccgtcccccggtttaaaacgtcttaacccccggttttccccggaccgtacccgggtaaaccgggtcccctaacccggtttacccgggaaaacccgg

SEQ ID NO: 220224 - DNA, 829 bp, Homo sapiens
  misc_feature: GYAE6OF01A5VAE.30.33.C11.1.454.CMB.1.raw
  modified_base (180)..(180): a, c, t, g, unknown or other
  misc_feature (180)..(180): n is a, c, g, or t
  modified_base (246)..(246): a, c, t, g, unknown or other
  misc_feature (246)..(246): n is a, c, g, or t
tcagcacgctacgtcacgaccggtgctcgatttagagtgagctcgttgggttggggtacgatttgatgttacctgatgcttagaggtctttcctggaagcagggctatttgttgcttcagcaccgtagtgcctcgtcatcacgcctcagccttgtactttccgatttgcctaggaaaccncgcctacacgtacgtaaccggacaaccgtcgcccgccaacactacgtcctcctcccgtccccctcncagtaaccaccaacgtacgaggtaactacttaaccgtcgttaccagtccgactaccggtcctttaccggcccgttaccggtaccggtttacggggtccgaccgttaccaccccgtacgcccccgttaagttaaccggttacgggtaaccgtaaccgggttaacccggtttccggttcccggttaccggggtacgaacggtccgtacggttcctttttacccgaaccccgtttacctttattaccggtttaacttacgttaccggtcaacgtcgtacttccgcttacgttcctgtaacctacccgtacaacgcctacgttaccgaccctcgtaacctaacgacccttaaccgtaacccttaccgaaccgttacggtaaccctttacccgaaaccgttaacccgacccttaaccccctaaacccaaacgacccgtataacccgtaacgtccgtaccgtccggtacgcccgtacgtccggttcgttccggagtactaccgggtttagggttaaccccgttaccccgttaacttaccgttccgtacccgggtaccggtacccgtaccggtacccggtaccctaccgg

SEQ ID NO: 220225 - DNA, 563 bp, Homo sapiens
  misc_feature: GYAE6OF02HUQOA.30.33.C11.1.454.CMB.1.raw
  modified_base (498)..(498): a, c, t, g, unknown or other
  misc_feature (498)..(498): n is a, c, g, or t
  modified_base (520)..(520): a, c, t, g, unknown or other
  misc_feature (520)..(520): n is a, c, g, or t
  modified_base (531)..(531): a, c, t, g, unknown or other
  misc_feature (531)..(531): n is a, c, g, or t
tcagcacgctacgtcacgaccggtgctcgatttagagtgagctcgttggggtttgggtacgatttagatgttaccgtgatgcttagaggcttttccttgaagctacgggcatttgttgacttcagcaccgtagtgccgtcgtcgatacgacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcggggcttttcgacccgctttactcgttacttatgtcagcattcgcacttctgatacctccagcatgcctcacagcacaccttcacaggcttacagaacgctccctaccaacaacgcataancgtcgctgccgcagcttcggtncagtggttacncccgttacatcttcgcgcaggccgactcgacc

SEQ ID NO: 220226 - DNA, 562 bp, Homo sapiens
  misc_feature: GYAE6OF02GXG33.30.33.C11.1.454.CMB.1.raw
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagccggggcttttcgacccgctttactcgttacttatgtcagcattcgcacttctgatacctccagcatgcctcacagcacacttcacaggcttacagaacgctccctaccaacaacgcataacgcgtcgctcgccgcagcttcggtgcagtggtttacnccccgttanactcttccgcgcacggccactcgaacc

SEQ ID NO: 220227 - DNA, 581 bp, Homo sapiens
  misc_feature: GYAE6OF02JX4CR.30.33.C11.1.454.CMB.1.raw
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgctttatcgttacttatgtcagcattcgcacttctgactacctccagcatcgcctcacagcacaccttcacaggcttacacgaacgcctcccctacccaacaacgcactaacgcgtcgctgcccgcacgcttccggtgctacgtcgggtttacgccccgttacactccgttcccgcgtccacggcccgtactccgaacccg

SEQ ID NO: 220228 - DNA, 564 bp, Homo sapiens
  misc_feature: GYAE6OF02F0CXT.30.33.C11.1.454.CMB.1.raw
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttacttatgtcagcattcgcacttctgactacctccagcatcgcctcacngcacaccttcacaggcttacanaacgcctcccctaccaacacgcatacgctcgctgccgcacgcttcggtncagttcggtttacnccccgttanacttcctccgcgcacggccgactcgacg

SEQ ID NO: 220229 - DNA, 657 bp, Homo sapiens
  misc_feature: GYAE6OF02JHUXI.30.33.C11.1.454.CMB.1.raw
  modified_base (494)..(494): a, c, t, g, unknown or other
  misc_feature (494)..(494): n is a, c, g, or t
tcagcacgctacgtcacgaccggtgctcgatttagagtgagctcgttgggtttgggggttacggatttgtatgttacctgatgcttagaggcttttccttggaagcagggcgatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaaacctgtttcccatcgacctacgtccttcggcctccgccttagggtccgactcacctcgccccgattacgttgacaggaaccttgtcgtccggcgagcgggtctttcacccgtctttactccggtttacttatcgtcagctacttcgctacttctgactacctccagccatcgcctcacagctacaccttcaacacggtccttacgacgaaccgtccncccctacccaaccaacacactaagcgttaccgactcgtcccgcacgtccgttaccgggtcgtacctacggttacgggtttttaaccgtcccccggtttaacaaccgtttccgttccccggccggtaccgtaaccggggtccccgtacccgttcccggaacccg

SEQ ID NO: 220230 - DNA, 604 bp, Homo sapiens
  misc_feature: GYAE6OF02HT7TZ.30.33.C11.1.454.CMB.1.raw
  modified_base (382)..(382): a, c, t, g, unknown or other
  misc_feature (382)..(382): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggacccttggtcttccggcgagcgggcttttcacccgtntttatcgttactatgtcagcattcgcacttctgataccctcagcatcgacctcacagcactaccttcacaggcttacacgaacgcctacccctacccaaacacgacataacgcgtccgctcgcccgcacgtccttcgggtcacgtacgttcgggtttaaccgcccccgtttaacgcctttcccgttccgaccgtccgacgggcccgtaccgtccgtaacccg

SEQ ID NO: 220231 - DNA, 611 bp, Homo sapiens
  misc_feature: GYAE6OF02IFVKO.30.33.C11.1.454.CMB.1.raw
  modified_base (497)..(497): a, c, t, g, unknown or other
  misc_feature (497)..(497): n is a, c, g, or t
  modified_base (535)..(535): a, c, t, g, unknown or other
  misc_feature (535)..(535): n is a, c, g, or t
  modified_base (565)..(565): a, c, t, g, unknown or other
  misc_feature (565)..(565): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttagggtcactcacctcgccccgattaacgttggacaggaacccttggtcttccggcgagcgggcttttcacccgtctttactcgtttacttattgtcatcattcgctacttctgacttaccctccagcattcgccctcacagcacaccttcacaggtccttaacacgaacgcctacccctaaccaacaacnccataacgccgtacgcctgcccgacacgtcgttccggngcctacgttcgggtttaccgccccgtttanaccgtttaccgttcccgacgtccgacggacccaccgtccgtaaccg

SEQ ID NO: 220232 - DNA, 638 bp, Homo sapiens
  misc_feature: GYAE6OF02FJ3XD.30.33.C11.1.454.CMB.1.raw
  modified_base (459)..(459): a, c, t, g, unknown or other
  misc_feature (459)..(459): n is a, c, g, or t
  modified_base (575)..(575): a, c, t, g, unknown or other
  misc_feature (575)..(575): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgcttaaaccgggacaaccgtcgcccggcaacatagccttctcccgtccccccttcgcagtaaccaccaagtacaggaatacttaacctgtttcccatccgactaccgcctttcggcctcgtccttagggggtcactcctacccctcgccccgtatttaaccgttggaccacggtaacccttggtccttccggcgaggcgggtctttcgacccgtcttactcgttacttatcgtacagtctattcgctacttctgactacctcagcatcncctcacagcaccaccttcacagtacttacagaaccgccctacccctaaccaacctaaccgcaacgtaagccgtacgcgtcgcccgcacgtcttcggtcactagttcgggtttaccnccccggttaactaccgttaccgttcccgccgtacgaccggtacccgaccgtacccgaacccgg

SEQ ID NO: 220233 - DNA, 388 bp, Homo sapiens
  misc_feature: GYAE6OF02F672L.30.33.C11.1.454.CMB.1.raw
  modified_base (385)..(388): a, c, t, g, unknown or other
  misc_feature (385)..(388): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgtttcccatcgactacgcctttcggcctcgccttagggtcactcaccctgccccgattaacgttggacaggacccttggtcttccggcgagcgggctggcaaggcgcatagnnnn

SEQ ID NO: 220234 - DNA, 604 bp, Homo sapiens
  misc_feature: GYAE6OF02H5DP4.30.33.C11.1.454.CMB.1.raw
  modified_base (563)..(563): a, c, t, g, unknown or other
  misc_feature (563)..(563): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcaccccgtctttatcgtttacttatgtcagcattcgcacttctgacttaccctccagccatcgccctcacagcacctaccttccacaggtccttacagaaccgcctacccctaacccaacaacgcaataacgcgtcgctcgcccgcaacgcgttcggtgctagtcggtttaaccgccccgtttaanactttccgttcccgcgtccgacggcccgtacgtccgaaccg

SEQ ID NO: 220235 - DNA, 614 bp, Homo sapiens
  misc_feature: GYAE6OF02FLDVY.30.33.C11.1.454.CMB.1.raw
  modified_base (180)..(180): a, c, t, g, unknown or other
  misc_feature (180)..(180): n is a, c, g, or t
  modified_base (388)..(388): a, c, t, g, unknown or other
  misc_feature (388)..(388): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatacgccttctcccgtccccccttgcagtaaccaccaagtaccaggaatattaacctgtttcccatcgactacgccttcggcctcgccttaggggtcactcaccctgccccgtattaacgtggacaggaacccttggtccttccggcgagcgggtctttcgacccgtntttatcgttacttatcgtcagtcagttcgactacttctgactacctccagcactcgcctcacacgccactaccttcacaggtccttaacacgtaaccgcctacccctacccaacgaacgcaataacgtcgtccgactcgcccgacacgtccttcggtcacgtacgttcggttaccgcccgttaacgcttcctccggccgtccgacggcccgtacgtaccggaaccg

SEQ ID NO: 220236 - DNA, 625 bp, Homo sapiens
  misc_feature: GYAE6OF02JAPF7.30.33.C11.1.454.CMB.1.raw
  modified_base (512)..(512): a, c, t, g, unknown or other
  misc_feature (512)..(512): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagactttttaggaatattaacctgtttcccatcgactacgcctttcggcctcgccttaggggtcgactcaccctcgcccgattaacgttggacaggaacccttggtcttccggcgagcgggtctttcaccgtcttatcgttacttatctcagctattcgcacttctgtactacctccacgcatcgccctcacagaccactacccttcacacgtacttacacgaaccgcctacccctaacccaaccaacgcaagtaacnccgtcgaccttcgcccgtccagccgtttccgggcacgtacgttcgggtttaaccgccccgtttaatcgttaccttcccggcggtacctacgggcccgtacgtacccggaaccg

SEQ ID NO: 220237 - DNA, 693 bp, Homo sapiens
  misc_feature: GYAE6OF02HW37G.30.33.C11.1.454.CMB.1.raw
  modified_base (413)..(413): a, c, t, g, unknown or other
  misc_feature (413)..(413): n is a, c, g, or t
  modified_base (472)..(472): a, c, t, g, unknown or other
  misc_feature (472)..(472): n is a, c, g, or t
  modified_base (620)..(620): a, c, t, g, unknown or other
  misc_feature (620)..(620): n is a, c, g, or t
tcagcacgctacgtcacgaccggtgctcgatttagagtgagctcgttggggtttgggggtacgatttgatgttacctgatgcttagaggctttttcctggaagcagggcattttgttgcttcagcaccgtagtgcctcgtcatcacgcctcagccttgtatttttccggattttgacctaggaaaaccagcctacacgtacttaaaccgggacaaccgtcgcccgaccaacatacgtccttcctcccgtcccccttcgacacgtaaacaaccaaagtaacaaggtaaattaacttaaccttcgtttacccatcgaacctacgtccctttcggcccttcgtccgtttacgggggtccactccaccctcgaccccgtaattaacgttggacacggtacccttggtcctccggcgngtcgggtctttccgaccgtcttactcgttacttagtcgtcactctatcgtctacttcgngtaccttacctccgagacacgtcgaccctacaacgcaccacctaacctacgaactagtaccttaacgacgtaaccgcccttaacccctacccaaacgaccgacaacgtaacgtccgtacgccgttacgcccgacacgtcgttaccggntacgtacgttcggttaccgtcccttaacgtcgttcccgttaccgccggtacgaccggtccgaccgtccgaccg

SEQ ID NO: 220238 - DNA, 602 bp, Homo sapiens
  misc_feature: GYAE6OF02FTYSS.30.33.C11.1.454.CMB.1.raw
  modified_base (477)..(477): a, c, t, g, unknown or other
  misc_feature (477)..(477): n is a, c, g, or t
tcagcacgctacgtcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaccgggacaaccgtcgcccggccaacatagccttctccgtccccccttgcagtaacaccaagtacaggaatattaacctgtttcccatcgactacgtcctttcggcctcgccttaggggtcgactcaccctgcccgattaacgtggacacggaacccttggtcttccggcgagcgggtcttttcgacccgtctttatcgttacttatgtcagctagttcgctacttctgactcctcagccatcgcctcacagccacaccttcacgacgtcttaacacgaacncctaccccaaccaacaacgcaatacgcgtcgctcgaccgcacgtccgttcggctctacgttcgggttaccgtaccccgttaataccgttccgttccgcgccgacggtcccgtacgtccgaacccg

SEQ ID NO: 220239 - DNA, 738 bp, Homo sapiens
  misc_feature: GYAE6OF02JTJIL.30.33.C11.1.454.CMB.1.raw
  modified_base (542)..(542): a, c, t, g, unknown or other
  misc_feature (542)..(542): n is a, c, g, or t
  modified_base (618)..(618): a, c, t, g, unknown or other
  misc_feature (618)..(618): n is a, c, g, or t
tcagcacgctacgtcacgaccggtgctcgatttagagtgagctcgttgggtttggggtacgatttgatgttacctgatgcttagaggtcttttcctggaagcagggcatttgttgcttcagcaccgtagtgcctcgtcatcacgcctcagtccttgattttccggatttgcctacggaaaaccagcctacacgtacgtaaaccgggacaaccggtcgcccggaccaacatacgccttccgtccccgtcccccttcgcaacgtaacctaccaagtacaggaacttacttaaccttcgttaccactacgactacgtcctttcggccctcgtaccgttgggggtcctactcccgtacccgtcgtaccccgtaagttaaccgttcggaaccgtacgaacccgtttcggtacctttccgggacgtacgggcggtccttttaccgaccccgttatttacgtacgtttaacttcgtacgttcgactcctagttccactacctttacacgttaactaccccgtacgagtaccagtcctacccgtcaaccncgacctacctccttaacaccgtataccgttacgacaaccgccctaccctaaccaccgacactacgacgtccgtacnctaccgcgacctcgttacggttccggcttacgtacggtttacggttaccccgttcccgtaacgttcccttcccggttacccgccggtaccgacccgggtacccttccggtactaaccccg

SEQ ID NO: 220240 - DNA, 144 bp, Homo sapiens
  misc_feature: GYAE6OF01AJALR.19.27.C05.1.454.CMB.1.raw
  modified_base (142)..(144): a, c, t, g, unknown or other
  misc_feature (142)..(144): n is a, c, g, or t
tcagtactctcgtgcacgaccggtgctcgatttagacgcgatcgaagggtttgggggcagggtgtacacctgtggttccctgggctgcctggtcaaggacacttcccacgagagtactgagcgggctggcaaggcgcatagnnn

SEQ ID NO: 220241 - DNA, 142 bp, Homo sapiens
  misc_feature: GYAE6OF02F1CUQ.19.27.C05.1.454.CMB.1.raw
  modified_base (141)..(142): a, c, t, g, unknown or other
  misc_feature (141)..(142): n is a, c, g, or t
tcagtactctcgtgcacgaccggtgctcgatttagacgcgatcgaagggtttgggcagggtgtacacctgtggttccctgggctgcctggtcaaggactacttcccacgagagtactgagcgggctggcaaggcgcatagnn

SEQ ID NO: 220242 - DNA, 170 bp, Homo sapiens
  misc_feature: GYAE6OF02JENXT.19.27.C05.1.454.CMB.1.raw
  modified_base (143)..(170): a, c, t, g, unknown or other
  misc_feature (143)..(170): n is a, c, g, or t
tcagtactctcgtgcacgaccggtgctcgatttagacgcgatcgaagggtttgggggcagggtgtacacctgtggttccctgggctgcctggtcaaggactacttcccacgagagtatgagcgggctggcaaggccgcatagnnnnnnnnnnnnnnnnnnnnnnnnnnnn

SEQ ID NO: 220243 - DNA, 494 bp, Homo sapiens
  misc_feature: GYAE6OF01CSMQC.38.22.B11.1.454.CMB.1.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (467)..(467): a, c, t, g, unknown or other
  misc_feature (467)..(467): n is a, c, g, or t
tcagtcgatcacgtcacgaccggtgctcgatttagacgacagctcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggcctcctcatctatggtncatccaccagggccactggtatcccagccagggtcagtggcagtggtcngggacagagttcactctcaccatcagcagcctgcagtctagaagattttgctagtttattctgtcagtcattacaatttactggtcctctacgtggacgttcggcagggaccaaggtggaaatnaaacgactggtgctgacacatctgttc

SEQ ID NO: 220244 - DNA, 491 bp, Homo sapiens
  misc_feature: GYAE6OF01BD4OI.38.22.B11.1.454.CMB.1.raw
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtgcatccaccagggccactggtatcccagccagggtcagtggcaggtgggtctgggacagagttcactctcaccatcagcagcctgcagtctgaagtatttgctagtttatttctgtcagctattacaattactggtccttcctacgtggacgttcgccgagggaccaggtggaatnaacgactgngctgcacntntgtc

SEQ ID NO: 220245 - DNA, 552 bp, Homo sapiens
  misc_feature: GYAE6OF01D6ZQ2.38.22.B11.1.454.CMB.1.raw
  modified_base (197)..(197): a, c, t, g, unknown or other
  misc_feature (197)..(197): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggctcccaggctcctcatctatggtgcatcccacagggccactggtatcccagccagggtcagtggcagtggtcngggacagngttcactctcacatcagcagcctgcagtctagaagtntttgctagtttatttctgtcagtctatttaacaattacgtacggtccttaccgttacggtggtaccgtttccgggaccgtacgggggtaccctaaagggtcgggtaaaactccgaaaacggtaacgttaggtggacgtcggacctacccagttcgtggttacc

SEQ ID NO: 220246 - DNA, 539 bp, Homo sapiens
  misc_feature: GYAE6OF01ALP9C.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggctcccaggctcctcatctatggtgcatccacgagggccacgtggtactcccagccagggtccagtggcaggtgggtctgggacaggtacgttcacttctcaccatcagcagcctgcagtctgaagtatttgactagtttattcgtgtctagctattactaattacgtcggtaccttccgtacgttcggtaccgttcgggccgaggggtaccgtaaggtacggaaactacgaaacgtacgtacgtaggcctgaccacgtatccgtgtcccg

SEQ ID NO: 220247 - DNA, 540 bp, Homo sapiens
  misc_feature: GYAE6OF01DA9N1.38.22.B11.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccaccctctcctgcagggccagtcagagtgttagcagcaacttgcctggtaccagcagaaacctggccaggcctcccaggcctcctcatctatggtncatcccacagggccactggtactcccagccagggtcagtggcaggtgggtctgggacagagttcactctcaccatcagcagcctgcagtctagaagtattttgacttagtttattctgtcagtctaattacatttactcggtccttacgtacgtcggtacgttcggaccgaggggaccctaagggtacggaaactacgaaaacggtactaggtcgacgtacgactaccgtacttcgtgttacc

SEQ ID NO: 220248 - DNA, 498 bp, Homo sapiens
  misc_feature: GYAE6OF01D8QCE.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccagggtcagtggcagtgggtctgggacagagttcactctcaccatcagcagcctgcagtctgaagtattttgctagtttatttctgtcagtcattacaattctggtcctctacgtggacgttcggccaggggaccaagggtggaaatacgaaacgactgtggctgacacatctgtc

SEQ ID NO: 220249 - DNA, 531 bp, Homo sapiens
  misc_feature: GYAE6OF01C1ZGD.38.22.B11.1.454.CMB.1.raw
  modified_base (287)..(287): a, c, t, g, unknown or other
  misc_feature (287)..(287): n is a, c, g, or t
  modified_base (499)..(499): a, c, t, g, unknown or other
  misc_feature (499)..(499): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaactgggtncgacaggcccctggacaagggcttgagtggatgggatggatcagcgcttacaataataacacacactatgcacagaagttccagggcagagtcaccgtgaccacggacacactccacgacgcacacgcctacagtggagtgaggagcctgagatctagacgacgacggtccgtgtattacgtgtcgcgagacgtacagaattagttgttagnggtactacgtggggacctaggggacccgtcgg

SEQ ID NO: 220250 - DNA, 517 bp, Homo sapiens
  misc_feature: GYAE6OF01BHZ3J.38.22.B11.1.454.CMB.1.raw
  modified_base (293)..(293): a, c, t, g, unknown or other
  misc_feature (293)..(293): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtncatcccaccagggccactggtatcccagcccagggtcagtggcaggtgggtctgggacaggagttcactctcaccatcagcagcctgcagtctgaagtattttgctagtttatttctgttcagtctaattacaattacgtcggtccctaccgtacgtggtacgttcggccgaggggaccaagggtacggaaatacaaacggtactgtggctgacacatctgtcc

SEQ ID NO: 220251 - DNA, 577 bp, Homo sapiens
  misc_feature: GYAE6OF01EF9XC.38.22.B11.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctccaggctcctcatctatggtncatccacgagggccactggtactcccagccagggtcaggtggcaggtgggtctggggacaggtagttccacgttctcacctatcagcagcctgcagtctagtaagtattttgacttagttttactttcgtgtctagtactattaactaatttacgtcgggtcccttaccgttacggtggtaccggttccggaccggtacggggtaaccgtaagggttacggaaacgttaccgaaaacggtacgttaggtcggacgtacgaccaacctacgttcgtcggttacccg

SEQ ID NO: 220252 - DNA, 508 bp, Homo sapiens
  misc_feature: GYAE6OF01EDD25.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccagggtcagtggcagtgggtctgggacagagttcactctcaccatcagcagcctgcagtctgaagtattttgctagtttatttctgtcagctaattacaattactgggtccttccttacgtggacgttcggccgtaggggaccaagggtacggaaatcgaaacgactgtggctgacaccatctgtc

SEQ ID NO: 220253 - DNA, 569 bp, Homo sapiens
  misc_feature: GYAE6OF01BZZ9U.38.22.B11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (389)..(389): a, c, t, g, unknown or other
  misc_feature (389)..(389): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagcagcaacttgcctggtaccagcagaaacctggccaggcctcccaggctcctcatctatggtncatccacagggccatggactcccagccagggtcagtggcaggtggtctgggacaggagttcactctcaaccatcagcagcctgcagtctgaaagtnttttgcttagtttatttctgtcagtctaatttacaatttacgtcggtacccttaccgttacggttgggtacccggtttcgggacccggtaacgggggaacccgtaaagggtaggtaaaacgttacgaaaaccggtacgttaggtacgggtcctacggaccaacctattccgtggttaccc

SEQ ID NO: 220254 - DNA, 634 bp, Homo sapiens
  misc_feature: GYAE6OF01ATDN9.38.22.B11.1.454.CMB.1.raw
  modified_base (197)..(197): a, c, t, g, unknown or other
  misc_feature (197)..(197): n is a, c, g, or t
  modified_base (419)..(419): a, c, t, g, unknown or other
  misc_feature (419)..(419): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttgcctggtaccagcagaacctggccaggcctcccgaggcctcctcatctagtcggtgccactcccaccgagggccacgtggtactcccgagccgagggtcagtggcagggtggtctgggacaggtacgttccacttcgtacacctatcacgccacgcctgctagtctaggtaaagttnttttcgactttagttttactttcgtagttcgtagtacttaagtttaactaagtttaccgtggtaccccttaccgttacggttcgggtacccgtttccgggacccggtaacgggggtaacccgtaaaggggtaacggtaaacctaaccgtaaaacggtaacgttacgggttacggaccgttacggaccctaaccgtacgttccgttcgtttacccg

SEQ ID NO: 220255 - DNA, 541 bp, Homo sapiens
  misc_feature: GYAE6OF01AV9H7.38.22.B11.1.454.CMB.1.raw
  modified_base (390)..(390): a, c, t, g, unknown or other
  misc_feature (390)..(390): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggctcccaggctcctcatctatggtgcatccaccagggccactggtactcccagccagggtcagtggcaggtgggtctgggacagtagttcactctcacatcagcagcctgcagtctgaatntttgctagtttatttctgtctagtctagttactaattactcggtaccttccttacggtcggtaccgttccgggccgtaaggggtaccgaaagggtacggtaaacgtacgaaacgtacgtcggtaggcgtacgaccacctactcgtcgttac

SEQ ID NO: 220256 - DNA, 519 bp, Homo sapiens
  misc_feature: GYAE6OF01EW5RY.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccacagggccatggtatcccagccagggtcagtggcagtgggtctgggacagagttcactctcaccatcagcagcctgcagtctagaagtattttgctagtttatttctgtcagtctatttacaattactggtccttccgtacgtggtacgttcggccgtaggggacctaaggtacggaaatagaaacggaactggtgacgtcggactaaccatctgttacc

SEQ ID NO: 220257 - DNA, 509 bp, Homo sapiens
  misc_feature: GYAE6OF01ER5I8.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggagggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtatcccagcccagggtcagtggcagtgggtctggggacagagttcactctcaccatcagcagcctgcagtctgaagtattttgctagtttatttctgtcagcattaacaattactggtccttccgtacgtggacgttcggccgaggggaccaagggtggaaactacgaaacgactgtgctgacaccatcgtgtcc

SEQ ID NO: 220258 - DNA, 633 bp, Homo sapiens
  misc_feature: GYAE6OF01C7QR9.38.22.B11.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcagcaacttagcctggtaccagcaagaaacctggaccaggcctcccgaggcctcctcattctatggtncatcccacgagggcccacgtcggtactcccgagccgagggtcaggtcggctaggtcgggtactggggactaggtacgttccaccgttctaccaacctagtccacgtcacgcccttggctagttacctaggtaagttattttcggacctttaaggttttactttcgtgttactaggtaccttaatttaactaacgtttaccgtacggttcccttaccgttaacgggttccggtacggttccggaccgtacggggtaaccctaagggtacgtaaacgttacgaaacggtctacgggtacggtactacggacccactacgttcgttcgttaccg

SEQ ID NO: 220259 - DNA, 542 bp, Homo sapiens
  misc_feature: GYAE6OF01BGQZY.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaactgggtgcgacaggcccctggacaagggcttgagtggatgggatggatcagcgcttaacaataataacacacactatgcacagaagttccagggcagagtcaccgtgaccacggacacactccacgagcacagcctacatggagttgaggagcctaggagactcgtaggaccgacgacggccgtagttattacgtgtcgcgagagtacagtaattattagttagtggtacttacggtggggaccgtaaggggtacccgtcggg

SEQ ID NO: 220260 - DNA, 516 bp, Homo sapiens
  misc_feature: GYAE6OF01B7X2Z.38.22.B11.1.454.CMB.1.raw
  modified_base (195)..(195): a, c, t, g, unknown or other
  misc_feature (195)..(195): n is a, c, g, or t
  modified_base (508)..(508): a, c, t, g, unknown or other
  misc_feature (508)..(508): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcagcaacttgcctggtaccagcagaaacctggccaggctcccaggctcctcatctagtggtgcactccaccgagggccactggtactcccagccagggtcagtggcaggtggtctgggacagagttcactctcaccatcagcagcctgcacgtctagaagtattttgactagtttatttctgtcagtcattactaattctggtcctctacgtggtacgttcggaccgtaggggaccaagggtagaaacgtacgaaacggtactgtaggctgaccacntcgtgtcc

SEQ ID NO: 220261 - DNA, 581 bp, Homo sapiens
  misc_feature: GYAE6OF01CPK9M.38.22.B11.1.454.CMB.1.raw
  modified_base (198)..(198): a, c, t, g, unknown or other
  misc_feature (198)..(198): n is a, c, g, or t
  modified_base (406)..(406): a, c, t, g, unknown or other
  misc_feature (406)..(406): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtgttagcagcaacttgcctggtaccagcaagaaacctggccaggcctcccaggcctcctcatctatggtgcatcccaccgagggcccactggtactcccgagccgagggtccaggtggcaggtgggtctgggacaggtagttcactctcaccatcagcagcctgcagtctagaagtnttttgacttagttttattctgtacagtctaattaactaatttacgtgggtcccttccgttaacgtcgggtaccgtttccgggaccgtaaggggtaccgtaagggtacggtaaaacttacgaaaaccggtaacgttggtacgggcttacggacctaaccgtacttcgttgttaccc

SEQ ID NO: 220262 - DNA, 495 bp, Homo sapiens
  misc_feature: GYAE6OF01E3GVD.38.22.B11.1.454.CMB.1.raw
  modified_base (488)..(488): a, c, t, g, unknown or other
  misc_feature (488)..(488): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtgcatccaccagggccactggtatcccagccagggtcagtggcagtgggtctgggacagagttcactctcaccatcagcagcctgcagtctgaagtattttgctagtttatttctgtcagtcattacaattactgtcctcctacgtggacgttcggcgaggggaccaggtaggaatacgaaacgactgtgctgcacnctctgtc

SEQ ID NO: 220263 - DNA, 575 bp, Homo sapiens
  misc_feature: GYAE6OF01CWNQI.38.22.B11.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (415)..(415): a, c, t, g, unknown or other
  misc_feature (415)..(415): n is a, c, g, or t
tcagtcgatcacgtcacgaccggtgctcgatttagacgacagctcgagggggaggaactgctcagttaggacccagacggaaccatggaacgccccagcgcagcttctcttcctcctgctactctggctcccagataccactggagaaatgtgatgacgcagtctccagcccaccctgtctgtgtctccgaggggaaangcccaccctctcctgcgagggccagtcagngtgtagcagcaacttgcctggtaccagcagaaacctggccaggcctcccaggtcctcctcatctagtggtgcatccacgacgggccacgtggtactcccgagccgagggtccaggtcggctaggtgggtctgggacaggtagttcacgtctaccaccgatcagcacgcctcgcagtctagtaagtntttgacttagttttactttctgtcacgtctaattactaattacgtcgtccttccgttacgtcggtaccgttccggccgaacggggaccctaagggtacggaaacgtaccgtaaaacgacgttcgggtaggaccgtcgacccacctactccgttcgttacc

SEQ ID NO: 220264 - DNA, 568 bp, Homo sapiens
  misc_feature: GYAE6OF01B3SJF.38.22.B11.1.454.CMB.1.raw
  modified_base (198)..(198): a, c, t, g, unknown or other
  misc_feature (198)..(198): n is a, c, g, or t
  modified_base (412)..(412): a, c, t, g, unknown or other
  misc_feature (412)..(412): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaancgccaccctctcctgcagggccagtcagagtgttagcagcaacttagcctggtaccagcagaaacctggccaggctcccaggcctcctcatctatggtgcactccaccgacgggccacgtggtactcccagccagggtcagtggcaggtggtcgtgggacaggtagttcactctacacctatccagtcgacgcctgactagtctaggtaagttnttttgacttagtttttactttcgtagtctagtactattaactaatttccgtcggtaccctcgttacggtggtaccgttcggaccggacgggaccgtaaagggtcgtaaactaccgaaacgtacgtagtacggactcgacctacctatcgtgttacc

SEQ ID NO: 220265 - DNA, 544 bp, Homo sapiens
  misc_feature: GYAE6OF01A4L9D.38.22.B11.1.454.CMB.1.raw
  modified_base (196)..(196): a, c, t, g, unknown or other
  misc_feature (196)..(196): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagcagcaacttagcctggtaccagcaagaaacctggccaggcctcccaggcctcctcatctagtggtgcactccaccgagggccacgtggtactcccagccgagggtcagtggcaggtgggtctggggacaggtacgttcactcgtccaccatccagcagcctgctagtctagtaagtntttgcttagtttntttctgtctagtctaattacaattacgtcggtccctcgttacggtcggtacgttcggaccgtacggggacctaagggtacgaaactcgaaacgtactggtcgctacgacacatcgtgttcc

SEQ ID NO: 220266 - DNA, 853 bp, Homo sapiens
  misc_feature: GYAE6OF01CC6C4.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtcctccgaggggaaancgcccacctctcctgcagggccagtcagagtgtagcagcaacttagcctggtaccagcaagaacctggaccaggcctcccgaggcctcctacacgttcctagtggtcgacctaactcccgaaccgacgggcccaacgttcgggtaacctccccgaaggccccgaagggggttccaaggttcggggacctaaggggttcggggttaccgtagggggaactacgggtaacgttttcccgaacgtttccctacccgaaaccccgtattaccgaacggtacccgacgggtcccctttagggaccccgtaaaggtttcccgtttaaagggtaaaaaccggtttatttttttacgggaacccttttaaaggtttttttaaccttttcccgttaggttaccgtaaggttacccttaaattttaaaccgtaaaacgttttcccgtaccggggttacccccttttaacccggttaacgggttaccggggttaccccgggttttaccggggaaacccggttaaacgggggggtaaacccctttaaaaagggggtaccgggttaaaaaaactaccccggggtaaaaaacccggtaaacggttttcggggtacgggttacccgttaccgggtaacctaaccccgtaagtttcccgtaggtttacccc

SEQ ID NO: 220267 - DNA, 781 bp, Homo sapiens
  misc_feature: GYAE6OF01ANEFT.38.22.B11.1.454.CMB.1.raw
  modified_base (328)..(328): a, c, t, g, unknown or other
  misc_feature (328)..(328): n is a, c, g, or t
tcagtcgatcacgtcacgaccggtgctcgatttagacgacagctcagggggacccaaaaaccacacccctccttgggagaatcccctagatcacagctcctcaccatggactggacctggagcatccttttctggtggcagcagcaacaggtgcccactcccaggttcagctggtgccagtctggagctgaggtgaagaagccgtggggcctcgaggtgaaggtctcctgcaaggcttctggttacaccttaccaactagtggtactcgaacgtgggtgccgacgaccgggccctggacgaagggtcttaggagtggagtgggatggntcgagccgtacttaacgaataagtaaccacgactactagtcgactaacgtaaggtaacgttccgaagggtcaacggtacgtaccgtaaccggtacgaacccgaacgggaaccaccgacgtacccgaacggtacgaccaaccgacggtaccctaacgtacggttagggtaacgttcggaacggtaccgccggttaggaacggttacgttaccgggtacggaaacccggtaacccggtacccgggtacgttacggtttaaaccggtttcgtacggggtaccgacgttaacgggtaaacgttaaaccggaaggttttaaaccgttaaggtttttacggtaaacgggttaacgggttaaccccgttaaccgggggttacgggggtaacccccggttaaaccggggggttaaaccccccgttggggttaaaccccccggttccccggtttaaccccgg

SEQ ID NO: 220268 - DNA, 660 bp, Homo sapiens
  misc_feature: GYAE6OF01CYXRQ.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctagctcccagataccactggagaaatagtgatgacgcagtctccagccaccctgtctgtgtctccgaggggaaangccaccctctcctgcagggccagtcagagtgttagcagcaacttgcctggtaccagcaagaacctggccagggcctcccaggctcctcatctatggtgcactcccaccgagggccacgtggtactcccgagcccgagggtcaggtggcaggtcgggtctggggacaggtagttcacgtctcaccatcagcacgcctgcgtacgtctaggtaagttagtttttgacgtttaagtttttacttttcgttcggttacagtacttaatttaaccgtaaatttaccgtacggttacccttccggttacggttacgggttacccggtttaccggggtacccggtaacgggggtaacccgtaaagggggttaacgggtaaaaaccgttaccggtaaaaaccggtaacggttcgggttacgggtccgttacggtaccccgtaaccgtaacggttccgtttcggtttacccg

SEQ ID NO: 220269 - DNA, 590 bp, Homo sapiens
  misc_feature: GYAE6OF01B9JJ4.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccagtcagagtgttagcagcaacttgcctggtaccagcaagaaacctggccaggcctacccgaggcctcctcatctagtggtgccatcccacgagggccacgtggtactccccgagccgagggtcaggtggctaggtcgggtctaggggactaggtacgttccgaactccgtacaacctatcacgcacgcctgcagtctagaagtatttgacttagtttattctgtcagtctaattactaattacctcggtcccttaccgtacggttacggtaccgttaccggaccggtaacggggacctaaagggtacggaaaacgtaccgaaaacggtacgtacgggtacgcgttacgacctacgacgttcgttgttacc

SEQ ID NO: 220270 - DNA, 536 bp, Homo sapiens
  misc_feature: GYAE6OF01B50WE.38.22.B11.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (530)..(530): a, c, t, g, unknown or other
  misc_feature (530)..(530): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgtagcagcaacttgcctgataccagcagaaacctggccaggctcccaggcctcctcatctatggtcncatcccaccgagggcccacgtggtactcccgagcccgagggtcaggtggcaggtgggtctggggacaggacgttcactctaccaccatcagcacgcctgcagtctagaagttntttgcttagttttnttctgtcagtctaattaactaatttcgtcggtccttcgtacggtggtaccgttcggaccgaggggacctaagggtggaaactacgaaacgtatgtaggctgacactntcgtcg

SEQ ID NO: 220271 - DNA, 642 bp, Homo sapiens
  misc_feature: GYAE6OF01BU8MX.38.22.B11.1.454.CMB.1.raw
  modified_base (427)..(427): a, c, t, g, unknown or other
  misc_feature (427)..(427): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctcccagataccactggagaaatagtgatgacgcagtctccagccaccctgtctgtgtctccgaggggaaagacgccaccctctcctgcagggccagtcagagtgttagcagcaacttagcctggtaccagcaagaacctggaccaggcctcccgaggcctcctcatctagtggtgctactcccaccgacgggcctacgtggtactcccgagccgagggtcaggtcggcgtaggtcgggtcgtgggacaggtacgttcacttcgtaccacctatcagcacgccgtgctagtctagaagttnttttggactttaggttttactttcgtgtactacgtacttaagttaacctaacgtttacgtcgggtaccccttacgttacgggttcgggtaccgttaccgggacccggtaacgggggtaacctaaaggggttacgtaaacggttaacccgtaaaacggtcggttacggtacgggttaccgtacggaaccctaacccgtacttccgttcggttaccc

SEQ ID NO: 220272 - DNA, 604 bp, Homo sapiens
  misc_feature: GYAE6OF01BVBR3.38.22.B11.1.454.CMB.1.raw
  modified_base (196)..(196): a, c, t, g, unknown or other
  misc_feature (196)..(196): n is a, c, g, or t
  modified_base (399)..(399): a, c, t, g, unknown or other
  misc_feature (399)..(399): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctccaggcctcctcatctatggtgcactccaccgagggccactggtactcccagccagggtcagtggcaggtgggtctggggacaggtacgttcactctcaccatcagcacgcctgcagtctagtaagtnttttgcttagttttatttctgtcagtctagttaactaatttaccgtcggtcccttaccgttacgggtcgggtaccggttaccgggcccggtaacgggggtaacccgtaaaggggttacgggtaaaacgttaccggaaaaccggttaacgttacgggttacgggtaccgttacggaccctaacccgtactttccgtcggtttaccc

SEQ ID NO: 220273 - DNA, 707 bp, Homo sapiens
  misc_feature: GYAE6OF01EBUQM.38.22.B11.1.454.CMB.1.raw
  modified_base (191)..(191): a, c, t, g, unknown or other
  misc_feature (191)..(191): n is a, c, g, or t
  modified_base (298)..(298): a, c, t, g, unknown or other
  misc_feature (298)..(298): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctcagccacctgtctttgctcgagggaancgccacctctcctgcagggccagtcagtgtgtagcagctaacttagcctaggtaccagcaagaacctggaccaggcctacccgaggcctcctcacttctagtggtcncactccaccgaggcccagttcggtaactcccgaggtaccgagggtccaggtcggcctagggttcgggtacgtagggactaggtacgttcgaccttcgacctaacctagtaccgaacggtcctaaccggtcccgttagaccgtaacggtttaccgtagggttaaaacgtttacgttttttcggaacctttttaaggttttttactttccgttacggtacctacgtacctttaactttaaaccgtaactttaccggtccggttacccgttacccgttaacggggttcgggtaacccgttaccggggaccgtaaacgggggtaaccttaaaggggtaaacgtaaaccgtaccggaaaacggtcggttaggtacggtcaacggtcccgaacttagtcgtttcgccgtttaccg

SEQ ID NO: 220274 - DNA, 631 bp, Homo sapiens
  misc_feature: GYAE6OF01CPEAS.38.22.B11.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagcagcaacttgcctggtaccagcagaacctggccaggctcccgaggcctccncatctagtggcncactcccaccgaggccaactggtaactccccgaagcccgagggtaccaggtcggacgtagggtgggtacctggggaactaggtagtttccacgttctaccaccgatcgagcacgtccgtgctagtctagtaacgtattttgacgttagttttacttctgttactaagtcgttaatttaacctaaacgtttacgtaccgggtacccttaccgttaacggttcgggtacccgtttccgggaccgtaacggggaaccgtaaagggttaacggaaaacgttaccgaaaacggtacggttacggtacggtacgttacggacacctattccgtcgttacc

SEQ ID NO: 220275 - DNA, 710 bp, Homo sapiens
  misc_feature: GYAE6OF01DK5O9.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccgttgggttttgggggaagaggaagacgtggaccggtccccccagcagcaacaggtgcccactcccaggttcagctggtgcagtctggagcgtgaggtgaagagccgtggggcctcagtgaaggtctcctgcaaggtcttcgtggttacacctttaccaactatggtatcaacgtgggtgcgacacggcccctggacgaaggtcttgagtggagtggatggatcgagcgtacttaacaaataactaacacacaactatagacaacgtaagtaacgttccgaaggggacctaggacgttaccgaaccggtacgaacccgaacgggtaaccaacgaccgtacccgaacggaacgaccaaccgtacgacccgttaacgaggtaggtacggttaggaacgggacgtccgtaggaacgtacgttaccgtacggaaccggaaccgtaaccgggtacccgtttacgttaacgtttaaccgtggttacggacggtaaacggtacgtaaaccgtaagttaaaacgtttaggttttacgttaaagttacggtaaacgttaccgggtacgggggtaaccccgtaacggggtaaccccgttaccgggg

SEQ ID NO: 220276 - DNA, 518 bp, Homo sapiens
  misc_feature: GYAE6OF01DQXDF.38.22.B11.1.454.CMB.1.raw
  modified_base (415)..(415): a, c, t, g, unknown or other
  misc_feature (415)..(415): n is a, c, g, or t
  modified_base (510)..(510): a, c, t, g, unknown or other
  misc_feature (510)..(510): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgagaagcctggggcctcagtgaaggtctcctgcaaggcttctggttacactttaccaactatggtatcaactgggtgcgacaggccctggacaagggcttgagtggatgggatggatcagcgcttacaataataacaacacactatgcacaagaagttccagggcagagtcaccgtgaacccacggacacataccacgagcacagctacatggagttgaggngcctgagatctgaacgacacggccgtgtacttactgtgcgagagtacagaatattgttaatggaacttacgtggggtccaagggtaccctggtcnccgtcccg

SEQ ID NO: 220277 - DNA, 594 bp, Homo sapiens
  misc_feature: GYAE6OF01BYTN8.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtgccatcccaccgaggggcccacgttcggtactccccgagcccgagggtccaggtcggcaggtgggtctgggacaggagttcactctccacatcagcacgcctgcagtctagaagtattttgcttagtttactttcgtgtcagtctaattactaatttacgtcggtaccttccgttacggttggtaccggttccgggacccgtaacggggtacccgtaaagggttacgggaaaacttaccgaaaacggtaacgttcggtacgggaccttacggacctaacccgtacttccgttcggttacccg

SEQ ID NO: 220278 - DNA, 793 bp, Homo sapiens
  misc_feature: GYAE6OF01BPO9H.38.22.B11.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaangccacctctcctgcagggccagtcagagtgttagcagcaacttagcctggtaccagacgaagtaaacctggaccaggcctcccaggcctcctcatctagtggtcgactactccaccgagggccacgtcggtactcccgagccgagggtcaggtcggacgtaggtcgggtactcggggtaacaggtacggtttaccaacgtttcctaccaaccctattccgacgtaccgaaccgccgttacggtaccgtaaggttaccgttaagggaaacgttttacggttttttacggtaccttttaaagggtttttttaacttttaccgtttcggttaacgtaacggtttaaccgttaacttttaaaccttaaagttttaacccggttcccggttaaccccgtttacccggtttaaccgggttaccgggggttaaccccggttttccggggaaccccggggttaaaccgggggtaaacccgggttaaaacgggggttaacgggtaaaacccggttaaaccgggtaaaaacccggttaaaaggttccgggtacgggtaaccgttacgggaaccccttaaccgttacgtttcccgttcgggtttacccc

SEQ ID NO: 220279 - DNA, 723 bp, Homo sapiens
  misc_feature: GYAE6OF01A3JXH.38.22.B11.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaangccaccctctcctgcagggccagtcagagtgtagcagcaacttgcctggtaccagcagaacctggccaggcctcccgaggcctcctcactctagtggtcgctactcccaccggacgggccctagtggtacctcccgaggcccgtagggtcaggtcggacgtagggtcgggtactaggggaactaggtacgtttccacttctaccgaacctagttcgacgtccgtacgtccgtagaccgtacgttcgtaaggtaaacgtttcgttttacggccgttttaaagtttttaccgttttacgtacggttacctacggttacctttaacgtttaaccttaaacgttttacccggtccgggttacccctttaccggtttaacgggttaccgggttaacccggttccgggtaccggtaacgggggtaaccccgtaaagggggttaaccggtaaaaccggttaaccggaaaacgggttaccgttacgggtacgggtaccgtacggtaaccctaccgttacgttccgttcggtttacc

SEQ ID NO: 220280 - DNA, 686 bp, Homo sapiens
  misc_feature: GYAE6OF01C5IRV.38.22.B11.1.454.CMB.1.raw
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttggggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttacaactatggtatcaactgggtncgacacggccctgggacaaggggcttggagtgggatgggatggatcagcgacttaacaaataanaacacacactatcgacaacaggtaacgttccgaaggggcaagacgtcaccggtgaccgacggacacactaccaacgacacacacgcctaacagtcgggaagttggaacgggagcccgtaggacggtatacggtacggaaccggtacgtaccggggtaccgttacgggttaacgttaaccgttgggtacgggaaccgggtaaggtaaacggttaaacctaaagggttaaacgtttaacggttttagggttttaaacggtacggggttaaacccgttaaccgggggttacggggggtaaccccggtaaccggggggtaaacccccgttacccggggg

SEQ ID NO: 220281 - DNA, 551 bp, Homo sapiens
  misc_feature: GYAE6OF01CF06F.38.22.B11.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttgcctggtaccagcaagaaacctggaccaggcctcccaggcctcctcatctatggtncatccaccgagggcctacgtggtactcccaggccagggtccaggtggcaggtcgggtctgggacagtagttccactctacaccgatcagcacgcctgctagtctagaagttcttttgcttagttttactttctgtcagtactaattactaattcgtcggtccttcgtacgttggtaccgttccgggaccgaggggtaccaagggttacgaaagtacgaaacgtgtggtaggctaggacaccgtatcgtgtacc

SEQ ID NO: 220282 - DNA, 707 bp, Homo sapiens
  misc_feature: GYAE6OF01CNNNT.38.22.B11.1.454.CMB.1.raw
  modified_base (165)..(165): a, c, t, g, unknown or other
  misc_feature (165)..(165): n is a, c, g, or t
tcagtcgatcacgtcacgaccggtgctcgatttagacgacagctcagggggggagaggagcccagcactagaagtcggcggtgtttccattcggtgatcagcactgaacacagaggactcaccatggagttggctgagctgggttttcctgttgcttctttaagnggtgtccagtgtcaggtgcagcgtgggtggtagtcggtgggggagcggtggtccaggccgtggggacgtccctggacgtactcgtccgtgtgctagtcctcgtggtacttctacgtttcgagttagttatcggctacgtcgcctacgtcggggtccccaccgaggccctaccggacggtacgaacgggggtcctggggtaggtcggggtacaacctaacgtttagttaatttaagtagttaggaggttaagggaaattaagtagtaaactacgtaatcggaactacggtaccgtcggtaaggtaccgggtacctattacgtactcgtactaccgtaccgaaggtaacgtaacgtaaccttaaccgaaacgtaaccgtaccgtacgttacgtccttacgtacgtaaactaaagtacgtaacgttacgacgttagaaggttagttaggaacggtacgaccggtagttgttacgttagttacggtgtacggtaacggttaaggttaggtttacgggaggggttaccggcggtaacgttaaacggg

SEQ ID NO: 220283 - DNA, 879 bp, Homo sapiens
  misc_feature: GYAE6OF01BV42O.38.22.B11.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcgagggccagtcagagtgtagcagcaacttgcctggtaccagcaagaaacctggaccaggcctcccgaggtcctccctctactctatgggtcnccactcccgaccgacggggccctacggttcggtacctaccccgaacgggacccgtaacgggggtttaccaacgggttcgggaccggtaaggggttcgggggttaccgtaggggggtaaacctaaggggttaccgtttacccgtaaccttcccgttaacccgtaacccgtaacgttcccgaacgggtccctaacggtcccgtttacggaccgttaacggtttaccggtaagggtaaacggttttacttttttacggggtaaccttttaaaggtttttttaaccgttttccggttaacggttacccgttaaagggttacccttttaaagttttaaacccgtttaaacggttttacccggtttacccgggttacccccgtttacccggtttaaacggggttccggggttaaccccggggttttacccggggaccccgggtaaaccggggggtaaacccgggtaaaacgggggttaaccgggtaaaacccgttaacccggaaaaaaccgggttacgttacggggttaccggtaccgtaccgtaacccgtaacccgtacgtttccggttcgtttaccc

SEQ ID NO: 220284 - DNA, 852 bp, Homo sapiens
  misc_feature: GYAE6OF01B5M14.38.22.B11.1.454.CMB.1.raw
  modified_base (304)..(304): a, c, t, g, unknown or other
  misc_feature (304)..(304): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagccaccctgtctgtgtctccgaaggggaaacacgcccaccctctcctgcagggccagtcagagtgtagcagcaacttgcctggtaccagcaagaaacctggccaggcctccgaggcctacctcagtctagtcggtnccactcccgaaccgacgggccctaacgttcggtactccccgaaggaccctaggggttccaaggtcgggaccgtaaggggttcggggtaccgtaggggaactaacggtacggtttaccaaccgttcgtacccgaacctacgttacccgaacggcctaacggtcccgttacggcccgtaagggtttaccctaagggttaaaccggtttagttttttaccgggacgtttttaacggtttttttaacgtttccgtacggttttaccgaaacggttccctttaaattttaaacccgttaaacttttacccgggttccgggtaaccccctttaccgggtttaaaccgggttcggggtaaaccccgggttttaccccggggaaaccccggggtaaacgggggggtaaaaccccgttaaagggggtaaacccggttaaaaaccgttaacccggggtaaaaaacccggttaaccgggtttcgggtacccggggtaacccgtttaaccggaaaccccttaacccgtaaagggtttcccttacgggtttttaaaccccc

SEQ ID NO: 220285 - DNA, 686 bp, Homo sapiens
  misc_feature: GYAE6OF01EFMKX.38.22.B11.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (383)..(383): a, c, t, g, unknown or other
  misc_feature (383)..(383): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctcccagataccactggagaaatagtgatgacgnagtctccagcccaccctgtctgtgtctccgaaggggaaancgcccacctctcctgcagggccagtcagagtgtagcagctaacgttagcctaggtacccagctaagaaaccctggaccacggcctcccgaggcctcctctaatcgtagtggtcncactcccacgacggcctagtcggtacncccgagccgaggtcaggtcggcaggttcggtacgtgggaacnggtacgttcacttaccgtacaaccgtatcgacgaccgacgtccgtagacttacggtacgttaacggtaagtttacgtttttcgaccgttttaagtttttacgtttacctacggttactaacggtactttaacttaacccgttaactttaccgtccggttacccgtttaccggttaacgggttaccggttacccggttaccgggaccggtaaaccgggtaaccggtaaggtaacggtaaactaaccgtaaacggtacgtacggttacggaccgtagtaccctacgtacttccgtcgtttacccg

SEQ ID NO: 220286 - DNA, 597 bp, Homo sapiens
  misc_feature: GYAE6OF01DLJQG.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtgcgacacggccctggacaaggcttggagtggatgggatggatcgaggcgcttacaataataacacacactatgacaacgagaagttccgaagggcagagtcaccgtacgaccacggacacactaccacgacgacacacgcctaacagtcggtagttggaggacgccgtagagactcgtgaaccgaccgacggtccgttagttacttacgtggtcgacggaagtacggtaccaagtaaagttacgttttagttagttcggtaaccgttacggtacgggggtccgtaaacggggtaaccccttgggtacccgtacccggttacccg

SEQ ID NO: 220287 - DNA, 692 bp, Homo sapiens
  misc_feature: GYAE6OF01CX9AL.38.22.B11.1.454.CMB.1.raw
  modified_base (196)..(196): a, c, t, g, unknown or other
  misc_feature (196)..(196): n is a, c, g, or t
  modified_base (471)..(471): a, c, t, g, unknown or other
  misc_feature (471)..(471): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaanagccacctctcctgcagggccagtcagagtgttagcagcaacttgcctaggtaccagacagaaacctggaccacggcctacccgaggcctcctacaacttccgtaatcgggttcacctaacttcccgaacgacggggccctaacgttcgggtaacctccccgaagcccgaaggggttccaggttcgggctagggtcgggtctaggggacagtcgtttacaccgttcgtaccaaccataccgacgccagtcctgacctaggttctaggaaagtttnttttcggtacctttaagtttttacttcgtagttaccgtagtacttaatttaaccgtaattttaccgtcgggtaccccttacggtttaacgggtccgggttacgtttcccggggaccgtaacgggggaaacccgtaaaggggtacggtaaaactacccggaaaacggttcgttgggacgggttacctacgggaccctaaccttcgttccgttaggtttaccc

SEQ ID NO: 220288 - DNA, 719 bp, Homo sapiens
  misc_feature: GYAE6OF01EVL2Q.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggaccacgacgacgaaacgtaacgtcgacgacggtccctaccggacgtcctcctactactactaggttcgggtcactacctacccaacgggacggaccctaggtaggttaccctaccgaccgaccggtacggtacgtagggtcgacggtagggtcggtcggtacggacgagttacgtaccgtaccttaccgtaccaactactacgaccgacgacgtcctaggaccgtagttcgtaaggttaattttagtttacgtaacgttttaagttttctttcgttcgtaactacgtaactttaacgttaacttaacgtttacggtacccgttacctttaccggtaacgggtacgggtttacccggtaccgggtaaccgggtaaaccggggtaaacgtaacggggtaaacgtaaactaaaccggaaacccggttaggttacggacggttaccgacgtacccgaccttagtccgtttaaccg

SEQ ID NO: 220289 - DNA, 548 bp, Homo sapiens
  misc_feature: GYAE6OF01AVKQQ.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtgcgacaggccctggacaagggcttggagtggatgggatggatcagcgcttacaataataacacacactatgcacagaagttcaggcagagtcacgtgaccacggacacatcacgagacacagcctaacataggagttggaggacggcctgagtagtctaggaaccgacgaccggccgttgtaacttacgtgtcgcggagagtacgagtaagttagttgttaagtggactacggtacggggacctaacggggaaccctcgggtccgtaccggttcccg

SEQ ID NO: 220290 - DNA, 586 bp, Homo sapiens
  misc_feature: GYAE6OF01BC48B.38.22.B11.1.454.CMB.1.raw
  modified_base (273)..(273): a, c, t, g, unknown or other
  misc_feature (273)..(273): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (431)..(431): a, c, t, g, unknown or other
  misc_feature (431)..(431): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacaccttttaccaactatggtatcaacgtggtncgacaggccctaggacagggcttgagtggagtgggatggatcgagcgtacttaacaattaataacacacgactatgacaacagtaacgtcagggcagacgtcacgtgaccacgacacanccacganaccaacgcgacctacatacgggattggaaggnaccgtagacgtatcaggaaccgacgacgggtccgtgttaacgttacgtggtagacgtagacgttagaaagttaatagtttacgttaaggtcggaaccgtttacgggcgggggaacccttaacgggggaaccccttgggtacccgttaccggtccg

SEQ ID NO: 220291 - DNA, 543 bp, Homo sapiens
  misc_feature: GYAE6OF01D038V.38.22.B11.1.454.CMB.1.raw
  modified_base (396)..(396): a, c, t, g, unknown or other
  misc_feature (396)..(396): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccacgtggtactcccagccagggtcaggtggcaggtggtctgggacagagttcactctcaccatcagcacgcctgctagtctagtaagtnttttgcttagttttatttctgtcagtctaattacaatttacgtggtcccttaccttacggtggtaccgttcggacccgtaggggacctaagggtaggtaaactacgaaacggtacgtggtagcttcgacctaccattccgtgttacc

SEQ ID NO: 220292 - DNA, 727 bp, Homo sapiens
  misc_feature: GYAE6OF01B4EPK.38.22.B11.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctcgaggggaaangccaccctctcctgcagggccagtcagagtgtagcagcaacttgcctaggtaccagcaagaaacctggccaggcctccaggcctccgtcattctagtcggtcgcactccgaccgagggcctacgtggtactcctacggccgaagggtcaggtcggactacggggttcgggtagtcggggaactaggtacgtttaccacgggttcctacaaccgtatccgaacggtccaacggtcctcggacgtacggttactaagggttaacgtttacgttttcggtaactttacggtttttactttcgttacggttaccaaggttaccttaagtttaaaccttaacgtttaaccgtaccggttaccctttaacccggttaacggttaccgggtaccgggtttacccgggaacccgtaacgggggggttaaaccctaaaggggttaaccgggaaaaaccttaccggtaaaaacggttaccgttacgggttaccggtaactaaccggtacccgtaaccgttaataccgtttcggttaaacccg

SEQ ID NO: 220293 - DNA, 669 bp, Homo sapiens
  misc_feature: GYAE6OF01D3OX1.38.22.B11.1.454.CMB.1.raw
  modified_base (246)..(246): a, c, t, g, unknown or other
  misc_feature (246)..(246): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgcagtctggagctgaggtgaagagcctggggcctcagtgaagtctctgcaaggcttntggttacacctttacaactgtgtatcaacgtggtgcgacaggcccctggacgaggcttgagtggagtgggatggatcgagtcgacttaacaataataacacacactatgcaacgagtaagttcgagggacagacgtcacgtacgaccgacggacacacaccgacgacgcaacgacgaccctaacgtagtacgggtagttaggaacgggacgtacgtagaacgtcgtaccgtacgggaaccggtaaccggtaaccgggtaccggtttagtacgtttaaccgtaggttacgggtacggtaaagggtaaccgttaaaccgtaaagggtttaaactttaggtttaacggtttaaggttaccgggtaaaccggtttaacgggttacccgggggaacccggttaaccggggtaaccccgtttaccgggg

SEQ ID NO: 220294 - DNA, 705 bp, Homo sapiens
  misc_feature: GYAE6OF01DVJT9.38.22.B11.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcacgggccagtcagtagtgttagcagcaacttgcctggtaccagcagaaacctggccaggctcccgagctcctcatctagtggtncactcccaccgagggccacgtcggtactccccgagccagggtccaaggtcggacgtaggtcgggtcgngggacaggtagttccaacgttcctaccgaacctacgtaccacggtccaaccggtccgtaggacccgtaggttaccgtaggtaaaaggtttacttttttcggacgtttaagttttttacgtttccgttaggttacctaggttaccttaactttaaccgtaaacttttaccgtccgggttacccctttacccggttaacggttccgggtaaccggtttccgggaacccgggtaaacgggggtacccgtaaaaggggttaacggtaaaacgttaccgaaaaacggtaccgttagggtacggaccgttacggaacccgtaaccctcgttcgttcgtttacccg

SEQ ID NO: 220295 - DNA, 529 bp, Homo sapiens
  misc_feature: GYAE6OF01DQDH1.38.22.B11.1.454.CMB.1.raw
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
  modified_base (454)..(454): a, c, t, g, unknown or other
  misc_feature (454)..(454): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttacaactatggtatcaactgggtncgacacggcccctggacaagggcttggagtggatggggatggatcagcgacttaacaataanaacacacactatgcacagaagtccagggcagagtcaccgtgaccacggacacactccacgagcaacacgacctacagtggagttgaggagctagagatctgacganaccggcgtagtatacgtgtgcgagagtacagtaattnttagttatggtactacggngggacctagggacctcggg

SEQ ID NO: 220296 - DNA, 562 bp, Homo sapiens
  misc_feature: GYAE6OF01BC8RU.38.22.B11.1.454.CMB.1.raw
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (477)..(477): a, c, t, g, unknown or other
  misc_feature (477)..(477): n is a, c, g, or t
  modified_base (552)..(552): a, c, t, g, unknown or other
  misc_feature (552)..(552): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcagtgaaggtctcctgcaaggcttctggttacacctttaccaactatggtatcaactgggtgcgacacggccctggacaagggcttggagtggatgggatggatgagcgtctanaataataacacgacactatgacanagaagtccgaggcaggacgtcaccgtcgacccgacggacacatccgacgacgcacgagcctacgataggtagttgaggcgtccgaggaagtactcgaggaaccgacgacgggtcgttagtacttacgngtacgcgagtacgtacaaggtattagttagtacgtgaccgtaggtccggggactacggggaacccttggtacccncccggttccg

SEQ ID NO: 220297 - DNA, 595 bp, Homo sapiens
  misc_feature: GYAE6OF01DM8CJ.38.22.B11.1.454.CMB.1.raw
  modified_base (197)..(197): a, c, t, g, unknown or other
  misc_feature (197)..(197): n is a, c, g, or t
  modified_base (437)..(437): a, c, t, g, unknown or other
  misc_feature (437)..(437): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgtagcagcaacttgccgtaggtaccagcagaaacctggccaggcctcccgaggcctcctcacttctagtgggtcgcctacgtcccaccgacgggcccacgtcggtaactccccaaggcccgagggtcaggtggcgtagggtcgggtcgtggggaacaggtacgttcactcgtacacctatcacgcagtcctgctagtctagtaagttnttttgacttagttttacttcgtgtactagtctaattactaatttcgtcggtcccttccgttaggtcggtaccgtccgggaccgtacgggggacctaagggtacggaaacgttaccgaaaggtacgtggtcggactcggacaccttagtcgttgttccc

SEQ ID NO: 220298 - DNA, 541 bp, Homo sapiens
  misc_feature: GYAE6OF01AJBWS.38.22.B11.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctntcctgcagggccagtcagagtgttagcagcaacttgcctggtaccagcagaacctggccaggctcccaggctcctnatctatggtcncatccacagggccagtggtactcccagccaggtcagtggcaggtgggtctgggacagtacgttcactctccacatcacgcacgctgcngtctagattagtttnacgttagttttattcngtcagtctaacttactaattcgtcgtcccgttacgtacgttggtaccgttcggccggagggtaccgaggttaacggaactacgaaaccggtgtacgggttgacgttcgaccaactcgttcgtgttaccc

SEQ ID NO: 220299 - DNA, 723 bp, Homo sapiens
  misc_feature: GYAE6OF01A4K74.38.22.B11.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccacctctcctgcgagggccagtcagagtgttagcagcaacttagcctggtaccagcaagaaacctggccaggcctcccgaggcctcctcatctagtggtnccatccaccgngggccagtggtacncccgagccagggtcaggtggctaggtgggtcgtgggacaggtagttccaactcctacgacctagtaccgaacggtcacggtccctagccgtagttaccgtaggtaaagtttacgtttttcgaccgtttagtttttaactttcgttacgttacaaggtacctttaaagtttaaccgtaaagttttacccggtccggggttaccccctttaacccgtttaacggggtaccggttaacccgggtttccccgggtaacccgggtaaacgggggttaaacccggttaaaacggggtaacgttaaaaaccggtaaccgtaaaaacgggttaaccggttcgggttaaccgggtaccgttaaccggacccgtaaacccgttaacggtttcccgttcgtttaacccg

SEQ ID NO: 220300 - DNA, 710 bp, Homo sapiens
  misc_feature: GYAE6OF01CYZ1Y.38.22.B11.1.454.CMB.1.raw
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
tcagtcgatcacgtcacgaccggtgctcgatttagacgacagctcgagggggaggaactgctcagttaggacccagacggaaccatggaagcccagcgcagcttctcttcctcctgctactctggctcccagataccactggagaaattagtgatgacgcagtcctccagcccaccctgtctgtgtctccgaggggaaanacgcccaccctctcctgcagggccagtcagagtgttagcagactaacgttagccttaggtaaccaggactaacggaaacctggacccaaggcctacccgaggtcctcctcatcctagtcggnctactaccacgaggccctagttcggtacctccccggaagtcccggtagggtacctaggtcggtacgtagggttcggggtacgtaggggaaccgtaggtacggtttccaaccgttcctaccgaacctagtccgaacgtaccacgtcctaggacctaggttcgtaaggtaaagttgtttttcgacgtttagtttttactcgttaggttacacgttactaactttaactaaacgttttacccgtggttacccctttaacggtacggtttacgggtaccggttttccgggaaccggtaacggggtaaccgtaagggttaacggaaaacttacggaaaacgttacgttacgggacgtacgttaccggactaacccgtacgttcgttcttaccg

SEQ ID NO: 220301 - DNA, 686 bp, Homo sapiens
  misc_feature: GYAE6OF01CHGRS.38.22.B11.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagtcgatcacgtcacgaccggtgctcgatttagacgacagctcagggggagggaactgctcagttaggacccagacggaaccatggaagccccagcgcagcttctcttcctcctgctactctggcctcccagataccactggagaaatagtgatgacgctagtctccagccaccctgtctgtgtctccgaaggggaaancgcccaccgtctcctgccagggccagtcagagtgtacgcagcaactgcctggtaccagcaagaacctggccaggcctcccaggcctcctcatctagtggtncactcccgacgagggccagtcggtactcccgagccgagggtcagtggctagggtcgggtcnggggacaggtacgttcacctctaccacctatcgacgctacgccttgactagttccgtaggtaaacgttacgttttcgctttaagtttttactttcgttacggttacgtaagtaccttaagtttaacctaagttttacccgtcgggttacccttacccggttaacggttacggggtacccggtttacccgggaccggtaacgggggtaaccccgtaaaggggttacgggtaaaaacgttaacccgaaaaaccggtaaccggttagggttaccgggttcgtaaccgggtacccgtaaaccgttacgttccgtttcggtttacccg

SEQ ID NO: 220302 - DNA, 682 bp, Homo sapiens
  misc_feature: GYAE6OF01AWGC4.38.22.B11.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (419)..(419): a, c, t, g, unknown or other
  misc_feature (419)..(419): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatgtgatgacgcagtctccagccaccctgtctgtgtctccgaggggaaancgccacctctcctgcagggccagtcagagtgttagcagcaacttgcctggtaccagcagaacctggccaggcctccaggcctcctcatctagtggtcncactccaccgacgggcccagtcggtactcccagccgagggtcagtcggctaggtgggctgggacaggtacgttccactctacaccatcgagcacggccctaggactacggtctaggtaaacgttnttttacggactttaacggttttacttttacgtcggttacctacggtaccttaactttaaacctaagtttacccgtacgggttaccccctttacccgttaaccgggttcggggtacccggtttaccgggacccggtaacgggggttaaaccccgaaagggggttaaccggtaaaacgttaccggaaaaaccggttaacggttacgggttacgggacccgttacggtacccgtaaaccgtttaacgttccggttacgtttacccg

SEQ ID NO: 220303 - DNA, 601 bp, Homo sapiens
  misc_feature: GYAE6OF01DBQ1S.38.22.B11.1.454.CMB.1.raw
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgcagggccagtcagtagtgttagcagctaacttagccgtaggtaccagcaacgaaacctggaccaggcctcccgaggtcctcctcatctagtggtgctactcccaccgacgggccaacgttggtacctcccgaaggcccgagggtcaggtggcgtagggtcgggtcgtagggacaggtacgttcactcctcaaccntcagcncgcctgtcagtctagtaagtnttttgcttagttttnttcgtcgttcagtactagtttaacaactttacgcgtcccgttcgttacggtccggtacggttccggaccgtacggggaacctaagggtaacgtaaactacgaaacggtacgttggtggaccgtcgacctaccgtacgttcgttcgttaccg

SEQ ID NO: 220304 - DNA, 634 bp, Homo sapiens
  misc_feature: GYAE6OF01CBEO7.38.22.B11.1.454.CMB.1.raw
  modified_base (197)..(197): a, c, t, g, unknown or other
  misc_feature (197)..(197): n is a, c, g, or t
  modified_base (620)..(620): a, c, t, g, unknown or other
  misc_feature (620)..(620): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtagcagcaacttgcctggtaccagcaagaacctggaccaggcctcccgaggcctcctcattctagtggtgccactcccgaccgacgggccctacgttgggtacctccccgaggcccgtagggtccaggtcggcgtagggtgggtctggggacaggtacgttccactctaccgacctagtcgacgccacgtcctgacgtagtcgtaggaagttagttttgactttagttttactttcgtgtactagtctaactttactaactttaccgtcggtacccttaccgttacggttcgggtaccgttaccgggaccggtacggggaaccgtaagggttacggaaaacttaccggaaaaccggtacgttacgggtacggacgtacgaccctaaccgtnttccgtggttaccc

SEQ ID NO: 220305 - DNA, 530 bp, Homo sapiens
  misc_feature: GYAE6OF01BJ834.38.22.B11.1.454.CMB.1.raw
  modified_base (392)..(392): a, c, t, g, unknown or other
  misc_feature (392)..(392): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaagagccaccctctcctgcagggccagtcagagtgttagcagcaacttagcctggtaccagcagaaacctggccaggctcccaggctcctcatctatggtgcatccaccagggcccatggtactcccagccagggtccaggtggcagtgggtctgggacagagttcactctcaccatcagcagcctgcagtctgtaagtnttttgcttagtttatttctgtctagctaattactaacttacgtcggtacccttccgtacggtggtaccgttcggccgtaggggaccaagggtcggaaactacgaaacgtacgtggtcgctcgacacctatctgttacc

SEQ ID NO: 220306 - DNA, 515 bp, Homo sapiens
  misc_feature: GYAE6OF01A3KP5.38.22.B11.1.454.CMB.1.raw
  modified_base (479)..(479): a, c, t, g, unknown or other
  misc_feature (479)..(479): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctccaggctcctcatctatggtgcatccacagggccactggtactcccgagccagggtcagtggcagtggtctgggacagagttcacgtctcaccatcagcagcctgcagtctagaagtattttgctagtttatttctgttcagtctattacaattactggtcctcctacgtggtacgttcggccgtaagggacctaagggtgaaactanaaacggtactggtacggactcgaccaccatctgtcg

SEQ ID NO: 220307 - DNA, 614 bp, Homo sapiens
  misc_feature: GYAE6OF01C7ANY.38.22.B11.1.454.CMB.1.raw
  modified_base (212)..(212): a, c, t, g, unknown or other
  misc_feature (212)..(212): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttctggtggcagcagcaacaggtgcccactcccaggttcagctggtgcagtctggagctggaggtgaagaagccgtggggcctnagtgaaggtctcctgcaaggtcttgtggttacacctttacaacttatggtatcgaactggggtcgacgacgacggtccccgtagggaaccgtaaggggtcttaggaggtagggtagtggggtatgggattcgagtcgtacttaacaaataataacactacactatacgcaacaaggtacgtaccgagggcagtagtcatcatcgaacacagtaacacgactaccgaacgacgactaaccgtagacccctaagacgttaggaaaccgttggaacggtacctagggactagtacgtacggaacgtaaccgacggttaccttaagttattagtcggtgacgtagaacgtaactaactttcccacttaacagttactaacgactaagtagtacgttgcttttaacg

SEQ ID NO: 220308 - DNA, 827 bp, Homo sapiens
  misc_feature: GYAE6OF01CWS3R.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcattccttttcttggtggcagcagcaacaggtgcccactcccaggttcagctggtgcagtctggagctgaggtgaagaagccgtggggcctcagtgaaggtctcctgcagcttctggttaccacctttacactatgtatcaacgtggtgacgacacggcccgtaggacgaagggctggagtggagtagggagtggatacgagcgtacttaacaaattaaactaacaacaactaactagtcgacaacgaacgtaacgttaccgaagggacaacggtagtcccgaacgtacggaacccgtaacgggaacctaacgacgtacccgaacgtaacgacccgaaaccgaaccggtaccttaacgaaggttcgggtaacggtttaagggacggggtaaccggtacccgttaagggacggtacttaccggtaaccggaaccggaacccgtaaccccggggttaccggggtttaacgtttaaccggttttaaccggttacggttaccgggaaaccgggtaaaggttaaacgggttaaacccgtaaagggttaaacgtttttaagggtttaaggttttaaacgggttaacggggttaaacccgggttttacccgggggttaaccggggggtaacccccggggtaaaacccgggggttaaccccccgggtttaaccgggggttacccccggttaacccccgggttttaacccccggg

SEQ ID NO: 220309 - DNA, 632 bp, Homo sapiens
  misc_feature: GYAE6OF01BZU0X.38.22.B11.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (617)..(617): a, c, t, g, unknown or other
  misc_feature (617)..(617): n is a, c, g, or t
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctntcctgcagggccagtcagagtgttagcagcaacttgcctggtaccagacaacgaaacctggccaggcctcccgaggtcctcctnatctagtggtnccactccaccgngggcctagtggtactcccgagccgagggtcaggtcggctagggtcgggtctagggactaggtacgttcacgttctaccactactcgacgcacgtcctgactagtctaggtaaagttcttttggactttagtttactttcgtagtcaagtacttaatttaactaacgtttacgccggtaccctttaaccggtacggttcggtaaccgttccgggaccggtaagggggtaaccctaaagggggtacgtaaaacttacccgaaaacggttacgttgggtacgggtacctcggaaccctaaccgtntttccgtcggtttcc

SEQ ID NO: 220310 - DNA, 580 bp, Homo sapiens
  misc_feature: GYAE6OF01A3Z5E.38.22.B11.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccacctgtctgtgtctccgaaggggaaancgccaccctctccngcagggccagtcagagtgttagcagcaacttgcctggaccagacaagaaaccnggaccaggcctccgagcctcctnatctagtggtcncactccacgnggcctagtgtacncccgagccgagggtcaggtcggactagggtcgggtcagggaacaggtacgttaccaccgtctccgaaccgtataccaggcacgtcctacgctagtctaggtaagttactttcgacttagtttactttctgtctagtctaattaactaagttccgtacggtcccttcggttacgtcggacggttccgacggtacggtacctaagggtacgaaacgtacgaaacgtacgtggtacgcgtacacactacttcgtgttacc

SEQ ID NO: 220311 - DNA, 554 bp, Homo sapiens
  misc_feature: GYAE6OF01DH3Z2.38.22.B11.1.454.CMB.1.raw
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
tcagtcgatcacgtcacgaccggtgctcgatttagacgacagctcagggggagaactgctcagttaggacccagacggaaccatggaagccccagcgcagcttctcttcctcctgctactctgcctccagataccagtgaagaaatagtgatgacgcagtctccagccacctgtctgtgtcacgagggaancnccacctcncngacgacggctgcagngtgnacnanacgtcncgtagacagacacgaacncgcgagtcncgagtctcntatcagtcggcacactcaacgcgacactgacctccgagtcgagtcaggtgacgtgggtcggcgtaaggntagtacttcgtaacctcaacnctaatcgacgntacgactgacgtagtacgtaagtaacttgtttacaggtttatttactggtacttacgacttataacgtttacaagttaccgtcgttaccttacgtcggtaacgtacggttaccggacgggaacgaacggtaaggtaacgtacaaagaacggtgttagacgactggaccctagtactgtcgttac

SEQ ID NO: 220312 - DNA, 683 bp, Homo sapiens
  misc_feature: GYAE6OF01EV9JQ.38.22.B11.1.454.CMB.1.raw
  modified_base (201)..(201): a, c, t, g, unknown or other
  misc_feature (201)..(201): n is a, c, g, or t
  modified_base (668)..(668): a, c, t, g, unknown or other
  misc_feature (668)..(668): n is a, c, g, or t
tcagtcgatcacgtcacgaccggtgctcgatttagacgacagctcagggggtagggaactgctcagttaggacccagacggaaccgatggaagccccagcgcagcttctcttcctcctgctactctggctcccagataccactggagaaatgtgatgacgcagtctccagcctaccctgtctgtgtctccgaggggaaacncgccaccctctcctgcagggccaggtcagtagtgttagcagacaacttagcctggtaccagcaagaaacctggccaggcctcccgacggcctcctcatctagtcggtgctactccgaccgagggcccacgtcggtactccccagcccgtagggtccaggtcggacgtagggttcgggtcgtgggaacaggtacgtttccaaccgttctacgaccctaactcgtacgccgtaacggtcccctcgaccctaagttacgttaggtaagtttacttttcgactttacgttttaacttttcgtagttaccaacggttctaatttaaaccgtaagtttacccgtcgggttacccttacccgttaacggtccggggttaaccggttcccggaaccggtaacggggtaaaccgtaaggggttacgaaaacgttaccggaaaacgtggtcggtagggtcctacgggaccaaccgtnttccgtcggtttacc

SEQ ID NO: 220313 - DNA, 689 bp, Homo sapiens
  misc_feature: GYAE6OF01BDOHW.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcaagaaacctggccaggcctcccgaggcctcctcatctatggtgcactccaccgagggcccagtcggtaactccccgagcccgagggtcaggtcggcgtaggtgggtctggggacaggtacgtttccacttcctaccaacctatccgacgccgacggtcccgttgacctacgtcgttaggaaacgtttagttttgtacctttaggttttaacttttccgtgttacctaacgtactaattttaacgtaacttttaccgtcggttacccctttaccggttaaccgggttcggggtacccggtttccggggacccgtaaacggggggtaacccgtaaacgggggttaacgggtaaaacgttacccggaaaaacggtaaccggttcgggtaacgggtccgtacgggtaccctaaaccgtcgtttccgttccggttaccc

SEQ ID NO: 220314 - DNA, 611 bp, Homo sapiens
  misc_feature: GYAE6OF01B4ZLI.38.22.B11.1.454.CMB.1.raw
  modified_base (303)..(303): a, c, t, g, unknown or other
  misc_feature (303)..(303): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagagccgtggggcctcgagtgaaggtctccgtgcaaggtcttcgtggttacacctttacaacttatggtatcaacgtgggtgcgacacggccctggacaagggcttgngtggagtgggatggatcgagcgcttaacaataaactaacacacactatgacaacagaacgttcagggcagacgtcaccgtgaccgacggacacactaccacgagcaacagacctaacagtagggagttggaggacgccgtagacgtactcgacggaccgaaccgacgggccgttagttacgttacgttggtccggacgagtaacgtaacgtaagtaagtttacgttagggttagtacgggtaacgttaccgggtacggggtaccccgtaagggggtaaccccgttgggtacccgtacccggttacccg

SEQ ID NO: 220315 - DNA, 704 bp, Homo sapiens
  misc_feature: GYAE6OF01ACWD1.38.22.B11.1.454.CMB.1.raw
tcagtcgatcacgtcacgaccggtgctcgatttagacgacagctcgaggggggtagggaactgctacaggttaggacccagacgggaaccatggaagccccaggcgcagcttcctcttcctcctgtctactctggcctcccagataccactggagaaactggtgatgacgctagtcctccacgcccaccctgttcctggtgtccgtccggaaggggtaaacgcggccctaacccgtcgtccctaggaccgacggggacccaggtaccaaggtacgttggttaccgcgaggtacctaaacgttagcccttaggtaacccagacaaacgaaaccgttggacctacgggcctacccgaggcctaccctacagttcgtacgtcggtacgacctaactcccgaaccgacgggtacccctaaggttcgggtaacctaccccgacgggtacccggtaacggggtccaacgggtcggaccgtagggttcgggtacgtacgggacgtaggtacgtccacgtacacctaacatacgcacacgtcctgactacggtatagtaacgttagttagtactttagttacttcgtgtctatacttatacgtacttcgtcgtacctacgtagtcggtacgtaccggacggacggtaacgtagggtaacgtacgtaacgaaccggtgtaccggtacacgtaacgaccatcttccgtcgttac

SEQ ID NO: 220316 - DNA, 641 bp, Homo sapiens
  misc_feature: GYAE6OF01C7N38.38.22.B11.1.454.CMB.1.raw
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttggggttttgggggaagaggaagactgacggtccccccagcagcaacaggtgcccactcccaggttcagctggtgcagtctggagctggaggtagaagaagccgtggggcctgaggtgaacggtctcctgcaaggtcttcgtggttacctacctttaaccaacttatggtatacgaacgtgggtacncgacgacggcccctggaacaaggggtcttggagtggagtgggagtggatcgagcgtactaacaaataaacaacacactactatcgacacgaagtaacgtcggaggcagtacgcaccgtacgaccgacgacactacncacganacacacncctaagagtaggacgtaggaggacgtcgagagtactacgtacggaacgtaccggacgggtccgttagttaaccgttgttacggagggtacggtaaggtaaccgttaagaaaggttaatttagtttaggttaagtacggttaaccggtacgggttaccggggaccgtaacggggtacccgttacccgggg

SEQ ID NO: 220317 - DNA, 739 bp, Homo sapiens
  misc_feature: GYAE6OF01BRUNW.38.22.B11.1.454.CMB.1.raw
  modified_base (170)..(170): a, c, t, g, unknown or other
  misc_feature (170)..(170): n is a, c, g, or t
  modified_base (243)..(243): a, c, t, g, unknown or other
  misc_feature (243)..(243): n is a, c, g, or t
tcagtcgatcacgtcacgaccggtgctcgatttagacgacagctcagggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagcgtggtggagtcggtgggggagcggtggtccaggccgtggggacggtcccgngacgtaccttccgtccttggtcgctacggtcccttcgtaggtactttcctacgttttcaggttaacgtttagtggacctagtcggcctacggttcggggtacccgccgacggtcctccggaagggaccgaaaggggggtcctaggggtacggttggggtacgaacgttaaccttaagttacttaagtagtaggtaagtagggtaaataagtagaaattactagtagacacggtaccgtacggtaggaacgggtcctagtttacacgtctacttactaccgaacgtaacgaacttaactaaccgaaagtaaccctaacgtcctacgttcgtacctacgtaactaaacgtcgaaacgttacgtcccggtaagtaaggttaagggtaccggaaaggtaccggacggttacgttaggtacggtttattaacggttggtacgtaagggttaaacggttcgggtttaggggtaccggggtcggtaacggtaacgttaaacgg

SEQ ID NO: 220318 - DNA, 691 bp, Homo sapiens
  misc_feature: GYAE6OF01DYW98.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttgcctggtaccagcaacgaaacctggccaggctcccgaggctcctcatctagtggtgccactcccaccgacgggccctaacgttcggtaactccccgaaggcccgtaaggggtccagggttcggaccgtagggttcgggggttccgttaggggaacctaaggtacggtttcccaaccgttccttaccaaccctagttccgaaacggtcccaacgggtccccttggaccctaaggtttccgtaaggtaaacggttatttttcgggactttaaggtttttactttcgtacgttacagtaccttaatttaacctaattttaccgcgggttacccttccggttaacggtcgggttaccgttcgggaccgaacgggggtaaccctaaagggtacggtaaaactaccgaaaacggtacgtcggtacggcctacgacctacctacttcgtacgttccc

SEQ ID NO: 220319 - DNA, 651 bp, Homo sapiens
  misc_feature: GYAE6OF01BSE2A.38.22.B11.1.454.CMB.1.raw
  modified_base (272)..(272): a, c, t, g, unknown or other
  misc_feature (272)..(272): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtncgacaggccctggacagggcttgagtggatgggatggatcagcgtacttacaattaaataacacaacactaatcgcaacgagaacgttccgaagggcaaggacgtaccgaccgtcgaacccacggaccacactaccgacgagcacgacgacctacgaagtggtagttaggaggacgtccgtaggacgacgttctaggaccgaacgacccgggtaccgttagttaacgtttaccgtgggtacggaccggtaaggtaacggtaaacgaaggtaaagttagttttaggttaaacggttcgggtaaaccgttaaccggttacggggggtaaccccggtaacggggtaaacccccggttgggttaccccgtaacccggttcccg

SEQ ID NO: 220320 - DNA, 629 bp, Homo sapiens
  misc_feature: GYAE6OF01BPEGO.38.22.B11.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaancgccacctctcctgcagggccagtcagagtgtagcagcaacttagcctggtaccagccaaggaacctggccaggcctccaggcctcctcatctagtggcgcatcccacngggccagtggtactcccgagtccgagggtcaggtggcgaggttcggcgtgggaactaggtacgttccaccgttcgtaccaacctatacagcacgtccctgactagtctagtaagttgttttagactttagttttactttcgtgtactacgtacttaagttaactaactttcgtaccggttaccttaccgttacggttccggtacgttacccgggtaccggtaacggggtaaccgtaagggttaacggtaaacgttaaccgaaacggtaacgttacgggtacggtacccgttaggtaccaaccgttacgttcgttcggttaccc

SEQ ID NO: 220321 - DNA, 579 bp, Homo sapiens
  misc_feature: GYAE6OF01EYAW1.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggctcccaggcctcctcatctatggtgcatcccaccgaggggcccactggtactccccgagcccgagggtcaggtcggcaggtgggtctgggacaggtacgttcactctcaccatcagcacgcctgctagtctagtaagtattttgacttagtttatttctgtcagtctaattaactaattaccgtcggtcccttaccgttacggttcgggtaccgttccgggaccggtaacggggtaccgtaaagggtacggtaaactacgaaacggtaacgtggtacggcgtacggccaaccgtacttcgttcgttaccg

SEQ ID NO: 220322 - DNA, 664 bp, Homo sapiens
  misc_feature: GYAE6OF01B91ZA.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgcagtctggagctgaggtgaagaagcctggggcctcagtgaaggtctcctgcaaggcttctggttacacctttacaactatggtatcaacgtgggtgcgacaggcccctggacaagggcttggagtggatggggatgggatcgagcgacttaacgaaataataacacaacactatgacacagtaacgtccgaagggcaagagtccaccggtacgaaccgtaacggaccaacgtactacccgaacgacgaccgtaacgacgtaccctaacgtaaggttacgggtaaggttacgggaacgggaacgtcccgttaagggaacgtaacttacgtacgggaaccgtaaccgtacgggtaccgttagttaacgttacgtaggtacggtacgaaggtaacgtaactaaggtaaacgtttagttacgttaaagtcggtaacgttaacggtcggggaaccgtaaccggggaacccttaccgggg

SEQ ID NO: 220323 - DNA, 597 bp, Homo sapiens
  misc_feature: GYAE6OF01C0CIC.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggcctcccaggcctcctcatctagtggtgcactcccgaccgacgggccacgtggtactccccgagccgagggtcaggtggacaggtgggtctgggacaggtacgttccactctacacctatccagcacgccctgacctagtccgtagtaagttattttcgacttagttttatttcttggtacagtctattactaagttctcggtcccttaccgtacggttcggtaccgttccgggaccggtacggggaaccgtaaggggtacgaaaccgttacgaaaacggtaccgttggtacggaccgttcgacccaaccgtcttccgtgtttacccg

SEQ ID NO: 220324 - DNA, 679 bp, Homo sapiens
  misc_feature: GYAE6OF01BOJJX.38.22.B11.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (379)..(379): a, c, t, g, unknown or other
  misc_feature (379)..(379): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccacctctcctgcgagggccagtcagagtgttagcagcaacttacgccgtggtaccagcaacggaacccggcaggcctccgaggcctcctnatctagtggtcactactcccgacgacgggccacgtggtacctccgagccgtagggtcaggtggcgtagggtcgggtacgtagggaacngggtacttccaactctacaacctatacgacgcctacgtccgtgacgtacgttcgtaagtaagttacgttttcgtacgtttagtttttattcgttacgtactacgtacttaactttaactaacgtttaccgtaccggttacccttaccggttaacggttccgggttaacccggttaccgggacccgggtaaacggggtaccgtaaacgggtaaccggtaaacgtaaccgtaaaacgggtacggttgggtaccggtacccgtacgtaccgtaaccttagttccgttacgtttcttaaccccg

SEQ ID NO: 220325 - DNA, 529 bp, Homo sapiens
  misc_feature: GYAE6OF01A7R12.38.22.B11.1.454.CMB.1.raw
  modified_base (323)..(323): a, c, t, g, unknown or other
  misc_feature (323)..(323): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
  modified_base (491)..(491): a, c, t, g, unknown or other
  misc_feature (491)..(491): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtgcgacaggccctggacaagggcttgagtggatgggatggatcgagcgcttanaataataacacacactatgacacagaagtccaggcagagtcaccgtgaccacggacacactccacgagcacagcctaanagtggagttgaggacgctgagtatcngaccgacgacggccgtgtacttacgngtcgcgagtagtacaagattattgtatggacttacgnggggtacccgacgggtaacccgtcggccgtcccggtcg

SEQ ID NO: 220326 - DNA, 623 bp, Homo sapiens
  misc_feature: GYAE6OF01CDCBF.38.22.B11.1.454.CMB.1.raw
  modified_base (154)..(154): a, c, t, g, unknown or other
  misc_feature (154)..(154): n is a, c, g, or t
  modified_base (352)..(352): a, c, t, g, unknown or other
  misc_feature (352)..(352): n is a, c, g, or t
  modified_base (614)..(614): a, c, t, g, unknown or other
  misc_feature (614)..(614): n is a, c, g, or t
tcagtcgatcacgtcacgaccggtgctcgatttagacgacagctcaggggacccaaaaaaccacacccctccttgggagaatcccctagatcacagctcctcaccatggactggacctggagcatccttttcttggtggcagcagcaacaggtncccactcccaggttcagctggtgcagtctggagctgaggtgaagaagccgtggggcctcagtgaaggtctcctgcaaggcttctggttacacctttaccaatatggtatcaacgtgggtgcgacacggccctgggacaagggcttgaggtggagtggggatggactcgagcgcttaacaaataataacacaacactancgacacgaagaacgttccgagggacaaggacgtacgaccgtagaccgacggacacactaccgacgagaccaacgacgtcctaagacgtaggtagtttaaggacggtactcccgtaggaacgactaccgtacggaaccgtaaccggaccgggtaccgttagttaacgtttacgtggtacgacggtaagtaacgtacgtaagtaattagtttagttagtacggtacttacggacggggtaccacggggtaaccctgggttcccnccggttccg

SEQ ID NO: 220327 - DNA, 615 bp, Homo sapiens
  misc_feature: GYAE6OF01DBO0A.38.22.B11.1.454.CMB.1.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (608)..(608): a, c, t, g, unknown or other
  misc_feature (608)..(608): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctaccgaggggaaangcccacctctcctgcagggccagtcagagtgtagcagcaacttagcctaggtaccagacacgaacctggccaggcctcccgaggcctcctacattctagtcggtacncaactcccaacgacgggcctacgtcggtacnccccgaggcccgaagggtcaaggtgaccgtaggtcggtacgtgggacctaggtacgtttccaacgttcgtaccaactagtaccagtaccgacgccgtgacgtagttactaaggtaaggttactttacgggactttaaggttttctttcgtagtacctagtctaacgtttaactaagtttccgtcgtacctacgttacgtcggtaccgttcggacgacggggtaccaaggtacgaactacgaaacgtacgtgtacgactcgacactacgttntgttacc

SEQ ID NO: 220328 - DNA, 612 bp, Homo sapiens
  misc_feature: GYAE6OF01DGJVQ.38.22.B11.1.454.CMB.1.raw
  modified_base (199)..(199): a, c, t, g, unknown or other
  misc_feature (199)..(199): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtcctccagccaccctgtctgtcgtctccgaggggaaancgcccaccctctcctgcagggccagtcagagtgtagcagcaacttgcctggtaccagacagaaacctggcccaggcctcccgaggcctcctcatctatggtgcactccaccgagggccacgtggtactcccagccgtagggtcaggtggcgtagggtgggtcgtgggacagtagttccactctcaccatcgagcacgtcctgactacgtcgtaggtaagttattttcgactttagttttactttcgttcgttactagtcctaattaactaacgtttaccgtcggtacccttaccgttacgggttcggtaccggtttccggaccggtacggggaacccgtagggttaacgggaaacctacggaaacggtacgtacggtacgggtacctcggactaccgttactcgttgttaccg

SEQ ID NO: 220329 - DNA, 590 bp, Homo sapiens
  misc_feature: GYAE6OF01ATA4Z.38.22.B11.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcagctaacttagcctggtaccagcaagaacctggccaggctccaggcctccnatctagtggtgctatcccgaccgagggcccagtcggtactcccgagccagggtcaggtggcagggtgggtctagggacaggtacgttcacttcgtacaccatcgagtcacgtcctagctagttctaggtaagttgtttacgctttagttttactttcgtagttacagtacttaacttaactaatttaccgtcggtccttaccgttacggtcggtaccgttccggacggagggtaaccgaagggtacgtaaacttacgaaacggtacgttcggtacggtacgtcgaccgaacattccgtcggttac

SEQ ID NO: 220330 - DNA, 662 bp, Homo sapiens
  misc_feature: GYAE6OF01AWFEP.38.22.B11.1.454.CMB.1.raw
  modified_base (426)..(426): a, c, t, g, unknown or other
  misc_feature (426)..(426): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttctggtggcagcagcaacaggtgcccactcccaggttcagctggtgcagtctggagctgaggtgaagaagcctggggcctcagtgaaggtctcctgcaaggcttcgtggttaccacctttaccaactatggtatcaactgggtgcgacacggccctggacaagggtctggagtggagtgggatggatcgagcgtacttacaataataacacacactatgacacgagtaacgttaccgagggacaaggacgtacaccgtgaacccgacggacacataccacgagaccacacgcctaanagtacggagttacgaaggacgtaccgtaggacgtagtaccgtaggtaaccggaaccgtaccgggtacccgtttaggtaactttaccggtaggtacgtaacggaaaggtacgttaaccgtaaaggttaaacgtttaaggtttagttacggttaacggtaacccgttaagggttaaccggggtacccggtaacggggttaaacccccgttggggttaccccgaccggtttaaccccgg

SEQ ID NO: 220331 - DNA, 944 bp, Homo sapiens
  misc_feature: GYAE6OF01DQVDX.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactggaccggtccccccagcagcaacaggtcgcccactcccaggttcagctggtgcagtctggagctggaggtgaaggaacgccgtggggcctcgagtgaaggtctcctgcaggtcttcgtggttaacctacctttaaccaacttagtggtactacgtaacgttggggtcgaccgtaaccgaccgggtccccccgtagggaaccggtaacgggggtccgtttaggaagggttagggtaacggttgggggtaacgttcggggtaacgttaccggaacgggttacccggttaaccgtttaaaacctaaaacgtttaaaaacgtaaaacccgaaacccgtaaacgttaaaccttaaacggtaccggtaaacccgtaaaccggtaaacgggttaaaaccgggtttaccccggaaacggggggtaacccgtaaacggggttaaaccggttaaccccggaaaccccgggtttaaccgggaaaaccccccggaaacccggggtaaacccaaaacccggtaacccgttaaccccgaaaccgggaaacccgtaacccgaaacccggtaacccgtaaaccccgttaaccggtaacgggttaacggggtaacggtttaacgggaacggggtaaccggtaccggttacgggtaacgtacgttaaccggtacggaacccggtaaccggtaccggggttaccgttacgttaacttaccggttaggtacggacggtaaggtacgtacgtaagttaagttagttacgttagacgggtaacgtacgggtacgggtaccggtaaccgggtacccgttaccggg

SEQ ID NO: 220332 - DNA, 745 bp, Homo sapiens
  misc_feature: GYAE6OF01B6OV0.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagcccagcgcagcttctcttcctcctgctactctggctcccagataccactggaagaaatagtgatgacgcagtctccagcccaccctgtctgtgtctcgaggggaaacncgcccacctctcctgcgagggccagtcagtagtgtagcagacaacttgccgtgtaccagacaacgtaaccgtggacccaggcctacccgaggtcctacctctattctagtggtcacctactccgacgacggcctacgtcggtactcccgaagccgtaagggtcagggtcgacgtagggtcgggtacaggggaacaggtacgtttccaccgttctaaccacttacgacgaccggactaaccgtccgttacggaccttaaggttccgtaacggtaaacggtttacgtttttacgacgtttttaacgtttttcttttaccgtaggttacctacggttaacctttaacgtttaacgtaaccgttttccgttaccggttaccccgtttaaccgttagggttacccggggttaccgggttaaccggggtaacccgggtaaacggggtaccgggttaaaaccgggttaaggtaaaaccttaaccggaaaacggttacggttaccgggtaggtacccgttaagtaccctaaaccgtttacgttccgttggttacc

SEQ ID NO: 220333 - DNA, 616 bp, Homo sapiens
  misc_feature: GYAE6OF01AUPMO.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggcctccaggcctctcatctagtggtgcatcccacgagggcccacgtggtactcccgagccgagggtcaggtggctaggtcgggtctggggacaggtagttccacttcctacacctatccgagccacgccctggcctagttcctaggaaagttattttcgactttaagtttttactttcgtagttacaggtaccttaatttaacgtaatttaccgtacggtacccttacccgttacgggttacggtaccggttccggaccggtaacggggtacccgaaaggggttacgaaaactacgaaacggtacgtggtacggtaccgtacgaccctaacctacttcgttcgttccc

SEQ ID NO: 220334 - DNA, 675 bp, Homo sapiens
  misc_feature: GYAE6OF01AJ9PH.38.22.B11.1.454.CMB.1.raw
  modified_base (356)..(356): a, c, t, g, unknown or other
  misc_feature (356)..(356): n is a, c, g, or t
  modified_base (437)..(437): a, c, t, g, unknown or other
  misc_feature (437)..(437): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgaccggtccccccagcagcaacaggtgcccactcccaggttcagctggtgcagtctggagctggaggtgaagaagccgtggggcctcgagtgaaggtctcctgcaaggcttcgtggttaccacctttaccaacttatggtatcaacgtgggtcgcgacgacggcccctggacgagggtcttggagtggagtgggatggatcgagcgtacttaanaataataacacacactatgacacgagtaacgttcgagggcaggacgtccaccgtacgaacccgacgacacactccacgacncacacgacctacgagtagggtacgtaggaacgggacgtaccgtaggaacgtacgtaccggtacggaacccgtaaccggtaccgggtaccggttacgttaacgttaccgtaggtacggtaccgggaaggttaacggtaaccggtaaagttaaacgtttagttttagggttaacgttacgggtaaccgttacccggggttacgggggacccggtaaaccggggtaaccccggttaccggg

SEQ ID NO: 220335 - DNA, 765 bp, Homo sapiens
  misc_feature: GYAE6OF01CN7MP.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaanacgcccaccctctcctgcgagggccagtcagagtgtagcagactaacttcgccgtaggtaccagacgaacgaaccgtcggaccaacggcctacccgacggtcctccgtacacttcgttagtcgggtcgacctacgtaccccgaaccggtaacgggccctaacgttacggtacctccccgaggtccggaggttccgaggtcggacgtacgggtcggtcggtacgggactacggtacgttcctacctccgtaccaccgtacgtcgacgtaccgtacgtcccgtagtaccgtaacgttcgttaacgttaagtttacttttaggtacttttaagtttttacgttcgttagttacccgtaagttaccttaaacttttaaccgtaacgtttaccggtaccgggtacccttttaccgggtacgggttccgggttacccgggttacgggacccgggtaacggggtaacccgtaaagggggtttaaaccgaaaccgtaaaccggtaaaaccggttacgttacgggttaccggccttaacgggtaccctaaccggttacttcccgtttcggttaaccc

SEQ ID NO: 220336 - DNA, 641 bp, Homo sapiens
  misc_feature: GYAE6OF01AYPI0.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgcacgggccagtcagagtgttagcagcaacgttagcctggtaccagcaagaaacctggccaggcctcccgaggctccgtcatcctatggtgcactccacgacgggccacgtggactccagccgaggtcagtggcaggtggctgggacaggtattcgactcgtaccacgattccagtcacgtcccgtgccaagttccgtagtagttacttttgacttaagtttacgtttctgtcgtacgtacttaacgttaactaagtttccgtaggtcccttaccgttacggttacgggtacccggttcgggtacccggaacggggtaaacccgtaagggttaacggtaaaaccgttaacggtaaacccgggtaaaacgttcgggtaacgggtacccgtacgtaacccgtaacccgtaattccggttaacgttaccccg

SEQ ID NO: 220337 - DNA, 707 bp, Homo sapiens
  misc_feature: GYAE6OF01DNJGA.38.22.B11.1.454.CMB.1.raw
  modified_base (332)..(332): a, c, t, g, unknown or other
  misc_feature (332)..(332): n is a, c, g, or t
  modified_base (661)..(661): a, c, t, g, unknown or other
  misc_feature (661)..(661): n is a, c, g, or t
  modified_base (692)..(692): a, c, t, g, unknown or other
  misc_feature (692)..(692): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaacagccaccctctcctgcgaggccagtcagagttgttagcagctaacgttacgccgttaggtaccagacaacggaaaccgtcggaccgaacggccctacccgaggtccctccgtctaacgttccttagtcgggttcncctaaccgtcccaaccggacgggaccctaagttccgggtaacctccccgaaggtcccggtagggttccgaggttcgggctaggggtgggtacgtgggacgaggttacgtctaccgtctacgtaccactacgacgccagtcctgaccgtagttaccgtaaggtaatttagttttcgactttaagttttactttcgttagtacttagtacttaacgtttaactaacgtttacccgttcggtacccttaccgtacggttaccggtacgggtttccgggaaccggtacggggtaaaccgtaaggggtaaccgtaaaacgtacgaaaccggttnttcgggtacgtccgtacgacctaacccgttntccgttgttaacccg

SEQ ID NO: 220338 - DNA, 730 bp, Homo sapiens
  misc_feature: GYAE6OF01ASB2T.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgccaccctctcctgcgacgggccagtcagagtgttagcagcaactagcctggtaccagacaacgaaacctggaccacggcctcccgaaggtcctccctacattacctagtcggtacgccgactcccaaccgacggggcccctaacgttcggtaacctccccggaaggtcccggaacggggttcgaacggttcgggcgtaaggggttcggggtccgtacgggggaacctaagggtaccgtttccgaaaccgttcctaccgaaccctataccaacggacctacggtcccgttacgacgttaacggtacgtaaggtaaacgtttagttttacgactttaacggtttttacttttcgttagtacctacgtactaaactttaactaacgttaccgttacggtccccttacgttacgggtacggttacccggttcgggtaaccggaacggggtaaaccgtaaacgggtaacggtaaacgtaagaaaccggttaacgtgggtacgtacgtacgtaccaaccgttactcgttcgtttacc

SEQ ID NO: 220339 - DNA, 569 bp, Homo sapiens
  misc_feature: GYAE6OF01DU4Q8.38.22.B11.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (554)..(554): a, c, t, g, unknown or other
  misc_feature (554)..(554): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctccctgcagggcccagtcagagtgtagccagctaacttagcctggtaccagcaacgaaacctggccaggcctcccgaggcctcctcatctagtgggtcncactccaccgacgggcctacgtcggtactcccacggccagggtcaggtcggcgtaggtgggtccgtgggacaggtagtccacgtcctacgaccatccgagcgacgcctgcgtagtcgtagttaagttcgtttagtacgtttagtttagtttcgtgttacngtaaaaactnttaactattacgtcgtccttcgtacgtcggtacgtcggcgacggaccgtaggtacgaactagaacgtatggcgtancgacacgtatctgtc

SEQ ID NO: 220340 - DNA, 542 bp, Homo sapiens
  misc_feature: GYAE6OF01AETKH.38.22.B11.1.454.CMB.1.raw
  modified_base (287)..(287): a, c, t, g, unknown or other
  misc_feature (287)..(287): n is a, c, g, or t
  modified_base (434)..(434): a, c, t, g, unknown or other
  misc_feature (434)..(434): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaactgggtncgacaggcccctggacaagggcttgagtgatgggatggatcagcgcttaacaataataacacacactatgcacagaacgttcagggcagacgtcaccgtgaccacggacacatacccacgagcacgacgacctacatggagtgaggngctgagatcgtgacgacgacggccgtagtactacgtgtgacgagtacgtacgagtaattgttacgttataggtaccttacgtacggggaccgaagggtacccgtcggg

SEQ ID NO: 220341 - DNA, 693 bp, Homo sapiens
  misc_feature: GYAE6OF01EPK7G.38.22.B11.1.454.CMB.1.raw
tcagtcgatcacgtcacgaccggtgctcgatttagacgacagctcagggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcagtgaaggtctcctgcaaggcttcgtggttacacctttacaactatggtatcaacgttggggtgcgacacgggtccctaggacgaagggcttggagtggagtgggagtggatcgagcgacttaacaataataacacacactatcgacacgaagtaacgttccgagggacaggtacgtaccacggtacgaacccgaacggacacgactacccgaacggacgacgaaccgacgaccttaacgaggttacgggtaggtttaggaacgggacgtccgtaaggagtattccggacgaaccgggtaaccgaccgggtaccgtttaaggttaacgtttacgtcgggtacggacggtaaggtaacggttaacgtaaggttaaagtttacggtttagtttaacggtacgggtaaccggttaacgggtacgggggtaacccggtaaaccggggtaaccccgttcggggtacccgtcccgggttaacccg

SEQ ID NO: 220342 - DNA, 616 bp, Homo sapiens
  misc_feature: GYAE6OF01EKEBK.38.22.B11.1.454.CMB.1.raw
  modified_base (197)..(197): a, c, t, g, unknown or other
  misc_feature (197)..(197): n is a, c, g, or t
  modified_base (454)..(454): a, c, t, g, unknown or other
  misc_feature (454)..(454): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcgagggccagtcagagtgttagcagcaacttagcctggtaccagcaagaaccctggaccaggcctcccgaggcctcctcatctagtggtcgaccactcccaccgacgggcctacgtcggtactcccgagccgagggtcaggtcggcgtagggtgggtcgtagggactaggtacgttccacttcacacctatcgagacacgcctcgcgtagtctagtaagttagtttcgactttagttttnttcgtgtactagtactattaacgtaactttacgtcgtacccttaccgttacggttcgggtaccgttcggacggtaacggggtaccgtaagggttaacggtaaactacggaaaacgtacggttcggtacggtactaccgactaccgttgttccgttgttaccc

SEQ ID NO: 220343 - DNA, 574 bp, Homo sapiens
  misc_feature: GYAE6OF01BKP2I.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatcccaccagggcccactggtactccccgagccagggtcaggtggctaggtgggtctggggacagtacgttcacttctcaccatcagcagcctgctagtctagaagtattttgctagttttatttctgtcagctattaactaattaccgtcggtcccttaccgttacgtcggtacgttccggaccggtacggggtaaccctaagggtacggtaaaacgttaccgaaaacggtaacgttacggtaggcttacggacctaacccgattccgttgttacccg

SEQ ID NO: 220344 - DNA, 691 bp, Homo sapiens
  misc_feature: GYAE6OF01AUEOO.38.22.B11.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctntcctgcagggccagtcagagtgttagcagcaacttgccttggtaccagcagaacctggccaggctcccaggcctcctnatctatggtnccatcccacgagggcccagtggtaactcccgagcccgagggtccaaggtcggtcgaggttcgggtcgtcgggactacggaagtttccaacgttctccgaacctagtccaggccacggcctgccgtagttaccgtagtaaaggttattttcgggactttacggtttttaactttccgttggttaccgtaacggtaccttaagtttaaccgtaacgtttaccttacgggttaccccgtttaccttaacgggtttacggtaacccggttttccgggacccggtacggggggttaaacccctaaaggggttaacgggtaaaacgttaacccgaaaacgggtaaccgttacgggtacggtccgttaacgggtaccaaccccgttaacgtccgttacggtttacc

SEQ ID NO: 220345 - DNA, 586 bp, Homo sapiens
  misc_feature: GYAE6OF01DXLXJ.38.22.B11.1.454.CMB.1.raw
  modified_base (321)..(321): a, c, t, g, unknown or other
  misc_feature (321)..(321): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaagcttctggtacacctttacactatgtatcaactgggtgcgacacggcccgtggacaagggctgagtggagtgggagtggatcagcgcttaanaaataataaacacaacactatgcaacagaagttccagggcagacgcaccgtgaccacggaacacaatccagagcaacnacctacatggagtggagagcctagagntcgngaaccggacacggacccgtgttaacttcgtagtcggaccgaagaagtaccgtaaaggactttaagtttggtttaagtacgggaaccgtttaacgggtcgggggggtaacccgaaacgggggttaccccttagggggtcccctaacccggtttcccg

SEQ ID NO: 220346 - DNA, 551 bp, Homo sapiens
  misc_feature: GYAE6OF01EF1SF.38.22.B11.1.454.CMB.1.raw
  modified_base (197)..(197): a, c, t, g, unknown or other
  misc_feature (197)..(197): n is a, c, g, or t
  modified_base (327)..(327): a, c, t, g, unknown or other
  misc_feature (327)..(327): n is a, c, g, or t
  modified_base (406)..(406): a, c, t, g, unknown or other
  misc_feature (406)..(406): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcagcaacttagcctggtaccagcagaaacctggccaggctcccaggcctcctcatctatggtgcactccaccgagggccagtggtactcccgngccgagggtcaggtggctaggtgggtctggggacaggtagttcactctcaccatcagcacgcctgcagtctagtaagtntttgcttagtttatttctgtctacgctaattaactaattcgtcgtcccttcgttacggtcggtaccggttcggccgaacggggtaccaagggtacggaaactacgaaacgtacgtggtaggctacgactactactcgtgttaccg

SEQ ID NO: 220347 - DNA, 672 bp, Homo sapiens
  misc_feature: GYAE6OF01A2PNW.38.22.B11.1.454.CMB.1.raw
  modified_base (252)..(252): a, c, t, g, unknown or other
  misc_feature (252)..(252): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtcccagccaccctcgtctgtgtctccgagggaaaggacgccaccctcctcctcgcgacggccacgtcagagtgttagcacgcactagtccnggtaccacgcgaacgaaaccgtcgccgacggccgtcccacggcgtcctccatctagtcggtgcacgtcccacccgacgggccgacctggtactccccacggcgacgggtccgtagaggcgacggttggggtacgtcggggactaaggtacggttccacgtcctaccgaccactacgacgcgacgcccgtgtaccgagttaccgtagaacggtttaattttcggtaccgttattttactttcgttacgtcgtaacgtactaactttaacgttaacgttacggttacccgccgttacccgtttaacgggtcggttaacccggttacggtaccgggacggggtaacccgtaagggttaacggtaacgttacgaaccgtaggtacgttcgggcctacgaccactacgtacgttcgtcttacccg

SEQ ID NO: 220348 - DNA, 761 bp, Homo sapiens
  misc_feature: GYAE6OF01CO9NV.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggccagtcagagtgtagcagcaacttgcctggtaccagcaacgaacctggaccaggcctcccgaggcctcctcatctagtggtcgaccactcccacgacgggcccacgtcgggtactcccgaggcccgtagggtaccaggttcgggacgtagggtcggggtactcggggacaggtaacgttccaaccgtcctaccgaacctataccgagtaccacgtccgtaggctaggttacctaggtaaacggtttactttttacgaccgtttaaggttttttatttaccgttaggttaccgtaacggttaccttaaagtttttaaaccctaaacgttttacccggttaccggttaccccttttacccgggttaaccgggtttaccggggttaccgggtttaccccggggacccgggtaaacgggggtaaacccggttaaaggggttaaacggggtaaaaccgtaaccgggttaaaaaccggtaccggtttaggggtacgggttaccgttaccgaacccgttaaccggttaccgtttcgttccggtttaccc

SEQ ID NO: 220349 - DNA, 848 bp, Homo sapiens
  misc_feature: GYAE6OF01AHCD0.38.22.B11.1.454.CMB.1.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagagccgtggggcctcagtgaagtctcctgcaggcttctggttacctacctttaccaactatggtatcaactgggtncgacncggccctggacagggcttggagtggagtgggatggactcgaggcgtactttaacgaaattaactaaaccaccaaccgtaacttaacgttcggaaccaacgaacggtaaaccggtttcccgaagggggccaacgggtaacgtcccgaaccggttaccggaacccgacgggaaccacccgaacgtaccccgaacggtaaccggaccaacccgtaacggtaccccttaacgtacgggttaacgggttaaacgggtttacgggaaccggggtaacggtccccgttaagggtaaccggtacgttaaccggttacggaaaccccggggtaacgtaccccgggggttacccgtttacgggttaacgtttaacccgggttcgggtaggttaacccggtaaacggggtaaccggtttaaaacccggtaaaggtttaaacggttttaacgttttaacgggttttaacgggttaaccggggttaaacccggtttaacccgggggtaaccgggggggttaaccccccggttaaacggggggtttaaccccccgggtttaacccggggg

SEQ ID NO: 220350 - DNA, 710 bp, Homo sapiens
  misc_feature: GYAE6OF01BZVCS.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaancgccaccctctcctgccagggccagtcagagtgttagcagcaacttagcctggtaccagcaagaaacctggccaggctcccgaggcctcctcatctagtggtgctagtcccacgagggccctagtcggtaactcccgaagtccgagggtccaggtggacctagggtcgggtctaggggaacctaggtacgtttcccgaaccttcctaccgaaccctacgttccgaacgcctaacggcccgttggaccctaggtaccgtaacggtaaaggtttactttttcggactttaaggtttttacttttaccgtcggttactaacggtactttaaacgtttaacctaaacgttttaccgtcgggttaaccccttaccggttacgggttaccgggttacccggtttccgggaccggtaacgggggtaaaccgtaaggggtacggtaaaacgttaaccgaaaccggtaacgttcgggtacggtaccttacggaaccctaaccgtactttcccgttgttacccg

SEQ ID NO: 220351 - DNA, 687 bp, Homo sapiens
  misc_feature: GYAE6OF01CAC63.38.22.B11.1.454.CMB.1.raw
  modified_base (547)..(547): a, c, t, g, unknown or other
  misc_feature (547)..(547): n is a, c, g, or t
tcagtcgatcacgtcacgaccggtgctcgatttagacgacagctcaggggacccaaaaaccacacccctccttgggagaatcccctagatcacagctcctcaccatggactggacctggagcattccttttcgttgggtggcagcagcaacgaggtcgcccactcccaggttcagcgtggtgcagtcgtggagcgtggaggtaggaagaagccgtggggcctcgaggtggaacggtctccgtgacgaaggtcttcgtacggtttacctaaccgtttaaccaacttagttaggtactacgtaacggtgggtcgacgacgaccggtacccgtaggaacgacgggtcttaggaggtggtagtgggacgtggactacgagacgtactaactaaataaacaacacaactactatacgaacgtaacaacggtaacgtaccgagggactaggacgtaccgaaccgtacgaacccgaacggaccaactacgtaccaacggacgacaacgacgtaccgtaacgtagtagggtacgtaggaaggtccgacgtagganacgttacgacgaaccggtaccggccggtacgttagttaacttgacgggtagacggtagtaagtaacgtaagaagtttgttaggtaagtacggtacgtaggacggggtacctaacgggtaccctcgtacccgtcgtacccg

SEQ ID NO: 220352 - DNA, 633 bp, Homo sapiens
  misc_feature: GYAE6OF01EA506.38.22.B11.1.454.CMB.1.raw
  modified_base (483)..(483): a, c, t, g, unknown or other
  misc_feature (483)..(483): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagcccaccctgtctgtgtctccgaggggaaagcgccaccctctcctgcgagggccagtcagagtgttagcagctaacgttacgcctggtaccagacaacgaacctggaccaggcctcccgacggtcctcctcactctagtggtgctactcccgaccgacgggcctacgtcggtactcccgagccgagggtcaggtggcgtagggttcggtcgtagggacgtaggtacgtttcgacctccgtacactacgtacgacgtacacgtcctcgactacggtactagtagtatttgtacttagtttattcgtgtactacgtntaacgttaactagttacgtcggtaccttacccgtacgggttacggtacccggtttccggaccgggtaacgggaaccgtaaagggtaacgaaacgtacgaaacggtacggttaggacggtactacgtaacctccttaactcgtcttacccg

SEQ ID NO: 220353 - DNA, 645 bp, Homo sapiens
  misc_feature: GYAE6OF01BJPP5.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcgagtgaaggtctcctgcaaggcttctggttacaccttacaactagtgtactcaacgtggtgcgacacggccctggacgaagggtcttaggaggtcggagtggggagtggagtacgacggtcgtacgttaacaaagtaataaaccaaccgaactaactagtacgacaacaagtaacgttccgaagggtcgaagacgctaccggtcgaaccgacggacacactaccgaacgagaccacacgacctaacgagtcggtagtacggaggacggtaccgtagaacgacgtacgacggaaccgaccggaccggtaccggttagttaacgttacgtaggtacggacggtacggagttaacgaaagttaacgttagttagttagtacgggattaccgggagggacccggtacggaaccggttcggtaccgcccggttacccg

SEQ ID NO: 220354 - DNA, 614 bp, Homo sapiens
  misc_feature: GYAE6OF01AEOXT.38.22.B11.1.454.CMB.1.raw
  modified_base (279)..(279): a, c, t, g, unknown or other
  misc_feature (279)..(279): n is a, c, g, or t
  modified_base (448)..(448): a, c, t, g, unknown or other
  misc_feature (448)..(448): n is a, c, g, or t
tcagtcgatcacgtcacgaccggtgctcgatttagacgacagctcaggggacccaaaaaccaacaacccctcccttgggagaatcccctagatcacagctcctcaccatggactggacctggagcatccttttcttggtggcagcagcaacaggtgcccactcccaggttcagctggtgcagtctggagcgtgagggtgaagaagccgtggggcctcagtgaagggtctcctgcaaggcttctggttacacctttacaactatggtatcgaactgggtncgtacacggccctggacaagggtcttgaggtggatgggatcggatcaggcgtacttacgaaataagtaaacacgaactaacttagtacgacaaccgtagaaacgttccgaagggcaaggacgtacgaccgtggaaccacggactaaccgataccgacgagaccacgacnctaacgattaggatttgggaaggacgccgtagacgtagtaccgtaaggaccaaccggacgtccggttaatacggttaactggtcgagacgtgtaaacgaataagtacttagtaacggttgtacctaggttgggaccgaaagggtacctacggtcgaaccgttcccg

SEQ ID NO: 220355 - DNA, 762 bp, Homo sapiens
  misc_feature: GYAE6OF01BTSC2.38.22.B11.1.454.CMB.1.raw
  modified_base (637)..(637): a, c, t, g, unknown or other
  misc_feature (637)..(637): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtcgtggagctggaggtagaagaaggccgtggggcctcgagtgtaacggtcctaccgtgaccgaaggtctttacgtaggttaacctaacccttttaaccgaaacttagttaggttaactaccgtaaacgttggggtacgaccggtaacgaaccggcccccgttagggaaccgtaaggggtccttaggaggttagggaggtgggaagtgggactcgaacgtccgtacttaaacaaattaaacgtaacaacacctagtatacgacaacgagtaaacgttccggaggaccaggtacgtaaccgtaccgtacgacccgtaacggacctacacgtaccccgaagacgtacaacgacgacctacgagttgggagttacgaggcgtacgtaggatacgttaccgaaggaccgtaacccggtacggttcccgttaaggtacgtttaaccggnggtaacggtaaccgtaaggggtaacgtaagtaaggttaattttacggttagtttaaacggtacccgggttacggttaacggggaccggggtaaaccccggtacgggttaaccccggttacccggg

SEQ ID NO: 220356 - DNA, 707 bp, Homo sapiens
  misc_feature: GYAE6OF01CP597.38.22.B11.1.454.CMB.1.raw
  modified_base (398)..(398): a, c, t, g, unknown or other
  misc_feature (398)..(398): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttggggttttgggggaagaggaagactgacggtcccccagcagcaacagtgcccactcccgaggttcagctggtgcagtctggagctggaggtagaagacgccgtgggcctgagtgaggtctcgtgctaaggtcttcgtacggtactaccttaccaacttagtacggtactacgaacgttgggtcacgacgacggccccgtaggacgaacggtcgttgagtggagttggagtggtatcgagtcgtacttaacaaataactaaccacaaccattagacgacaanaacggtaacgttcgaaggtacacgtaacggttccaaccggacgaaccgaccgaacgaaccgacgtacccgaacgcgaacacgtacaccgtaacgtaggtacgtagtacgacggtacgacgtacgaagtcgtacggtacgaacgtaccggtaccggtacgttagttaccgttcggtaggtacggaacggtaacgggtaacgtaacgtaaaggttaattacggtttaacgggttaacgttacggggtaacccggtttacgggtacccgggggtaaccgtaaaccccgggggtttaaccgttacccccgggg

SEQ ID NO: 220357 - DNA, 785 bp, Homo sapiens
  misc_feature: GYAE6OF01ELZEE.38.22.B11.1.454.CMB.1.raw
  modified_base (337)..(337): a, c, t, g, unknown or other
  misc_feature (337)..(337): n is a, c, g, or t
tcagtcgatcacgtcacgaccggtgctcgatttagacgacagctcagggggaggaactgctcagttaggaccagacggaaccatggaagccccagcgcagcttctcttcctcctgcctactctcggctccgaggataccactggagaaatgtgatgacgcagtctcagcctacctgtctgtgtctacgaggggaaagcgccaccctctccgtgcgagggccagtacgagtagtgtttaacgctagtacaactttacgccttaggtaccaggtcaaggaaaccctgggacccaagggcctaccccgaaggtcctacctcgacgttctaaggtcggtanaccgagtcccacggtaacgggcctaacgtggtaaccttcccaaggcccgtaaacggggttccaaagggtcgggtacctaagggtttacgggtaccgtttggggaaacctacgggtacggttttccccaaactttccggtaaccaaaccgtacgttaccgaacgggtacccaacggtaccttcggaaccgtacggtaccctaggtaaacgttagtttttaccggacgttttaaaggtttttacctttacgtacgttactaacggtactaaacgtttaaccttaacgtttaaccgtcgggttaacccgtttaccggttaacggttacggggtaacccgtttcgggaacccgggtaaaggggtaaaccgtaaagggttacgggaaaactacggaaaaccggtcgtaggtacgtaccggttaacgacctaaccggtcttcgttaacggttcc

SEQ ID NO: 220358 - DNA, 806 bp, Homo sapiens
  misc_feature: GYAE6OF01DGM44.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgcccaccctctcctgcacgggccagtcagagtgttagcagcaacttagcctaggtacccagaccaacgaaacccgtcggacccaacgggccctccccgaaggtcccttcccgtacctacttccgttaagttcggggtcgacctaaccgtaccccgaacccggtaacgggggcccctaaccggtttcgggtaaccctcccccgaacgggtacccggtacggggtcaacgggttcgggaccggtaaggggtttcggggtaccggtaggggaacctaaggttacggttccctacccgttccgtaccaacccgtagttccgaacggtcccacggtccccgttacgaccgttagttacgttaaggtaaacgtttcgtttttcggtacgtttaacgttttttaccgtttaccgttggttaccgtacggttaccttaatttaaccgttaatttacccggtcggttaccccgtttaccgttacgggttacgggtacccggtttccgggacccggtaacggggaacccgtaacggggtaaggtaaaaccgtaacggtaaaaccggtacggttcggtacggacttacggacctaccgtacttcgtcgtttaacccg

SEQ ID NO: 220359 - DNA, 531 bp, Homo sapiens
  misc_feature: GYAE6OF01ETSWR.38.22.B11.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctgganctgaggtgaagagcctggggcctcagtgaaggtctcctgcaaggcttctggttacacctttacactatggtatcaactgggtncgacaggcccctggacaagggctgagtggatgggatggatcgagcgcttacaataataacacacactatgacanagaagttccgagggcagagtcaccgtgaccagacacatccacgancacanccanatggagtgagagcctgagtactcgtagacgacgacggtcgtagtattacgtggtcgacgagacgtaacgagtaattattagtataggtactacggtaggggccgtagggaccctacggg

SEQ ID NO: 220360 - DNA, 755 bp, Homo sapiens
  misc_feature: GYAE6OF01DCW36.38.22.B11.1.454.CMB.1.raw
  modified_base (153)..(153): a, c, t, g, unknown or other
  misc_feature (153)..(153): n is a, c, g, or t
  modified_base (200)..(200): a, c, t, g, unknown or other
  misc_feature (200)..(200): n is a, c, g, or t
  modified_base (693)..(693): a, c, t, g, unknown or other
  misc_feature (693)..(693): n is a, c, g, or t
  modified_base (747)..(747): a, c, t, g, unknown or other
  misc_feature (747)..(747): n is a, c, g, or t
tcagtcgatcacgtcacgaccggtgctcgatttagacgacagctcaggggacccaaaaccacacccctccttgggagaactccctagatcacagctcctcaccatggactggacctggacgcacttcctttttcttgggtcgcagcagcaacnggtcgcccactcccgaggttcacggtctggtcgctggtcgtgggacncgtaggagggtagaagaacggtccggtcggggcctcgtaaggtggaacggttcctcgtagacgtagttccttcgtacggtttacctaaccttactagttagtacggtactaccgtaaggtcgggtacaccggacgtaccggtacccgtagggaacgtaacgggtcttaggaggttcgggaattcgggaagtcggacttcgaggtccttaactaacaaacgttaacaaacgacacgtaacctgtaaccgacgtaacgtaacggtaacgttccgggaacggtaccaacggttaacggtacccgacccggtaagaccccgaaaccggttacacgtaaccgtaccgaacggtaccgaaccgaaccggtaacgtaccgtaacgtacggtacggtaacgggtcggaacgtacggtcgtacgtaagtcgtacgaacgacccggacgtaccgtcgttaagttcctagtaggacgacgtacggtacgacgtaacgtagtttnagggttatccggttagaccggttacgggaccggtacggtaccgtacgggtcccngttacccg

SEQ ID NO: 220361 - DNA, 673 bp, Homo sapiens
  misc_feature: GYAE6OF01ARTR6.38.22.B11.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcagcaacttgcctggtaccagcagaacctggccaggctcccaggcctcctcatctatggtcncactccaccgagggcccacgtcggtactcccgagccgagggtcaggtggacctagggtcgggtctgggacaggtacgttccacgttcctaccaaccctagtccgacgccacgtccctggacctacggttccgtagggtaaacgtttcgtttttacggactttaacggtttttactttcgtacggttacctaggtaccttaagtttaacctaacgttttaccgtcgggttaccccttaccggttacgggttacgggttaccggttccgggacccggtaacggggtaacccgtaaaggggtacggtaaaacgttaccgtaaaaccggtacgttcgggtacggaccgttacgggaccctaaccgtacttccggttcgtttaccc

SEQ ID NO: 220362 - DNA, 553 bp, Homo sapiens
  misc_feature: GYAE6OF01COM2T.38.22.B11.1.454.CMB.1.raw
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagacgcccaccctctcctgccagggccagtcagagtgttagcagcaacttgcctagtaccagcaagaaacctggccaggcctcccgaggcctcctcatctatggtncactcccacgacgggccacgtgtactcccgagccgagggtcaggtggcgaggtgggtcgtgggaacnggtagttccactctaccaccatccagctacgccgtgacagtctagtaaagtgttttgacttagttttattcgttgtcagtactattaactaattacgtcgtccttaccgtacgtcggtacgttcggcgacgggtacgaggagtaactacgaaacgtacgtgtgacgtcgacactcgtctgttcc

SEQ ID NO: 220363 - DNA, 626 bp, Homo sapiens
  misc_feature: GYAE6OF01BYNKM.38.22.B11.1.454.CMB.1.raw
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
  modified_base (441)..(441): a, c, t, g, unknown or other
  misc_feature (441)..(441): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtcncctgcaaggcttctggttacaccttaccaactatggtatcaactgggtncgacacggccctggacaagggcttggagtggagtgggatggactcgaggtcgacttaacaaattaactaacacaactaactaatcgacacgaagtaacgttccgaggggcaaggacgtccaccggtgaacccgaacggacaacactccgaacganaccgacacgacctacgagtagggacgttggacggacgccgtagacgactcgtaggaccgaaccgaccgggtccgttagttacgttacgtaggtcgacgaagtacggtaactaaggtaatttagtttaggttaagtcgggtaaccttacgggtaggggaaccccgtaggggtaaccccgttacggg

SEQ ID NO: 220364 - DNA, 746 bp, Homo sapiens
  misc_feature: GYAE6OF01BU9DE.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaaggccgtggggcctcaggtgaacggtctccgtgcaggcttcgtaggttaccaccttttaaccaactagttggtactcgaacgtgggtcgcgacgacggcccgtaggactagggtcttaggaggttggatgggatggatcgaggcgtacttaacgaaataaacgtaaccaacaaccgtaactaacgtacggaccaaacgtaaacggttaaacggtttcccgaaaggggtcctaaacggtaacgttcccgaaccgggttacggaacccgaccgggaaccaacgtaacgtacccgaacgacggtaccaacgaccgtacctaaccgtaaggtacgggtaacgtttacgggaacgggtcgtacccgtagggaaacgttcgtaccggtaagggaacccggaacgttaacccgggggcctttaggttaacgtttacggtcggtacggaacgtaggaacggtaaacgtaagtaaacgttgtttagttacgtcgggtaaccttacggggtacggggacctaaccggggtaccccttggtacccgtcccggttaaccc

SEQ ID NO: 220365 - DNA, 608 bp, Homo sapiens
  misc_feature: GYAE6OF01D6WQB.38.22.B11.1.454.CMB.1.raw
  modified_base (289)..(289): a, c, t, g, unknown or other
  misc_feature (289)..(289): n is a, c, g, or t
  modified_base (367)..(367): a, c, t, g, unknown or other
  misc_feature (367)..(367): n is a, c, g, or t
  modified_base (442)..(442): a, c, t, g, unknown or other
  misc_feature (442)..(442): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagccgtggggcctcagtgaaggtctcctgcaaggcttcgtggttacaccttaccaactatggtatcaacgtgggtncgacacggcccctggacaagggcttggaggtggagtgggatggatcagcgactaacaataataacacacactatgcanagtaacgtccgagggcagtacgtacaccgtagaacccgaacggacaccactaccgaacgagcaacacgaccctanagtggtagttaggacggagccgtgacgtatacgtacgaaccgtacgaccggtcgttagttacgttacgtggtaggacggaaggtagtaacgaagtaaacttgtttaagttagtaacgggtaccgttacgggtacgggggacccgtaacggggtacccgttaccggg

SEQ ID NO: 220366 - DNA, 660 bp, Homo sapiens
  misc_feature: GYAE6OF01A8J0X.38.22.B11.1.454.CMB.1.raw
  modified_base (281)..(281): a, c, t, g, unknown or other
  misc_feature (281)..(281): n is a, c, g, or t
tcagtcgatcacgtcacgaccggtgctcgatttagacgacagctcaggggacccaaaaaaccacacccctccttgggagaatcccctagatcacagctcctcaccatggactggacctggagcatccttttctggtggcagcagcaacaggtgcccactcccaggttcagctggtgcagtctggagctgaggtgaagaagccgtggggcctcgagtggaaggtctccgtgcaaggcttcgtggttaccacctttacgaactagtggtatcgaacgtgggtncgacacggccctagggacaagggcttgaggtggagtcgggatggatcgaggcgtacgtaacaaagttaataacaactaacgtactagtacgaccaacgtaaggtaccgttacgagggaccaggtacgtacgaccgtaggaacccgaacggacaactacgtaccgaacgacgacgtaacacgacctacacgtggaacgttggaacgagaccgtagaggtactcggtacggaaccgtacgtaccgggtaccgttacggtaacgtttacggaggtacggaccggaagtacggtaaccgaaaggttagttacggttagttaggtaacggtaccgtacgggacgggtaccggacggtaacccggtcgttacgtccccggttacc

SEQ ID NO: 220367 - DNA, 776 bp, Homo sapiens
  misc_feature: GYAE6OF01A1ECH.38.22.B11.1.454.CMB.1.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
  modified_base (373)..(373): a, c, t, g, unknown or other
  misc_feature (373)..(373): n is a, c, g, or t
tcagtcgatcacgtcacgaccggtgctcgatttagacgacagctcagggggggagaggagcccagcactagaagtcggcggtgtttccattcggtgatcagcactgaacacagaggactcaccatggagtttgggctgagcttggttttccncgttgcttcttttaagnggtgtccagtgtcaggtgcagctggtggagtcgtgggggagcgtggtccaggccgtggggacggtccctgacgacctcctccgtgtgcagccctgtggtacttccgacttttcaaggttacgtttagtggccagtcggcctacgttcggggtccccgccgaggtccctaccgagggccgaagggggtctaggggaggtgggtanactactttatatttatagtgtaagtaggtaaattaagtagtaaacttacgtatcgacgtaacggtacctccgggtaaggaacggggtccctaattacctacttaccgtaacttcccgtaccaaggtaactaacctaacgttaaccccgaaaacggtaacccgtacccggttccgttacgttacccttacgttaacggaacctaaaagtaccggttaaacgtaccggtacccgttaaggtaaggttaacgggttacgggtaaaccggtaacccggtaacgggttacgtttacgggttagtttaacgttaccggttagggttaacggttaaacggttaaagggtttacgggttttgggggttaaccgggggttaccgggaccccggggttaacgttaaaacgggg

SEQ ID NO: 220368 - DNA, 693 bp, Homo sapiens
  misc_feature: GYAE6OF01CRGTV.38.22.B11.1.454.CMB.1.raw
  modified_base (200)..(200): a, c, t, g, unknown or other
  misc_feature (200)..(200): n is a, c, g, or t
  modified_base (375)..(375): a, c, t, g, unknown or other
  misc_feature (375)..(375): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtcctccgaaggggaaanagcccaccctctcctgcagggccagtcagagtgtagcagcaacgttagcctggtaccagcaacgaaacctggcccaggcctcccgaggcctcctacattcctagtcggtcgcactcccaccgagggcccagtggtactcccgaggccgagggtcaggtggacgtaggtcgggtcngggaacaggtacgtccacttcgtaccaaccgattccgacgacctacgtccgtacgaccgagttaccgtagttaaacgttattttcggtaaccgttttaagtttttactttacgtagttaccgtaagtactttaaactttaacgttaactttaccgttacgggtacccttaccggttacggtaccggttaccggtttaccgggaacccgggtacggggtaaaccgtaacgggttaacggtaaaacttaaccggaaaacgttaccggttacggtacggaccgttacggaccctaaccgtaacttccgttacgtttacccg

SEQ ID NO: 220369 - DNA, 675 bp, Homo sapiens
  misc_feature: GYAE6OF01D7B79.38.22.B11.1.454.CMB.1.raw
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtcgtggagctggaggtgaagaagccgtggggcctcgagtacggaaggttcctcctgacgaaggtctttccgtggttaccaccgtttaccaacgtatggtatcgtaaacgtggggtacgaccgacacggccccgtaggaacgaaggggtcttaggaggtggagtggggagtggactcgagcgacttaacaattaaanaacacanactangcanagaacgttccgaggaccagacgtacgaccgtcgaaccgacggacacgactaccgacgagacaacgacgcctaagagtaggagttagacgggtaacgtcgtaggagtacgtcgtacggaaccgaccggtaccgggaccgtttagttaacttaccggttaggtggaaccggaaggtaaacgtaccggtaaaggttaaagttacggttttaggttaggtacgggtaaccgttacgggtacggggaacctaaccggggtaacccggttccgaccggtacccgttaccg

SEQ ID NO: 220370 - DNA, 716 bp, Homo sapiens
  misc_feature: GYAE6OF01A8KSS.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcgagggccagtcagagtgttagcagctaacttagccgtggtaccagacaacggaaacctggccgaggcctccgaggtcctcctctatctagtcggtcgactactacccgacgtacgggcctacgtacgggttacctcccgaacggtccggtacggggtcgaacgggttcgggacgtacggggttcggggtacgtcgggggaactaggtacgttaccaccgttccgtaccaccgtataccgagccgacggtccgtgaccgtaagttacgtaggtaaacgtttcgttttcgtacgtttaaggtttttactttcgttaggtccgtaacgtaccttaacgtttaaccttaacgtttacccggtccggttacccctttacggttacggggttcggtacccggttccgggaccggtaacggggtaccgtaaaggggtaacgtaaacgtaacgtaaaccggtacggttaggtcgacgtacggaaccttaccgtctttccgttcgttaccg

SEQ ID NO: 220371 - DNA, 646 bp, Homo sapiens
  misc_feature: GYAE6OF01AO3F9.38.22.B11.1.454.CMB.1.raw
  modified_base (199)..(199): a, c, t, g, unknown or other
  misc_feature (199)..(199): n is a, c, g, or t
  modified_base (310)..(310): a, c, t, g, unknown or other
  misc_feature (310)..(310): n is a, c, g, or t
  modified_base (639)..(639): a, c, t, g, unknown or other
  misc_feature (639)..(639): n is a, c, g, or t
tcagtcgatcacgtcacgaccggtgctcgatttagacgacagctcgagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcctaccctctcctgcgacggggccagtcagtagtgtagcagctaattcgcctaggtaccagcaagaacctggccaggcctacccgaggtcctcctcatcgtagtggtcncactcccacgaggtccagtcgtactccgagccgagggtcaggtggctagggttcgggtctacgggactaggtacgttaccacgttcaccaccgtatccgacgtacaccgtccgtcgactacggttacgtagtaacgttactttcggtactttacgttttacgtttcgtacgtactacggtactaacgtttaactaacgttccgtacggtcccttacggttacgggttacggtaccggtcgggaccggtaacggggtaaccgtaagggttaacgtaaacgtaccggaaaacggtcggtacggtcggtactaccgactaactcttcggttnttacccg

SEQ ID NO: 220372 - DNA, 844 bp, Homo sapiens
  misc_feature: GYAE6OF01DM7OA.38.22.B11.1.454.CMB.1.raw
tcagtcgatcacgtcacgaccggtgctcgatttagacgacagctcagggggtagggaactgctcagttaggacccacgacggaaccgatggaaggaccccacgcgcagcttctcttcctcctgctactctggctcccagataccacgtggaagtaaatagtgatcgacgctagtcctccagtcctacctgtctcgttcgtaccgtaccgggaaggggaacacgcccctaccctcctccgtacgacgacgggaccgagtacgaaggtaggttagttacgactaagtacctaacgttacggtccgtaggtaaccagactaacggtaaaccgtcgggaccgacggtcccgtacccggacggtcctcctagtactcgtacggtggtactaccaccgtcccgaaccggagggtaccctagttacgggtacctacccgaacggtaccgtagggtacgtacggttcggacgggttcggggttacggggtcggtaacgggtaaacgtacgggttacctttcccgtaacccttaccgtaaccctaacgtacgtccgaaccgtaccgtaccgtacccgtacgtaccgtacggttacgttaagttaacggttacgttttacgtacgttttaacgtttccgtttacggttacgtacgtaacgtacttaagttaacgttaacggtttccgtccggttccgttaaccggtttacgggttaccgggtaccggggttaacccggtaaccggggtaaaccgggtacggtaacgggtaaacggtaaaccgtaaccggggaaacgttcggtacgggtacgtaccgtacggtaacccagggtttaccttcggtaccgtttaccg

SEQ ID NO: 220373 - DNA, 636 bp, Homo sapiens
  misc_feature: GYAE6OF01CAHEX.38.22.B11.1.454.CMB.1.raw
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (495)..(495): a, c, t, g, unknown or other
  misc_feature (495)..(495): n is a, c, g, or t
tcagtcgatcacgtcacgaccggtgctcgatttagacgacagctcaggggacccaaaaaaccacacccctccttgggagaatcccctagatcacagctcctcaccatggactggacctggagcattccttttcttggtggcagcagcaacaggtcgcccactcccgaggttcagctggtgctagtcgtggagctggaggtagaagaacgccgtggggcctacgagtgaacggttctccgtgacaaggtctcgtagttacctacttaccaattagtgtatacaagtggtgcgacgacggcccgtagacgaggtctaggagtggaggtggagtggancgacgcgtataanaataaactaacactaactaactatcgacaacgtagtaacgtccgaggacacggtacgaccgacgtacaaccgaacgacataccgaccgaacgtacgacaccgacgacctagtacggtaggacgtaggaaggtacgctaggacgtacncgtacgaacgtccggtacggcgttagttacttacggtgtacgacgtaaggtaagaacgtaagtaagttgttaagtacgttacgggaacgttagggtaccggggaacgttaaccggtaccggtacgttaccggtcccgtccg

SEQ ID NO: 220374 - DNA, 777 bp, Homo sapiens
  misc_feature: GYAE6OF01DHOZQ.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaanacgcccacccctctccgtgacgacgggccagtacgagtagttgtacgcagactaacgttcgccgttaggtaccagacaacgaaccgtcggaccgacggccctacccgacggtccttacccgtactactttccgtaaggttcggtcgacctaaccgtaccccgaaccggaccgggtccctaacggttacggttaaccctccccggaacgtacccgggtagggtaccgtagggtcggacgttaggggtcgggttacgtaggggaactacggtacttccgactcctacacctatcgacgccgacgtcgtgaccgtagttacgtaaggtaactttgtttacgtacgttttaacgtttttacgttcgtacgttacgtacgtacctttaactttaaacgttaacgtttaccgtccgggttaccccttaacggttaccgggtttacggggttacccggttccggggtaacccggtaagggggtaaacccggttaaagggtaacggtaaaacgtaaacccgtaaaacgggttacggttacgggtacgtaccgtacgtaacccttacgtaacgttccgttcgtttaccc

SEQ ID NO: 220375 - DNA, 952 bp, Homo sapiens
  misc_feature: GYAE6OF01EM8E8.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgaggtgtccttgggtttgggggaagaggaagactgacggtccccccagcagcaacaggtcgcccactcccaggttcagctggtgcagtctggagctgaggtgaagacgccgtgggcctcgagtgaacggtctccgtgacgaacggtcttcgttacggtttacctaacccgttttaaccaaacgttagtcgggttaacttaccgtaaacggttcggggtacgaccggtaaccgtaaccggggtcccccccgttaaggggaaaccgtaaacggggtccgttttaggggaagggttacgggggtaaggttagggggtacgttacggggtaacttaccggaacggtccggttaacctttaaaactaaaacgttaaaacgttaaaacccacctaaacgtaccgtttaacgtacgaacccgtaaacgtaacgggtaaacccgtttacccgggaagggggtaaacctacgggtaaccggttacccgtaacccgggttaacggaaccccggaaccggtaaccaaccgtaaccgtacccgaaccggtaccgaaccgaaccgtacgtaaccccgtaagacggttaacgggtaacggttacgggaacgggtaccgtaccgtaagggtaacgtacgttaaccggaaccggtaaacccgggtacccggtaaccggggttaccgttaacggtttaacgtttacccgggttagggtaccggtaacggtaaaccgggttaaacgtaaaacgttaaggtttaaaacggtttcggtttaacggttaacggttaaccgggtaaccggttaaccggggtacccggggtaaacccgggttaaacccggggtaccccggttaacccggg

SEQ ID NO: 220376 - DNA, 694 bp, Homo sapiens
  misc_feature: GYAE6OF01CYF0E.38.22.B11.1.454.CMB.1.raw
  modified_base (100)..(100): a, c, t, g, unknown or other
  misc_feature (100)..(100): n is a, c, g, or t
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (542)..(542): a, c, t, g, unknown or other
  misc_feature (542)..(542): n is a, c, g, or t
tcagtcgatcacgtcacgaccggtgctcgatttagacgacagctcagggtcttcgtggctcacgtccaccaccacgcatgtgacctcaggggtccggganatcatggagggtgttccgtttggggttttggggggaagagggaagacgtggaccggtccccccaagcagacaacgtaggtcgcccacctcccgagggttcagtcgtggtgctagtctggatcgtagaggtagagacgccgtgggcctagagtgacgtctctgacgacgtctacgttagtacctaccgttaccatagtgtacncgtaacgtgggtgaccgcgaccggcccgtaggacgtacggtgttggagtggagtggatggancgtgtacgtacgtaanaattaaactacaactactactagtagactaagaacgttacgtgaaccggtagtagaaccgttcgaaccggaacgaacccggtacgaaccctacgacgtaaccccgagaccgtacgaaccgtaacctacgtaagttacgtacgggtaagtacggaagggtccngtaagcggtaagtccggaaggtaccgtaccgtacggtaacgtttacggtattaaccggtgtaggaaaccgttgaaacgtcgtagtaaagtttcgtaagtagggttacaacgggtacccggttacggggaaacgtccgggtacccgttacggg

SEQ ID NO: 220377 - DNA, 793 bp, Homo sapiens
  misc_feature: GYAE6OF01C76J3.38.22.B11.1.454.CMB.1.raw
  modified_base (200)..(200): a, c, t, g, unknown or other
  misc_feature (200)..(200): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagccaccctgtctgtcgtctccgagggggaaancgcccaccctcgtcctgccaggggcctaggtcagtagtagttagcagtccaaacgtttagcccttaggtaaccaggaccaacggaaaacccgttcggaacccgacggtaccgtaccccgagggtccctctccgtaacttccgtaagttcgggtcgacctaccgtacccgaaccggtaccggggacctaacggttcggggttaacctccccgaaggtacccgaggggttcctaagggttcgggacgtaagggtcggggttacctaggggaactagggtacggtttacccaacgttccgtaccaaccgtaagttccaacggccaacggtccctcggaccgtacgttacgtaaggttaaagtacgtttttacgtacgtttaacggtttttaaccttttcggttacgtttacgaacggtttacctaatttttaaaccaaaggtttttcccggtacggtttaccccgttaccgtaaccgggtttcggtaaccggttacgggtaccccgggaagggttaaaccccgggaaggttaaccgggtaaactaaccggaaacggtaacgttcggtacgacgtacgacctacgattcttcgtacc

SEQ ID NO: 220378 - DNA, 864 bp, Homo sapiens
  misc_feature: GYAE6OF01D7RXJ.38.22.B11.1.454.CMB.1.raw
  modified_base (200)..(200): a, c, t, g, unknown or other
  misc_feature (200)..(200): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagactaccactggaagaaatagtgatgacgcagtctccagcccacctgtctgtcgtctaccgaggggaancgcccaccctctcctgcgacgggccagtcgagtagttgttagcagacctaacttacgccgtaggtaaccaggaccgaacgaaacccgtcggacccgaaccgggcctaccccgacggtcctccctactattccgtagttggtcgcctaccgtacccgacccggacgggtaccctaacggttcggtaccctaccccgacggtaccggtacggggtcctagggtcggcgtacgggggttcgggtcgggtaacgggtaccgtaagtaccggttaccctaccgttaccgtaaccctacctacaccggacgtcccgtaacgtcccgtagtaccgtacggtttacgtaaggtttaacggttttcgttttaccgttaacgtttttagtttttaccgttttaccggtaagtttcccgtaaaacggttaccgtttaaacttttaaaccggttaaaccgttttacccggtaccccgggtttaaccccttttacccggggtttacggggttaacccggggttacccgggtttaccccggggaacccgggttaaaccggggggaaaccctaaaacggggggttaaccgaaaaacgttaaacccggaaaccgggttaaagtccggggtacgtaccggttaccgtaacccgtaacctttcgttcccgttcggtttaccc

SEQ ID NO: 220379 - DNA, 994 bp, Homo sapiens
  misc_feature: GYAE6OF01CVYEO.38.22.B11.1.454.CMB.1.raw
  modified_base (199)..(199): a, c, t, g, unknown or other
  misc_feature (199)..(199): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagactaccactggagaaatagtgatgacgcagtctccagccaccctgtctgtgtcctccgaggggaacncgcccaccctctccgtgccgagggccagtcaggtgttagttagcagtactaacgtttacgccgttaggacctaggtacgaaccggtaaaccgttcgggaccccgtaaggtcccgttaccccggaacgggtcccttccccttaccgtaacgtttccgttacggttacgggttaccgtacctaaccgttaccccgaaccggtaccgggggacccctttaaccgggttaccgggttaaacccctacccccggtaaacggggtaccccgggttaacggggggttacccgtacggggttttaccggggaccgggtttaacggggggtttcccgggggttaaccggttttaacgggggggaaacccgttaaccgggttaaacccgggttttccccggtaaacccttttccccggttaaacccctaaacccgttaaccggttaccggtaaacccgggtaccctaccggggttacccccgttaagggtacccggtttaaacggggtttaccgtttaacgggttaaaacgggtttccgttttttaacgggactttttaacgggtttttaacttttcccggtacgttaaccgttagttaacccttaacgttttaaccgtaaaccggttttcccggttaccgggttaaccccgtttccgttaacgggttcccgggttaaccggtacccgggacccgggtaaacgggaaccgttagggtaaaccggtaaaccgtaaccggtaaacccgtaagggttccggtacgttccgtaccggaccttacccggtactttccgtccggtttaccg

SEQ ID NO: 220380 - DNA, 773 bp, Homo sapiens
  misc_feature: GYAE6OF01B6FIF.38.22.B11.1.454.CMB.1.raw
  modified_base (107)..(107): a, c, t, g, unknown or other
  misc_feature (107)..(107): n is a, c, g, or t
  modified_base (113)..(113): a, c, t, g, unknown or other
  misc_feature (113)..(113): n is a, c, g, or t
  modified_base (125)..(125): a, c, t, g, unknown or other
  misc_feature (125)..(125): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (335)..(335): a, c, t, g, unknown or other
  misc_feature (335)..(335): n is a, c, g, or t
  modified_base (388)..(388): a, c, t, g, unknown or other
  misc_feature (388)..(388): n is a, c, g, or t
tcagtcgatcacgtcacgaccggtgctcgatttagacgacagctcgagggggaggaactggctcagttaggacccagacggaaccatggaagcccagcgcagcttcncttccnctgactacttcnggcctccagactaccactggaacaaataggtgatcgacgcagtctcacgcccacctgtctggtgtccgtccgaaggggaaacncgtaccctacctctccgngccgagggtccagtcaggtacgttggacacctagacgtaacgttcgaccgtaggtaacacggacgaacggaaccgtggacccgacggtccaccggacggtcctaccctntacgtccgttagcggtcactactcccgaacggaggacctacggttacgtaccncccggaggtacccggaggtctacggtcgtaggtcggggttcggaacgtaggggacctaaggttcctacctccgttacctaccgaactcgtaccgaccgacgtaccgtcgtccgtcgtacgtacggtaacgttacggttaacgtttggtaccgtttaagttttaccgttcgttcgttaacgtacttacttaacgtttaacttacgttttaccgtaccggttacccggtttaccgttaacgggttaccgggtttacggtaccggggtaaccgggtacgggtaaaccggttaacggggaaacggttaaacggaaccgggttaaaaccggttcgggtacgggtacgtccggtaacgtaccgtaaccgtacttccgggtttattacccgg

SEQ ID NO: 220381 - DNA, 591 bp, Homo sapiens
  misc_feature: GYAE6OF01AJW7R.38.22.B11.1.454.CMB.1.raw
  modified_base (207)..(207): a, c, t, g, unknown or other
  misc_feature (207)..(207): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
tcagtcgatcacgtcacgaccggtgctcgatttagacgacagctcagggtcttcgtggctcacgtccaccaccacgcatgtgacctcaggggtccgggagatcatggagggtcgtccttggggttttaggggggaagaggaagactgacggtcccccagcagcaacgagtcgcccactccctaggttcagtctggtgcaggtctggnctggaggtgaagaggccgtgggcctcgagtcgaggtctcctgcaaggtctacgtgtacacttacaactgtgtatccgtagtggtacgcgngacgtccgngactacggtctggacgtgagtgggatgacgcgngtgtccgtaagtagtaccgaanaccgtactatcggtanacnggaatagaacgnggactacgtaanccgactcgaccgccaagacnctacgcgagctcgacgtaacncgagtcgtagacgtcgacgtcgtagtacgtacgtacgtacgacgtacgtaccgtacgttacgtacgtacgtacgtcgtacgtacgtacgtaacgtagtagtcgtacgtagtaccggtaccgacggtacggtacgtacgtacgtacg

SEQ ID NO: 220382 - DNA, 678 bp, Homo sapiens
  misc_feature: GYAE6OF01DKM08.38.22.B11.1.454.CMB.1.raw
  modified_base (154)..(154): a, c, t, g, unknown or other
  misc_feature (154)..(154): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtcgatcacgtcacgaccggtgctcgatttagacgacagctcagggacccaaaaccacacccctccttgggagaatcccctagatcacagctcctcaccatggactggacctggagcattccttttcttgggtggcagcagcaacaggtcncccactcccaggttcagcgtggtgcagtcgtggagctggaggtagaaggaggccgtggggcctcgagtgagtctcgtcgagagtcttgtcgttacctaccttacaacttagtggtactacgtagtcgggtgaccgacggacccgggtcccgtacgggaaggaccggtcgttagggtaggtacgggaggttgggaagtcggtaacgtcgngtacccgtattaaacgaattaaaccaacacacttanacgtnaacacggaagtacgtacggagcgaggaccgtacgaccggtacgaccgtaacgactaccacgtacccgagaccgacacgaccgaccgtaacgaggttcggagtacgggaggaccgtagtagacagtccgacgacgtaccggcgtttacgtacgttagtacggttgacggtaacgacgtaacgacggtaataacgtttaacggtgttaaccggttggaccggtacgggtaccggtaccgggaaacccggttaccggtcgtccgtcccgttaacccg

SEQ ID NO: 220383 - DNA, 868 bp, Homo sapiens
  misc_feature: GYAE6OF01CBHS1.38.22.B11.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctcccagactaccactggaagaaatagtgatggaacgcagtcctccagccctacctgtctgtgtcctccgagggaaancgcccacctctccgngcaggccagtcagngtntacgcagctaacgttgcctaggtaccagaccaacgtaacctggacccaggtcctcccgaggtccctaccgtcctaattccgtaagttcggacgccacgtacccaacccgtacgggtcccaacggtacggtacctccccgacggacccggtagggtactaggttccgggacgtagggttacggggtcctaggggtaactacggttaacgttccaaccgttccgtaccgaaacctcgtaccgacgacccgacggtccccgttaggacccgttagggttacctaacgggttaaagtttaaccggttttaccgggtacgttttaacggttttttacgtttacccgttacggttttaacgaacggtttacctttaaaccttttaaccggtttaaaaccgttttacccggttacggttttaaccccccgttacccggtttaacggggtttcccggggttaaccccggtttaccccggggaacccgggtaaacgggggttaaaccccggaaaaggggtttaaaccgggaaaccctttaaaccgggaaaaacccggttaacgggttacccggttaacggggtacccttacccggtaacccggttaaccgttacccggtttaccgttacccggtttacccc

SEQ ID NO: 220384 - DNA, 806 bp, Homo sapiens
  misc_feature: GYAE6OF01E01UR.38.22.B11.1.454.CMB.1.raw
tcagtcgatcacgtcacgaccggtgctcgatttagacgacagctcagggtcttcgtggctcacgtccaccaccacgcatgtgacctcagggggtccgggagatcatggagggtcgtcctttgggggtttggggggaagagggaagacgtggacccgggtcccccccagcagcaacgtaggtcgaccccactccccgaggttcagtctggtgcagtctggagtcgtggaggtaggaagaggccgtggggcctgtaggtacgaacgggtctcctaggaccaggttccttacgttcggtttaaccctaacccttttaaccaaccttgttaggtactaccgtaacggttgggtacgaccgaccgaccgggtccccgagggtaaccggtacggtcgttagggagttagggaggttacggggagttacggactaccggacgtccgttaacttaaacgtaaattaaaactaacccacaaccgtaacttagcgaaacccgaaggtacgtaacgtccgggaaggtacgtagtacccggctaacccggtacgaaccgtaccgaacctacgacccgtacgacggtaacaccgaacgtaccgtaccctaagtacggtagggtaccgtacggacggtacgactaagggtaactgtaccgtacggtaccccggtacggtaccggtttacgtactacggttaagccggttagggtaccgaaaggtacccgttaataaggtttaacgtttcgtagggtttaaacccggacgggttacgttacccgggggacccggtacgggtaacccgggttcccctacggg

SEQ ID NO: 220385 - DNA, 779 bp, Homo sapiens
  misc_feature: GYAE6OF01ASHF0.38.22.B11.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
tcagtcgatcacgtcacgaccggtgctcgatttagacgacagctcagggggaggaactgctcagttaggacccagacggaaccatggaagccccagcgcagtcttctcttcctcctgctactctggctcccagataccactggagaaatgtgatgacgcagtctccagccaccctgtctgtgtctccgaggggaaancgccacctctcctgcgaggccagtcagagtgtagcagcaacttgcctggtaccagcaagaacctggccaggcctcccagcctctcatctatggncactcccacgaggcctagtcggtactccccgagtccgacgggtcaggtggctaggtcgggtctggggactaggtacttcgacttccgtaccaccctaagtccgaacggcctaacggtcctacgggacccgttaacgttaccggttaagtaaacgggtttactttttcggtaaaccgtttaggttttttacccgttacgtttacgtaacccgttaggttaccctttaaacgtttaaccgtttaaacgttttcccggaacgggttaccccccttttaaccgggttaacccgggttaccgggtttaacccgggttacccggggtacccgggttaaaaccgggggggtaaacccgtttaaagggggtaaaccccggttaaaaccggtaacccgttaaaaacggggtaacccggttttaggggtaccggtacccggtttaaccggaccccttaaacccgggaccgtttttaaccgggtttccgttaacccccg

SEQ ID NO: 220386 - DNA, 736 bp, Homo sapiens
  misc_feature: GYAE6OF01EKFRS.38.22.B11.1.454.CMB.1.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
tcagtcgatcacgtcacgaccggtgctcgatttagacgacagctcagggggaggaactgctcagttaggacccagacggaaccatggaagccccagcgcagcttctcttcctcctgcctactctggctcccagactaccactggagaaatagtgatgacgcagtcctccagcccaccctgtctgtgtctccgaaggggaaancgcccaccctctcctgcgagggccagtcagtagtgtagcagctaacttcgccgtacgtacagcacgaaaccgtggccacggcctcccgaggtccctccgtctactcctagtggtcgacactccgaccgacggccactaggtacnccctaggccgtacggtcaggtcgcgtgggtacggtcgtcgggactaggtaccgttacgaccttaccgtacaacctacgtacgaacgcctacggcccgtacgcctaaggttccaaggttacgttaacgttttcgagttttacgtttacgtttcttacgtactaccgtacttaacgtttaagtaaccgtttaacggttcccggttaaccgttacccggttaacgggttacccgggtaccgggtttacccgggtaccccggggtaaacggggttaacccggtaaagggttaaccgggttaaacgtaaacccggtaaaaccggtacgggttccggtaacggttccgtaaccgttacccgaaacccgttacgtttcccggttaatttacccccgg

SEQ ID NO: 220387 - DNA, 809 bp, Homo sapiens
  misc_feature: GYAE6OF01DYXVR.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttacgcagactaacttagtcctaggtaccagacaacgaaacctggaccacgggcctacccgaacggtcctacccgtactaacttcctaagttcggttcgacctaactccccaaccggaacgggaccctacgtacgggttaacctaccccgaacggtacccgaacggggttaccgaacgggtcggggtaccgtaaggggttcggggtaccggttaacggggaacgtaacggtacgggtttacccaacccgtttcctaaccgaaccctaacgttacccgaagggtacccaacgggtccccgttaaggcccttaaaggttcccgttaaggggtaaaagtttacgttttttacgggaaccgtttaaacgggttttttttaatttcccgttaggtaccgtaacggtacctaaaggtttttaaaccccaagttttaaccgtccccgggtaaccccttacgttaaccgggttacggaacccggtttccggaaccggtaacggggtaacccgaagggttaacgaaacgttacaaaacggtaacgtcggtaaggtccgtacgtaccgaacctcgttaccgttgtaccg

SEQ ID NO: 220388 - DNA, 741 bp, Homo sapiens
  misc_feature: GYAE6OF01BK0A6.38.22.B11.1.454.CMB.1.raw
  modified_base (675)..(675): a, c, t, g, unknown or other
  misc_feature (675)..(675): n is a, c, g, or t
tcagtcgatcacgtcacgaccggtgctcgatttagacgacagctcagggtcttcgtggctcacgtccaccaccacgcatgtgacctcagggggtccgggagatcatggagggtgtccgtttgggggttttgggggggaagagggaagacgtcgaccgggtccccccagcagcaacgaggtgcccactcccagggttcagcgtggtgcaggtctgggagcgtggaggtaggaaggacggccgttcggggcctcgagtggaacggttcctaccgtgacgaaggtcttcgttacggttaacctaccttaacaacttagtggtaactcgacggtgggtcgacgaccgacggcccgtaggaacggagggtcttaggagtgggtagtagggtagtaggactcgagtcgtaactaaagtaaattaaacaacacctaaccgtactatacgaacctaagtaacggtaaccgtaccggaagggactaagggtaaccgttaccgaaccggtacgaacccgacggaccacgactaccgacgtacgacaacgacgtaacccgactaggcggttaaggtcggaaggtccgacgtggaacgtacgtcgtaaccgggactacccggggtactaccgggttataccgttacgggcgtagggacgtaaacgtagtaacgtaattaacggtttnttacgggtaaccgttgggtaacccgtagggtaaccgggggacccaacgggggttacccctacgggg

SEQ ID NO: 220389 - DNA, 716 bp, Homo sapiens
  misc_feature: GYAE6OF01A82YJ.38.22.B11.1.454.CMB.1.raw
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
tcagtcgatcacgtcacgaccggtgctcgatttagacgacagctcagggtcttcgtggctcacgtccaccaccacgcatgtgacctcaggggtccggagatcatgagggtgtccgttgggttttgggggaagaggaagactggaccggtccccccaggcagcaacgaggtcgcccactcccaggttcagctggtgcagtcgtggagcgtgaggtagaagacgccgtgggcctcgagtgaacggtcctcgtgacgaggtcttcgttacggttacctaccgttaacctacgtatggtactacgtaacggtggtcgaccgacgaccggtcccgtaggacgtaggtctaggacggtggaagtgggtatggactacgacggtacttacgtaanaaacttacaaacnccgtaacacgtagacaacgtaaagacgtacgaggacgaacgacgtaccgtaacgaccgaaccgaaccgaacgtacgtaccaccgaacgacgaacgacctaacgaccctagacggtagtacggtaaggacgtactcggagtacgtacgtacgacggtaccgaccggtaaccgtacgttacggttaactacggtcggaaccggtaaggtacggtaaaccgtaagtaacgtttaagttacggtttagtaaaccgggtacgtaaacccgggttacgtaccgggggaaaccgtaacccgggtacccgttacggtaccccg

SEQ ID NO: 220390 - DNA, 739 bp, Homo sapiens
  misc_feature: GYAE6OF01ANGIE.38.22.B11.1.454.CMB.1.raw
  modified_base (201)..(201): a, c, t, g, unknown or other
  misc_feature (201)..(201): n is a, c, g, or t
tcagtcgatcacgtcacgaccggtgctcgatttagacgacagctcagggggaggaacgtgctcagttaggacccagacggaaccatggaagccccagcgcagcttctcttcctcctgctactctggctcccagactaccgactggaagaaataggtgatgacgcagtctccagccacctgtctgtcgtctcgaagggaacncgcccacctcgtcctagcgtacggccaggtcaagtgtacgttagctacgctaacgttacgccgtaggtaccagacaacgaaccgtcggaccacggtcctaccgaggcctccgtataacgttcgagtttcgggaccaccgtacgtcccgaaacggtcgggtacccctaagtttcccggtaaccctaccccgtaacgggcccgtaacggggtacctaacgggtccgggtacttaacggggtcgggtacccgttaaggggactaaacggttcgtttcccaagtttccccggaactaccgaactccgtacggactacccgtcgtacgtacgcgttacgtacggttaacttaggtttaccgtacgttttacgttttacgtttcgttaggttcttaacggtacttacgttaacggtaaccttaacgtccgttaaccgttccgtacgttacggttaccgtaccggtcgtaacgggtccggaagttaacggtacgtaacgtaaccgtgtacgtacggactcggtactacgtacttggtccgttacg

SEQ ID NO: 220391 - DNA, 766 bp, Homo sapiens
  misc_feature: GYAE6OF01EES87.38.22.B11.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (559)..(559): a, c, t, g, unknown or other
  misc_feature (559)..(559): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagactaccactggagaaatagtgatgacgcagtctccagccacctgtctgtntctcgagggaacncgcccacctctcctgcgacgggtccagtcaggtagttgttacgcacgtactaacgttcgccgttaggaaccacgaccaaacggtaaacccgtgggtacccgacggtacccgtacccgtaaccgggtaccttccccgtactacgtttaccggtaaggttcgggtaccgtccctaacccgttacccgacccggtaccggggtacccaccggttaaggtcccctaccccggtacgggtacccggtaacgggtccggtaacggtcggggtacccgtaagggggttcggtacgggtacgggtaactacggttaaccgtttacccgactttcgacccctaacgaacgttaccgacggtaccacgttaccncgtaacgtacgttaccgtagttaacggtttactttacgggttaacttttgttaacttttcgtaaccgtcgtaactctaacgttacctacgttaccgtcgtacgttacgtcggtacgttcggaccgcggtaacggtaccgtaagtcgaaacgttacggaacgtcggttggtccacgttacggacccagtttacgtctcggtttaaccc

SEQ ID NO: 220392 - DNA, 735 bp, Homo sapiens
  misc_feature: GYAE6OF01BQ6VG.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttggggttttggggggaagaggaagactgacggtccccccagcagcaacaggtgcccactcccaggttcagctggtgcagtctggagctgaggtgaagaagccgtggggcctacgagtggaaggtctcctgacaaggtcttcgtcggttacctacctttaccaacttagtggtaactccaaccgtggggtcgacgacgacgggccccctagggaccaaggggtccttaggacggtggagtgggatggatcgagcattaacaaactaagtaacaactacgactagtcgacaacaaggaacgttccgaagggcaagacgacaccgtgaacccgacggtaccaacgactacccaacgacgacaaccgacgtaccctaactacggtacgggtagttcgggtaacgggacgtaccgtaacgggatacggtaccgtacggaaccggtaaccggaccggggttcgttaacgtttaccgtttaggtccggttacggacggtaacggaacgggttaaaccgtaaggtaaacttttaacggttttacggttaaacggttacggggttaaacccggttaagggtacccggggggtaaccggtaaaccccgggggttaaccgttacccgggg

SEQ ID NO: 220393 - DNA, 837 bp, Homo sapiens
  misc_feature: GYAE6OF01DIT6V.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccacgtggaagtaaatagtgatagacgcagtcctccacgccctaccctgtctgtacgtccgtaccggaaggggaaagaccgccctacccttcgtccgtcgacgacggggacctacgtacgaaggtagttagtacgacacggtacctaacgttcgaccgttaacggaaccaggtacaaaccggaaccgtcgggaccaccggtccctacccggacggtcctaccgtactacgttccggttaaggttcgggtaccgtaccgtaaccgtacccccggaaccgggtacccggggtacccctaacgggttacccggttaacccctaaccccggaaccgggacccggtagggtaaccgttagggtaccgggaacggtttaaggggtcgggtttaccggggtacgggtaaacgtaccgggtttaacgttacccctaacccgtttaccgtaaccccaacggttacaccgacgtaccggaccgttaccgtcgtacccgttagttcgtaagttaacgtttacgtttacgacgttttacgttttacttcttacggtacgtacttacgtacttaacgtacttaccggtaccgtacccttacgtacggttaccgtacggtaccggaccgggtaacgggacgtaacggttaaacgtaaccgtaacggtaaacggtcgtacggtcggaccttcgaaccctagtactggttcttacccg

SEQ ID NO: 220394 - DNA, 1141 bp, Homo sapiens
  misc_feature: GYAE6OF01DWX7N.38.22.B11.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
tcagtcgatcacgtcacgaccggtgctcgatttagacgacagctcgagggggaggaactgctcagttaggacccagacggaaccatggaacgccccagcgcagtcttctcttcctcctgctactcgtggcctcccagactaccacgtggaanaaatagtgatgacgcagtcctaccgacgccctacccgttgttcgtcgtcgtaccgtaccgggaaaggggtaaacnccgtcccctacccgtctaccgtaggcggaccgggaccctaaggtcgaacggttacggttacggtaacgcctaaggtacctaacgttacgtccgtacggtaacccgaagaccgtaaacggtaaacccgtcgggaacccgtacggtccccgtaaccggtcggtccccttaaccaccgttaccgtttaggttaccgggtacgggttccaaaccgtacccgttaacccccgggaaacggggtaccccggtaccgttaaacgggtttacccgttaaccccgaaccccgggtaacgggtaaccccgggttttaaggggaccggttacggggttaccggggtaaccggggtttacgggggttaaccgggggtggtaaacccgggttaccgtaaacgtttccgtttaaccccggacctttaaccgaaaccccggtaagtaaccggttaccggaaccggtacccggtaaccgtttacccgggtaacggttttaacggttaaaccggtttaccgggtaaaactttacccggggtttttaagtttaaacccggtttccggtttttaaaacggtttttcttaaacccggggttaccgtaacccgggtttaaaagttttaaacccttaaccgttttaaacgggttaaaccccgggttttcccgtacccccccgggggtttttaaaaccgggttaccccggggttttaaggggttaaaccccccggggtttttaacgggaccccgggggaaaaacccgggttaaaccgggggtttaaaacccgaaaagggggtttttaaaaacccgccccgggtaaaaaaagggttttacccccggtaggggtttacccgaacgggggttaccctttaaaaccccgggacgtttaaacccgtttccggttttaaaccgggttccctttaaaaccccgg

SEQ ID NO: 220395 - DNA, 643 bp, Homo sapiens
  misc_feature: GYAE6OF01A1IOI.38.22.B11.1.454.CMB.1.raw
  modified_base (378)..(378): a, c, t, g, unknown or other
  misc_feature (378)..(378): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccgttggggttttggggggaagaggaagacgtgaccgggtccccccagcagcaacaggtcgcccactcccgaggttcagctggtgcagtctggagctgaggtagaagacgccgtggggcctcgagtagaaggtcctcctgcagggtcttcgttcggttacctacctttaccaattataggtataccaacgtgggtcgacgaccgacggaccccgtggaaccgaagggtcgttaggagtggagtgggatggatcgagtctactaanaaatactaacacgaacactagcgacagacgtacgtacggaggtacaggacgtacacgtagaccgacgacagtaccacgagacacacgacacgtacgagtggacgtagacgggacacgtagagtactcgtaacggacgtacccgtaacgggtcttaggttacgttaggtcgtagaccggaacgtaagggtaacaaggttaacttaagtttacggtacgttacggtaaccggttcgggaacggtaccggtaacgggtaccccgttgg

SEQ ID NO: 220396 - DNA, 712 bp, Homo sapiens
  misc_feature: GYAE6OF01EKWTG.38.22.B11.1.454.CMB.1.raw
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
  modified_base (433)..(433): a, c, t, g, unknown or other
  misc_feature (433)..(433): n is a, c, g, or t
tcagtcgatcacgtcacgaccggtgctcgatttagacgacagctcgagggggaggaactgctcagttaggacccagaccggaaccagtggaacgccccagcgcagcttctcttcctctgctactctggcctcccagactaccactggaagtaatgtgatgacgcagtcctcacgtcccaccgttgtctcgtctcgtaccggaagggaactccgcccaccttccgtcctgccgacggcagtcgagtgtctacgcagacctaacgtttcgcgtacgtaccagacgaacgtaccgngccgacgcccnccgagtcctccgactgttccgtagttgccgacnccgtaccgacgcgtcacgtcgactaccgngacgtgctggtgtcgnggtcgtcggaggactaggtccgttccncgttacaccccgatacggtcgacncgttacccgtacgtaccgtcgtacggttaccgtaggtttacgtttaaccgttttcgttacgttttaaccgtttagttttcgtacggttactaccgtttaattaaccgttacgttaaccgttaccgcccgggtttacctttaccggttaccggtccgttaccgggttccggtaaacgggtacccgggtaacggttaaagttaaccgaaagttaacccgggaacgttcggtaacgtccggtaacgtacgtaaccccgtgtttaaccgttgttacccgtccg

SEQ ID NO: 220397 - DNA, 830 bp, Homo sapiens
  misc_feature: GYAE6OF01C1680.38.22.B11.1.454.CMB.1.raw
  modified_base (123)..(123): a, c, t, g, unknown or other
  misc_feature (123)..(123): n is a, c, g, or t
tcagtcgatcacgtcacgaccggtgctcgatttagacgacagctcgagggggacccaaaaaccacacccctcctgggagaactcccctagatcacagctcctcaccatggactggacctggancagttccttttcgtggtcggcgagcagcaacgaggtcgccactcccgaggttcagcgtggtcgctagtcgtggacgtcgtgggaggtaggaagacggccggtggggcctacggaggtagggtaacggtccgtacgacggtacgtaagggtcctttacggtacggtttaacctaacccgttaacctaaacgttaggtacggttaacgtaccgttaacggtcgggtacgtaccgaacggtaccgggacccctaagggtaccgtaaagggtctagggtagggttaacggaggttacgggagttacgggacgtacgacgggtacgtaacgttaaacgtaaacgttaacgaaaccggtacgaacgttaactacgggtactaacgaaacggtaacggtaacggttacccggaaaggaccgtaacggttacgaaccgacccgggtacgaaaccggaaccgggtaacacgtaacgtaccgaacggaacgacgtaaccgaccggtacctaagggtaacgtagggtaacggttagggaacgtcgggtccaacggaagtttaccgacgggtaacggtaaacccgaccggttcggtaaccgttagttaaccgtggttaacggcggtaaaccgtacgggtaactaacggtagtaacgttgtaggtacgtacggtacgttacgggacgggtacgtaacggtaccgtcgtcgtacggtaccg

SEQ ID NO: 220398 - DNA, 753 bp, Homo sapiens
  misc_feature: GYAE6OF01EQ7YB.38.22.B11.1.454.CMB.1.raw
tcagtcgatcacgtcacgaccggtgctcgatttagacgacagctcaggggacccaaaaaaccacacccctccttgggagaatcccctagatcacagctcctcaccatggactggacctggagcatccttttctggtggcagcagcaacaggtgcccactcccaggttcagctggtgcagtctggagctgaggtgaagaagccgtggggcctcgagtgaaggtctcctgcaaggtcttcgtggttacctaccttttaccaaactagttggtactacgaaccgtgggtagacgaacgaccggcccgtaggaacgaacgggtcttaggaggtagggagtcgggattgggacttacgacggtccgtacttaaacaaattaaactaaccacaacgtaacctagtacgactaacgaaggttaaacgtccggaacgggtacacggtaacgtaccgacccggttacggaaaccccgagggaccctaacgtaccgtacccaacggaacgacctaaaccgacgtaaccctaacgtaggtaacgggtaggtttaacgggaacgggtacgtacccgtaggaacgtacgttaccgtacgaaccggtaccgaccgggtcgttaagtaccgttacgtcgggtacggaccggtaagacggttaacgaaagttaaagtttcggttttagtaacggttacgggtaaccgtaagggggttccggtaacccggaacggggtaaccccgttcgggttaacccgccgttaacccg

SEQ ID NO: 220399 - DNA, 641 bp, Homo sapiens
  misc_feature: GYAE6OF01ENN94.38.22.B11.1.454.CMB.1.raw
tcagtcgatcacgtcacgaccggtgctcgatttagacgacagctcagggacccaaaaaccacacccctccttgggagaatcccctagatcacagctcctcaccatggactggacctggagcattccttttcttggtggcagcagcaacaggtgcccacctcccaggttcagctggtgcagtctggagctggaggtagaagaacgccgtggggcctgagtgaaggtctcgtgacgtagtcttcgtcgttactacctttacaacgtatggtactacaacgtgggtcgccgacgacggcccgtaggaacgagggtcttggtagtggaggtgggagtggatcgagccgtattaacaataaactaacacgaactactatacgacaacgaggttaaccgtcgaagggtacaaggacgtaccgaccggtacgaacccgtaacggaaccacacgtacccgaacgcgaccacgacgtacctaagagtaggtagtagaggtcgactaggagtacgcgtaagacccgacgccggtagttacgttacttacgaggtacggacgagacgtaagaagttaagttagtttaggtagttacggtacgttacgggacgggaccgtaaccgggtacccgttcggtccgtcccgtacccg

SEQ ID NO: 220400 - DNA, 914 bp, Homo sapiens
  misc_feature: GYAE6OF01ANW2G.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagctattccttttcttgggtggcagcagcaacgaggtcgcccactcccgtaggttcacgtcgttggtcgacgtagtcgtgggacgtcgtaggaggtaggaaaggaacggtccggtcggggaccttcgaggttacggtaacggttcctccgtcggacgtacggttcctttcgtacggttaacctaccttaacaagttagtcgtactaccgtaggtcgggtcaccgacgaccggcccgtagaccggtaaggttcgtaggacggtggtggtacgggtacgtaggtacgtcgaacggtaccgtaacttaaagtaaacgtaactaaccctaacctaacgtacgttagaacggaactaaccggtaacgggtaaccgttaccggaagggtaccgtaacggtaccggtaacccggtaaccggtaccggaaccccggtaaaacgacctaaccgtacccgaacccggtacgaaccgtaacccgtaaccggtaccgtaacccgtaagggttacgggtaacgggtaccgggtaacggttaacgggacccgttacggtaacgtacggttaacgtcccgggaacgtaaccgggccggttaaccggtaccggtttaagttaccgtaccgggtcgaaccgggaccggtaaagttaaccggtaaagttaacggttaacgttttaacggttaccggggtttaaggaaacccggggttaaccgggtaaccggggggttaccccggtaaacccgggggtttaaccccgggtaacccgtttcccggtaaccccggttaaccccgggttaacccccg

SEQ ID NO: 220401 - DNA, 948 bp, Homo sapiens
  misc_feature: GYAE6OF01BQ38O.38.22.B11.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagtcgatcacgtcacgaccggtgctcgatttagacgacagctcagggggaggaactgctcagttaggacccagacggaaccatggaagccccagcgcagcttctcttcctctgctactctggcctcccagactaccactggagaaatagtgatgaccnctagtctccagccaccctgtctgtgtctcgaaggggaaancgccacctcncctgcgacgggccagtcaggtacgttgtaaccgcgtacgtactaacgttacggccgttacgggtacccagaccgtaaacgtaacccgtggaccaacggtccctaacccggacggtccctacccttacgacgtttaccgtaggttcgggacctacctaaccgttacccccgaacgggacccggggttacccctaacggtttacggggtaacccctaccccggtaaccggcgggttaaccggggtaccgagggtttacccgggtaggacggggttacgggtcggtaacgggacttacggtacgttaccaacccgtttccgaaacccctaccgttagacccgaagtacccgggtatcccccgggttaagaacggtttaaccgtaccgggtttaaggttaaacgtttttacccggtttaggttacccgtttttttaaagtttttaccgtttccggttggtttaaaccttacgtttaaaccggtttaaacttttttacccgaaacggggttttcccttacccggggtttacctttaacccggggtttaaccgggttaccccgggttaacgggttaccccggggtaaaccgggttaaaccgggggttaaacgaaaccgggggttttaaaacggggacctttaaaaccggggaaacccggtttaagggtttaccgggggtaaccccttaggggtaccgttaacccccgtaaacgtttttcccggtcggttttaacttacccccgg

SEQ ID NO: 220402 - DNA, 619 bp, Homo sapiens
  misc_feature: GYAE6OF01BZ8SR.38.22.B11.1.454.CMB.1.raw
  modified_base (144)..(144): a, c, t, g, unknown or other
  misc_feature (144)..(144): n is a, c, g, or t
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactgganaatagtgatgacgcagtctccagcccaccctgtctgtgtctccgaggggaacacgcccacctctcctgcaggccagtcagagtgtancagcaactgctgacagcagaactgcagctccaggctcctcatctagtggtncactccgaccgcgggaccacgtcgtactcccaggtccgtaagggtcagtcggcgtagggttcgggtactggggactaggtacgttaccacttctaccgactatacacgtcgacgtccgtaggcgtagttccgtagtaagtttagttttcgacgtttagttttactttcgttagttcagttaccgttaatttaaccttaagtttacccgtacggttccccttaccggttaccggttacgggttaccggttcccgggaccggtaacggggtaccgtaagggtacggaaactaacggaaacgtacgtggtacgacgtcgacctaccgtacgtgtcgtccg

SEQ ID NO: 220403 - DNA, 717 bp, Homo sapiens
  misc_feature: GYAE6OF01DOCZJ.38.22.B11.1.454.CMB.1.raw
  modified_base (154)..(154): a, c, t, g, unknown or other
  misc_feature (154)..(154): n is a, c, g, or t
  modified_base (216)..(216): a, c, t, g, unknown or other
  misc_feature (216)..(216): n is a, c, g, or t
  modified_base (554)..(554): a, c, t, g, unknown or other
  misc_feature (554)..(554): n is a, c, g, or t
tcagtcgatcacgtcacgaccggtgctcgatttagacgacagctcagggacccaaaaaccacacccctccttgggagaatcccctagatcacagctcctcaccatggactggacctggagcattccttttcttggtggcagcagcaacaggtcncccactcccgaggttcagctggtgcagtctggagcgtgagtgaagacgccgtggggccctanaggtaggacgtccttccagacgtaacggtcttcgttaggttaacccttaccgtttaaacctaacgttacgttaggttaactacgtaacgttcgggtagacgaccgacgtccccgtaggaccgtaaggtcttaggagttggaagttgggagtggtaacgtcgtacgacggtacttaaacgaaattaaactaactaacacaacgtagtcacgtaactaaggtaacgttcgaacggtacaacggtactccgaaccggtcgaaaccaccggtaacaccgactaccgacgtacgaccaagtacccgaccttagacgttaggagtccgaggacgtccgttaganaccgttgacgaacggtacgtaccggtacgttacgttacttcggtacgacggtacgaaacgtacgtaacgacggttaaagttgttttaaggaacggttaggttaaccgtcgggttacggggtaccccaacggggttacccgtaccgtacgtcccgttaccccgg

SEQ ID NO: 220404 - DNA, 789 bp, Homo sapiens
  misc_feature: GYAE6OF01AYWX1.38.22.B11.1.454.CMB.1.raw
  modified_base (198)..(198): a, c, t, g, unknown or other
  misc_feature (198)..(198): n is a, c, g, or t
  modified_base (315)..(315): a, c, t, g, unknown or other
  misc_feature (315)..(315): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacccgtgtctgtgtctccgaggggaaancgccaccctctcctgcgacggccagtcagtagtgtagcagctaacttgcctcggtaccagaccaacggtaaccgtggaccgacggcctcccgagtcccttcctcatctagtggtacncctactcccgaccgacggcctacgtacggtacctacccgagccggtaggtaccgtaggtcggacggtacgggttcgggtacggtcggtaacgtacggttacgttaccaccgtttccacgtaccgtactacggacgaccgacggttccacggtcgttaacgtttccggtaagggttaactttttacggttttaccgtaacggtttttaatttttacccgtttacgtacggtttaaacctacgtttaaccctttaagttttaacctaaccgttttccggtcccgggtttacccctttacggttacggggtttacccgggttacccggttaaccgggaccccgggtaaaggggttaacccgtaaaagggggtttaaccgtaaaaccgtttaccgggtaaaaacccggttgttacccggggttacgttacccgtacgtaaccccttaaccgtttactttcccggtttcgttacccccg

SEQ ID NO: 220405 - DNA, 841 bp, Homo sapiens
  misc_feature: GYAE6OF01AEW2J.38.22.B11.1.454.CMB.1.raw
tcagtcgatcacgtcacgaccggtgctcgatttagacgacagctcaggggacccaaaaaccacacccctccttgggagaatcccctagatcacagctcctcaccgatggactggacctggagctatccttttctgggtggcaggcagcaccaggtcgcccactcccaggttcagctggtgcagtctgggatcgtgaggtgaagacggccgtggggcctacgagtggaacggttcctaccgtggtacgaagggtccttacgttacgggttaacctacccgtttaaccaattagttacggtataccgtaacgttggggtacaccggaaccgaccgggtccctagggaaccggtaaggggtccttagggacgggttacggtaaggttcggggaactttacgggaactaccgtaggaccccgttaagtttaaaccaaaaggtttaaaacttaaccaacgttaacccgtaacgttaacgttacggaaccgtaaacggtaaagttaaccgggtacccgaaggggaacaacgggtaccggtaccgtacccgggtagaaacccggacggtactaaccgtaaccgtacccgaaccgacgacgaaccgacgtacctaacgtacgttaacgggtacggttagggaagtacccgggtacgtacggtaacgtacgttaccgtaacggtaacccgtaacggtaccggttcggttaacgttaacgttacggtttacggacggtacgtaacggaacggttaaacgtaacggtaagtttacgggttaagttaggtacggtaacggtacgggtaccgggtacgtaaccgggtaccgtaccggtccggtaaccgttcccg

SEQ ID NO: 220406 - DNA, 764 bp, Homo sapiens
  misc_feature: GYAE6OF01CAX06.38.22.B11.1.454.CMB.1.raw
  modified_base (208)..(208): a, c, t, g, unknown or other
  misc_feature (208)..(208): n is a, c, g, or t
  modified_base (346)..(346): a, c, t, g, unknown or other
  misc_feature (346)..(346): n is a, c, g, or t
  modified_base (748)..(748): a, c, t, g, unknown or other
  misc_feature (748)..(748): n is a, c, g, or t
tcagtcgatcacgtcacgaccggtgctcgatttagacgacagctcaggggggagaactgctcagttaggacccagacggaaccatggaacgccccagcgcagcttctcttcctcctgctactctggcctcccagactaccactggaagaaatgtgatggacgcagtcctccagcccaccctgtctggtcgtcctacgaaggggaaacncgccccaccctcgtcctggacgacgggccaggtcaaggtggtacgtacgcagtacctaacgttacgccgtagtaacccgagaacgaaccgtaaaccgtggacccgaacggtcccttacccggaacggtcctaccctanaacgttcgtaggtcgtcactaaccgtccccgaaaccggtcgggtaccctacgttacgggtaaccctccccggaaggtacccggtacgggttacgacgggtcgggacgttacggggtggggttaaccctaggggaacgtacgtttaccggtacccacgtttccgaaccctaaaccggtctacgaccgtaccgtaccggtaccgtacgtaccgtacgttaccgtaacggtaacgttagttttacggtacgttttagtttacgttcgtacgtactaactacgtaactttacgtacttacggtcgtacccgttacgtcggtcggtacgtaccgggacgaacgggtcgtaaaggtacggtaaacgtaacccggaacgtaacggttcgacgaccgtagaaccgttacncgttccgtcgttaccg

SEQ ID NO: 220407 - DNA, 784 bp, Homo sapiens
  misc_feature: GYAE6OF01EGSLQ.38.22.B11.1.454.CMB.1.raw
  modified_base (168)..(168): a, c, t, g, unknown or other
  misc_feature (168)..(168): n is a, c, g, or t
  modified_base (519)..(519): a, c, t, g, unknown or other
  misc_feature (519)..(519): n is a, c, g, or t
  modified_base (587)..(587): a, c, t, g, unknown or other
  misc_feature (587)..(587): n is a, c, g, or t
tcagtcgatcacgtcacgaccggtgctcgatttagacgacagctcaggggacccaaaaaccacacccctcttgggagaactcccctagatcacagctcctcaccatggactgggacctggacgctacttccttttcgttgggtcggacagcagcgaacgtagggtccncccaactcccgtaggttcacggtcgtcgtgctagttcgtcggagtcgtaggaggagaagacgtccggtcggggtacctagaggtacgacgttcctccggtaggaccgtaggtccttacgttccgttacctacgttaacctactagttacggtatacgacgtcggtcgacgtacggccgccgtaggtacgacggtcgtggacggtaggacggtgggaatggacgtacgacgtcgtaactaaacaacttaacgaaacctacgtactaactacggaacaactaacgggaacggtaccgtaacggtcggaacgtacgacgtaacccgggtccgaaccgggaccgaacgtaacccngtaccctaccggaacgacctacgaaccgtacgactacgtacggtaggtgtaccgaaggtccgtaccgnggtaccttacggaccgaacgtaccggtacggtcccgggtaagtttactaccgttagtcggtacggttacgggaaactacgggttaaaccgtaaggttacgttttaaacggtggttaccggttagggttaacccggtacgggtacccggggtaccggacggtttaaccccgggttgtccccggttaccccgtacccgg

SEQ ID NO: 220408 - DNA, 824 bp, Homo sapiens
  misc_feature: GYAE6OF01D4NI4.38.22.B11.1.454.CMB.1.raw
  modified_base (165)..(165): a, c, t, g, unknown or other
  misc_feature (165)..(165): n is a, c, g, or t
  modified_base (206)..(206): a, c, t, g, unknown or other
  misc_feature (206)..(206): n is a, c, g, or t
tcagtcgatcacgtcacgaccggtgctcgatttagacgacagctcagggaacccaaaaaccacacccctccgttgggagaactcccctagatcacagcctcctcaccagtggactggacctggagctacttcctttttcttgggtggcagcagcaacgacggtcncccacgtccctaggttcagtcgtggtcgcgagttcgtggancgtggtaggtacgaagacggccgggtcgggcctacgtaggtacggtacgtccgtcgagacgtacggttcttacgttacggtaccttacctttaacgaacgttagtacggttacaccggttaacggtggtaccggaccgtaacggtacccgggtacccggtaggggtaaaccgtggggttccgttaaggggtaccggtagggtacggggttagggtacgtacggaccttaggtacggtacttaccgttaaaataaaccgtaactacccaaagtacccgtaactaggtactaaacccggaagtaacgggttaccgtacggacggtactaacgtacggaaccgttaccgggaaccgtacaacgtacaccgacgtaccagtaccaacgttacgacgccgtaagtggacgtaggttcggaacggtacgtcgacgtacgtacggttacggacccgacggttaacgtcccggttacgttagttaccggtaaggtcggttacgaaccgtaaggtacgtagtaaacgtttacgttagtttacggaacgggttaacggttcggaaccgggtaccggggtacccgggtaaaggtttccccgggtacggttcccgtcccgggttttaccc

SEQ ID NO: 220409 - DNA, 824 bp, Homo sapiens
  misc_feature: GYAE6OF01EKLUL.38.22.B11.1.454.CMB.1.raw
  modified_base (202)..(202): a, c, t, g, unknown or other
  misc_feature (202)..(202): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccacgccctaccctgtctgtgtctacgaggggaaacncgacccaccctctccgtgcgacgggccagtcagtgttgttacgcagctaacgttcgccgtacggtaaccagaacaacggtaaaccgtcggaccgtacgggccctaccgacggtccctccgtcctacgttcgttaggtcggtacgacctaccgttaccccgaccggtaccggccctacggtacggttaaccgtcccgaacggtccggaacgggtccgtacggtacggcggtaacggggttccgggtacgggtacgggtaacgtacggttacgttacccgtaccgttaccgtaccctaaaccgtaccgttacgacggtaaccgtccgtccgtcggtacgtaacgttacgttaaggttaacgtttacgttttacgggtacttttagggttttactttcggtacgtttacgtacgttaacttaacgttaacgttaaacgtttccgtaccgttcccgtttaaccggtttagggtacccggggttaccggttaaccgggacccggggtaaaggggttaacccggtaaacggggtaacccggtaaaacgttaacccgggaaacgttacggttacggtccgggtaaccttcggaaccccgttacggttccttaccggtttcgttaacccg

SEQ ID NO: 220410 - DNA, 711 bp, Homo sapiens
  misc_feature: GYAE6OF01CPZE5.38.22.B11.1.454.CMB.1.raw
  modified_base (147)..(147): a, c, t, g, unknown or other
  misc_feature (147)..(147): n is a, c, g, or t
  modified_base (208)..(208): a, c, t, g, unknown or other
  misc_feature (208)..(208): n is a, c, g, or t
  modified_base (524)..(524): a, c, t, g, unknown or other
  misc_feature (524)..(524): n is a, c, g, or t
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
  modified_base (695)..(695): a, c, t, g, unknown or other
  misc_feature (695)..(695): n is a, c, g, or t
tcagtcgatcacgtcacgaccggtgctcgatttagacgacagctcgagggggaggaactgctcagttaggacccagacggaaccatggaagccacagcgcagcttctcttcctcctgctactctggcctcccagataccactggaanaaatagtgatgacgcacgtcctccacgccctaccctgtctgtcgtctccggaagggaaacncgcccacctctccgtgcgacggcctaggtcagtagtgtacgcagacctacgttacgccgtacgtaccagaccgaacgtaaccgtcggaccgaacggcctacccgaggtcctccctcgtaactttcgtaggtcggtaccgacctacccgtcccgaacgggtccggaccccttaaccggtaacggttacccaaccccgggaaccggtccggttaacggggtcgtaacggggtacgggtacgggtaacgggttcggggtacgtaaccggggactaaggttccgtttacgaccgtacctaccgacctacgtcgaacgtcnccgtacgtggactacgttctaagggttactttagttaccttagtttacgttnttcggtntacgactagttactacgtacttcgtcgtaccgttaccggtaggtcggtacgtccggacggtaccggaaggtacggacgtaacgaacgtaagtacggtcgtagtccatacccncttacgtcgttacccg

SEQ ID NO: 220411 - DNA, 795 bp, Homo sapiens
  misc_feature: GYAE6OF01C3JH9.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatggagggtgtccgttggggttttggggggaagaggaagactgaccggtcccccccagcagacaacgaggtcgcccacctcccgaggttcagcgtggtgctaggtcgtggagcgtggaggtagaagaacgccgtcggggcctcgaggtggtaacggtctccgtgacgtacggtcttacgtacggttacctaccttacctaacgtagtaggtactacgtaacggtgggtcgaccggaccgtaccggtccccgtaaggaccggtacggtcggttaggaggtgggagtagggagtcggactcgagtacgtactaacgaaataaacacgaacacgtaactactacgaactaacgtaacggtaacgtccggaaggtccgaagtaccggtaccgtaccggtacgaaccgtaccgacctaacgacctaccgaacgacaccgacctacaccgttacgagggttagtacgggtacgacggggacctacgggaatacggtcctaaccggtcggaacccggtacccggtacgggttacccgtttaaggtaccgttaaggtggtccggttaaagggaaacgtaacccggttagtaaaaccggttagttttaaggtttccggttaacgggtaaccggttaaccggggttaacccggggacccgggttaaaacccgggtcccccgggttaacccggtaaccccggg

SEQ ID NO: 220412 - DNA, 826 bp, Homo sapiens
  misc_feature: GYAE6OF01BKBXK.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcattccttttcttggtggcagcagcaacaggtcgcccactcccaggttcagctggtgcagtcgtggagctggaggtgaagacgccgtggggcctcgaggtagaacggtctccgtgacgaaggtcttacgttggttacctacctttaccaacttagtggttatacgtaacgtgggtcgaccggaccgacggacccgtaggaacgaacggggtcttaggacggtgggtacgtaggggtagtagggtacgtcgaacggtaccggtactttaaacaaaacttaaacgtaaaccaaccgtaaacctaaccgttaagtacgaaccgtaaacgtaaacgggttaaaccggttaccggaaagggtacctaaaggtaaccggttaacccggtaaccccgggttaacggaaacccccgtaaacgggaacctaaccgtaaccctaacccggaaccggtaacgacccaaacggtaaccgtaacccgtaacgtaggtaacgggtacggttaaggaacgggtaccgtaccggtagtaacgtacgtaccggtaggaacccgtaaccggtacgggttccgttaagtttacgttacgtgggtacgtacgggaacgttacgtaaacgtaagtaagtttacggttacggttaaggtcccggttaacggtcgggtaacggggaccctaaccggggtacccgttccggttaaccgacccgttcccg

SEQ ID NO: 220413 - DNA, 726 bp, Homo sapiens
  misc_feature: GYAE6OF01B5UJM.38.22.B11.1.454.CMB.1.raw
  modified_base (146)..(146): a, c, t, g, unknown or other
  misc_feature (146)..(146): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (503)..(503): a, c, t, g, unknown or other
  misc_feature (503)..(503): n is a, c, g, or t
  modified_base (710)..(710): a, c, t, g, unknown or other
  misc_feature (710)..(710): n is a, c, g, or t
tcagtcgatcacgtcacgaccggtgctcgatttagacgacagctcaggggggaggaactgctcagttaggacccagacggaaccatggaagcccagcgcagcttctcttcctcctgctactctggctcccagactaccactggaanaaatagtgatgacgcagtctccagccaccctgtctgtgtcctacggaaggggaaacncgcccacccttctccncggcgacgggccagtcgagtagtgtancanactaactcgtccgtaggtaaccagaccgaaacggtaaacccgtggacccgtaacgccgttacccgaacggtcccttcccgtactacgttacgtagttggtccgtaccgtactccccggaacggaccgggaccctacggttacgggaacctccccgaaggtaccggagggttacggaggtcgggacgtagggggtcggttacggtacgggaactacggttcgttacctaccgttccaacaaccgtctacggaccncgtacgcccgtagaccgtacgttacgtacggttaatttacggttccttagtttcgttttaactcgtacggtactacgtaacttacttaaccgtacgtttacgaccgttcccgtacggtttacggcggttaccggtacgggaccggtacgggtaccgtaagggtaactaaacgtacggaacttaggtcgtagcgtacacctaaccgtntacccgtctttaaccg

SEQ ID NO: 220414 - DNA, 829 bp, Homo sapiens
  misc_feature: GYAE6OF01DTP7L.38.22.B11.1.454.CMB.1.raw
  modified_base (814)..(814): a, c, t, g, unknown or other
  misc_feature (814)..(814): n is a, c, g, or t
tcagtcgatcacgtcacgaccggtgctcgatttagacgacagctcgagggggaggaactgctcagttaggacccagacggaaccatggaacgcccagcgcagcttctcttcctcctgctactctggctcccagataccacgtgggaaataaagttgtacgagtcggaccgtcgtacgtccaccgacgaccctaccgttgttcgtcgtacgtcctaaccggaagggaaacaccgtacccctcctcgtccgcggaccgacggacctagtacgagtgttacgtacgcctaacggacttaacggttacgtcccgtaaggtaaccgaacgtaacgtaaaccgtaaccggtacggaccgtaccgtacccgtaccggacgtaccctccttagttaacttacggtaccggttcggaacgtaccgtaacccgtaaaccccgtaacggtaccgggtacccttaacggttaacccgttaacccggtacccccgaagggtacccgggtaaccggttacggaccgggttaccggggacggttaaacccggggttgggggtaaccgtaacgggttaaccgtaacggtttaaacctcccggttaccctaaccgtaacccacgtacgtaccgacgtacgaccgtcgtacgtaacgttacggttaacgtaagttacgttacgtttacgtcgttttaacgtttactttcgtacgtacgtacgtacttaacttaacttacgtaccttaccgtctaccgttcggtacgtcgtacgaccgggtacgtaacggaacgtaacgtaacgtaacgacgtccggtagcctacgctaaccngttacgtgtctaccg

SEQ ID NO: 220415 - DNA, 802 bp, Homo sapiens
  misc_feature: GYAE6OF01CST5G.38.22.B11.1.454.CMB.1.raw
  modified_base (199)..(199): a, c, t, g, unknown or other
  misc_feature (199)..(199): n is a, c, g, or t
  modified_base (396)..(396): a, c, t, g, unknown or other
  misc_feature (396)..(396): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctccagactaccactggaagaaatgtgatgacgcagtctccagccacctgtctgtcgtctccgaaggggaacncgcccaccctctccgtgccgacggggccaggtacaggtagttgttagcaagtacctaacgttagtcctaggtaaccagaccgaacggtaaaccctcggaccgaacggtccctacccgacggtcctcccctatacgttccgttaaggtcggtacgacctaccgtacccgaccggacgggccctaacggtcggttaccncccgtacggccggtagggtccaggtacgggtcgtagggtcggttcgagggtaacaggttaacgttcacgttccgtaccgactatcgaaccgcgacgtccgagtacgtaactgtaacggttaattttcgttttcgaaccgtttttagttttacgttccgttagggtaacctacgttaacctttaaactttaaccgtaacgtttttacccggaccgggttttaccctaccggtttaccggggttcggggttacccgggtttaccggggaacccggttaaacccggggggtaacgttaaggggttaaaaccggaaaaccgggttaacccgtaaaaacggttcggttaccggggtaccgtacgttacccgaaacccgttccgtttaaccggtgtttcccggtttaaaccc

SEQ ID NO: 220416 - DNA, 885 bp, Homo sapiens
  misc_feature: GYAE6OF01EWI9H.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagcccacccttgtctgtcgtctccgaaggggaaacgcgtccccacccttctacctgccgagggcccgagtacaggtagttcgttagccagccaaagttcgccgtacgtaccgagacgaacgaaacccgtggaccacggcctacccgaggtccctcctacattctaaggtcggtacgtacaccgtacccaccggaccggaccctacggttacggttacctaccccgaacggacccggtacgggtacgtacgggtccggtagtacggggttcggggtacgtaggggtactaacggttacgttacctaacgttacctacgaacccttaataccggaactaccggtaaccgtccgtacgtaccgttacggtacttaacggttaaagtttaacgttttaccggttaactttaggttttttaaacccgttttcgttaacggtttaccggtaacttaccttaaacgtttaaacctttaacggttttaaccccgttacccgggtacccttttaaaccgggttaaccgggttacccgggtttaaccgggtaccgggtaaacccgggggttaaaccgggggttaaacccggttaaaggggttaaaaccgggtttaaaccgtaaaaaccgggtttaaaacccgggtaaaagggtttacccgggtaaccggttaaccggttaccggtaaaccgttaacccgttaacggtttccggtcccttttaacccgg

SEQ ID NO: 220417 - DNA, 730 bp, Homo sapiens
  misc_feature: GYAE6OF01AEB7F.38.22.B11.1.454.CMB.1.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (468)..(468): a, c, t, g, unknown or other
  misc_feature (468)..(468): n is a, c, g, or t
tcagtcgatcacgtcacgaccggtgctcgatttagacgacagctcagggggaggaactgctcagttaggacccaggacggaaccatggaacgccccagcgcagcttctcttcctcctgctactctggcctcccagataccactggagaaatagtgatgacgacagtcctccacgcccacctgtctggtctacgtaccgaaggggaaancgcccctacccttctccgtagcgacgggccagtcgaacggtagtgttagccgagtaccgtaacgttacgccgttaggaccacggaccacgtaacccgnggccgtacgccgtaccaggtcctcctanacttcgtacgtcgtccgaccaacctcccggaacggacccggtactaccggttcgtaacccgcccgtacgggaacccggtacggtcgaaacgggcgggtaacgtcgggggtccgggttagaacccgggtaaacgngtttacccggtccaccgttaccggtaaacccacgggttccaagacggtacgtacgtcgtacgcgtacgtagtaacgtagtttacggtttacgtaccgtttagtttaccgttcttcgtacgtacgtacttacgttaaccttacgtacgtccgttaccgtcgttagttaccgttacggccggtaccggtacggtacggtaacggaagtacgtaacgtaacggtaccgtggtctacggtacgtacacgtccttaggtcttaccgg

SEQ ID NO: 220418 - DNA, 889 bp, Homo sapiens
  misc_feature: GYAE6OF01C6UV1.38.22.B11.1.454.CMB.1.raw
  modified_base (573)..(573): a, c, t, g, unknown or other
  misc_feature (573)..(573): n is a, c, g, or t
tcagtcgatcacgtcacgaccggtgctcgatttagacgacagctcgaggggggaggaactgctcagttacggacccaggacggaaccagtggaacgccccagccgcagtcttctccttccctctgctactcgtcggcctcccagactaccacgtaggaagtaaatacggtgagtgaccgcgtacgtcctaccgactcccctaccgtggtcctggtacgtaccgacggaaggggacaccgcccctacctctcgacggaccgacggaccgtagtacgtaggtaggttacgtagaccgtaacggtaaccttaaccggttaccgtcggtaaccgaccggaacgaaccggtaaaccggtaaccccgtgggaacccccgacggttaccgtccccggagttacccctccggtaaccttaacgttccgggttaagggtccggtaaccgaaccctttcccgaaccccggtaaccggaccgggaacccttttacgggacccgggtaacccttacccgaacgggtttacccgggtacggcgtttaaccgggcggtaaccggggttaggtccccgggggttaaanaccggggaataaccggttcttaaaccgtcccggacctaccgaagtacgttacgaccggtacgactaccggacggttctacgttacggtaactaggttacgttagtaacgtttacgtttaccgttgtacgttaacgaacttacgttaaccttagtaacttcccggtaacccggtacttaccgggttaacgttacccgggtacggtaaccgggaccggtaaacggtaaaccggtaacgggtaacaaaacggttaccgtaaaccgtgggttaccggacgtacccgtacccgaagttacccgacgttttctccgttaacc

SEQ ID NO: 220419 - DNA, 782 bp, Homo sapiens
  misc_feature: GYAE6OF01AKSAL.38.22.B11.1.454.CMB.1.raw
  modified_base (710)..(710): a, c, t, g, unknown or other
  misc_feature (710)..(710): n is a, c, g, or t
tcagtcgatcacgtcacgaccggtgctcgatttagacgacagctcagggtcttcgtggctcacgtccaccaccacgcatgtgacctcgaggggtccgggagatcatgagggtgtccgttgggttttgggggaagaggaagactggaccggtccccccagcagcaacgaggtcgcccacgtcccgaggttcagcgtggtcgcagtcgtggacgcgtggaggtacgaagaacgcgtggggcctcgagtaggaacggtctccgtgaccgtaaggtccttacggtcggttaacccttaccgtttaaaccgaattacgttcggtaacgtccgaaccggttggggtcgtacccgagtacccggtccccggtaggtaaccgtaacgggtctaggtaacggttcgaaggttgggagttcggactaccgacgaccgttaactaaacgtaaataaaccgaactaccgaactacgtatacgaccaagtaacgtacgtcgaagggactaacgacgtaccgtaccggtacgaacccggtaccgaactaccaacgtaccccggaagggtaccgtaaacccgacgtaaaccccggtcctaaaggggttaccctagggggttaacgtacgggaacgggtccgtaccgtaagggtactacggtaacgccggaacgttaaccgtcgggtatacgttaccgcggtggtacgaccgtaagtacgtaaacncggtttaaatcggttagttacgtacggtaacccttacggggaacgggaacccctcgggtaaccgttacccgg

SEQ ID NO: 220420 - DNA, 679 bp, Homo sapiens
  misc_feature: GYAE6OF01ETCIH.38.22.B11.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
tcagtcgatcacgtcacgaccggtgctcgatttagacgacagctcagggtcttcgtggctcacgtccaccaccacgcatgtgacctcgaggggtccgggagatcatggagggtgtccgttggggttttggggggaagaggaagacgtgaccggtccccccaggcagcaacgaggtcgccccactcccgaggttcagctggtncagtcgtggagctaggaggtagaagacggccggtggggcctacgtaggtaggaacggttcctccgtggaccgaggttcctttcgtacgttaacctaaccctttaccgtaagtagtacgtactacgtacggtggcgacgaccgacggtccgtaggacgtaggtcgtaggaggtaggngtaggagtacgactcgacgtacgtaactaaacaacgtaacaaccacgtaactacgtacgacgacaacgtagtaccgtacggacggacgtacgacgtacgtacgacgacgacgaccacacgaccgagacgacacgacgtactagagtaggtagtaggacgtacgacgtgacgtacgacgacggtaccgtacgtacggtacgttacgtacgtacgcggtacgacgagtaacgtagttaagttacgttgtaacgtaggtaccggtacggttacgggaaccgggtaccgttaccggtccggtacc

SEQ ID NO: 220421 - DNA, 726 bp, Homo sapiens
  misc_feature: GYAE6OF01AZ9BG.38.22.B11.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (436)..(436): a, c, t, g, unknown or other
  misc_feature (436)..(436): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccgagccaccctgtctgtgtctaccggaaggggaaacnccgcccacccttctcctgcgagggccagtcgagagttgtacncanacctaacgttcgccgtaggtaaccaggaccaaacggaaacccgtcggacccggaacggtcccgtccccggtaggcccttaccctactattccggtaagtcggtacgacctaaccggtcccaaccgggacgggtcccctaggttacgggtaccctccccgaacgggtcccggtagggtactagggtcggngtaccggggttcgggacgtagggaccgtaagtaccgtttaccgacccttctaaccgaccgtaagtccgaacgtccgtacgtcctagcgtacgttagtaggttaatttacgtttgtacctttagtttctcggttcagtactacgttaattaccgttaacgttccgaccggtttcccttacggttaccggtcgggtacgtccggaacgggtcggtaacgtaaggggtacaaacggtacgaaaccggtgtacggtcgtacctaccggaccctaacgtcgttcccgtgttcccg

SEQ ID NO: 220422 - DNA, 776 bp, Homo sapiens
  misc_feature: GYAE6OF01B41EY.38.22.B11.1.454.CMB.1.raw
  modified_base (153)..(153): a, c, t, g, unknown or other
  misc_feature (153)..(153): n is a, c, g, or t
  modified_base (563)..(563): a, c, t, g, unknown or other
  misc_feature (563)..(563): n is a, c, g, or t
  modified_base (572)..(572): a, c, t, g, unknown or other
  misc_feature (572)..(572): n is a, c, g, or t
  modified_base (612)..(612): a, c, t, g, unknown or other
  misc_feature (612)..(612): n is a, c, g, or t
  modified_base (748)..(748): a, c, t, g, unknown or other
  misc_feature (748)..(748): n is a, c, g, or t
tcagtcgatcacgtcacgaccggtgctcgatttagacgacagctcaggggggaggaactgctcagttaggacccagacggaaccatggaacgccccagcgcagcttcctcttcctcctgctactctcggcctcccagtactaccacgtggaanaaagttagtagatcggacgctacgtcctaccgacgcccctaccgttgtctgttcgtacgtaccgggaaaggggaaaactccgcccctacccgtcgttccgacggccgacgggtaccctaaggttaccgaaggtacggttacgtaacggacctaacggtacctaaaccgttccggttaccgttaaggtaaccgaagaaccgtaaaccgtaaccggtcggacccgacgtacccgtccgacggtccttccccgtataacgttcgtaacggttcggactaaccctacccgtaacccggaccggacggtaccctaaacggttcgtaaaccctacccggaacggttacccgggacggttacgaggttcggtacggtggggtacggttcggacggtaatacggtacgtctacgtacnccacgtacncgaagctccacgtcgacttagtcttaaggtcttacgtttntaaccgtttgtttactcgttagtctaagtattaccgttaaattacgtcccgtcgttacccgtaggtacgttccggtacgtccgggaacggaaccgggttagaaacggtaacgaactaacggacgttagaccgggtnacgtactaccttaacgcttcgtgtaacc

SEQ ID NO: 220423 - DNA, 681 bp, Homo sapiens
  misc_feature: GYAE6OF01ED0NA.38.22.B11.1.454.CMB.1.raw
  modified_base (241)..(241): a, c, t, g, unknown or other
  misc_feature (241)..(241): n is a, c, g, or t
  modified_base (384)..(384): a, c, t, g, unknown or other
  misc_feature (384)..(384): n is a, c, g, or t
  modified_base (519)..(519): a, c, t, g, unknown or other
  misc_feature (519)..(519): n is a, c, g, or t
tcagtcgatcacgtcacgaccggtgctcgatttagacgacagctcaggggacccaaaaaccacacccctccttgggagaatcccctagatcacagctcctcaccatggactggacctggagctattccttttcgttggtggcagcagcaacgaggtcgccctactcccgaggttcagtcttggtcgcgtagtcgtggatcgtggaggtagaagacggccgtggggcctgagtaggagtccncgtagactacggtcttcgtacgtaaccttaccttacagttagaggttactacgacggtgggtcgaccgtacggacgtcccgtaggacgtaggtctggtaggtggtaggtggtagtggactcgagtctaactaagtaaactaanaacaccatactactcgacaagactaacggtcgaggactaggtacaccgtacgaccgaacgacgtaacacgtaccgacaaccggactacgaaacgaccgtacaaggtacgtacggtagtgacggtaccaggtacgngtaatccgtacgaacgaccgttcggccgttagttacgtacgtggacggaggtaacgtaccgttaagaacgtttaagtttaacgttgggttaacggtacgacccgggtttacggaccggggtaacggttacccggtaccctgggtaacccccgtcgtaacccg

SEQ ID NO: 220424 - DNA, 794 bp, Homo sapiens
  misc_feature: GYAE6OF01DS9IU.38.22.B11.1.454.CMB.1.raw
  modified_base (177)..(177): a, c, t, g, unknown or other
  misc_feature (177)..(177): n is a, c, g, or t
  modified_base (365)..(365): a, c, t, g, unknown or other
  misc_feature (365)..(365): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
  modified_base (619)..(619): a, c, t, g, unknown or other
  misc_feature (619)..(619): n is a, c, g, or t
tcagtcgatcacgtcacgaccggtgctcgatttagacgacagctcgagggggaggaactgctcagttaggacccagacggaaccatggaacgccccagcgcagcttcctccttcctccctgccttacctcgttcggacctcccgaagaacttaccgacgtaggaagaaaattaggtnatcgaacgctcgtcctaccacgccacccttgttactgtcgttacgaccggaaggggaaactccgcccctaccctcgttcccgaggaccggacgggcctaagtcgaaggttacgttcgtagactacgaccttaacgttgaccgtacgtacgaacgtaccgaacgaaccgtcgccgtacggtccaccggngtccctaccgactctagtcgtcgtcgacctaccgacccgacggccggacctacgtacggtacctaccgacggcggtaggacgtgggtacgtcggtgggtcggtcgaacggacgtacgtaccgtcctaaccgtaccncgtaacnctacgcaccgttacggctacggtactacggtagttaacgttagttttaacgttgtttaactttttacgtttcgtttcacggttacgtaacgtttacgttaaaccggttttntaaaccgtttcgttccccgttaaacgggtttcccgtttacgggtttaaccccgggtacgttacgggaaacccggttaaggggaaacctttaacgggtaaaaccgtacggttaaacgtaccgggtacgttacgggtacctacggtaccctaacctacggttacttgtaccggttcc

SEQ ID NO: 220425 - DNA, 1062 bp, Homo sapiens
  misc_feature: GYAE6OF01B1OGX.38.22.B11.1.454.CMB.1.raw
  modified_base (118)..(118): a, c, t, g, unknown or other
  misc_feature (118)..(118): n is a, c, g, or t
tcagtcgatcacgtcacgaccggtgctcgatttagacgacagctcagggggaggaactgctcagttaggacccagacggaaccagtaggaacgccccagcgcagtcttcctcttcccncctgacttactcgtcggcctacccagacctaccagtaggaagtaaatcggtgaagtcgacgactacgtccctaccgaccgcccctacccgtggttcctggtccgtaccgacggggaaaggggaactcccgccctacccttccgtaccgcggacggacgggtacctaggtacgaggttacggttagtaacgccggaggtaacccttacggttaccgtccggtaacgggtaaccaacgggtaaccgaaaccggtaacccggtggaccccggaccggtcccgtaccgaccggttccctaccccttagtaaccgttaccgttacgggcggttacccgtaacctacccggtaaccccggaacccgggtacccgggtaacccttaccggttacccgggtaaccccttaccccggaaggggtacccggtcggggtaactcggggtaccgggttacggggttacgggtcgggttacccgggaaggggtaacccgttacggtttaccccgtacccgtacccgttaccgtaaccgtacggtaacccgccggtaaccggtacggtacccggtacgtacccggtaaggttaacccgtaacgggtttaaaggtttaaccttttcggtttaaaccgggttacgtttttaacggtttttaccgttacggtttaacggtttaacccgttaaggtttaaaccctttaaacccgggtttcgtttaaaccccgggttacccgttttaacccgggtaccccctttaacgggggttttaacccgttacccggggggttacccggttaccgggggtaaacccggggttaaaccggggtaaaccgggttaaacggggtaaacccggtaaacgtttaaaccccgggaaacgggtttaccggtcggttaaacccggtcccgttaccggtaacccttaaccggttacgtttacccgttcccgttaacccg

SEQ ID NO: 220426 - DNA, 952 bp, Homo sapiens
  misc_feature: GYAE6OF01AN43I.38.22.B11.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
tcagtcgatcacgtcacgaccggtgctcgatttagacgacagctcagggtcttcgtggctcacgtccaccaccacgcatgtgacctcaggggtccgggagatcatggaggggtgtccgttggggttttggggggaagagggagactggacggtccccccagcaggccaacagtacgcccactcccaggttccagctggngtcagtctaggagtcncggtaggtagaagtaacggccggttgggggccttacgaggtacggtaacggtcctacctaggtaccaaacgggtcttttacgtacgggtttaaccttaacctttttaacccaacttacgttacggtaacttaccggaaacgttggggtaccgaccggaaccgtaccgggtcccccggaacggaacgtaagggtaccgtttaagggaacgggttacggaaaggttcggggtaactttaggggacgtaacgtaacgggtaccgttaacgtttaaaaccgtaaaagttaaacctaaaccgacccaacggttaacctaacgggttacaaaccgtaacgtaaaccgggttaaccgggtttaaaccccgggaagggggtaaccgtaaccgggtaaccgttccggaaaccccggtaccgaaccggaacccccgaactaaccgaacgtaaccccgagggtaacccgtaaccaacccgtaaccggtaccctaaacgtacggttaaccggggtaagttacggaacggggttacggtcttaacgggtaataacggttaccgtaccggaacccgtaacggttaaccggtcgggttaactttacgggttaccttacggaacgggcgggttaaaacgaaggtaaccgtaaaggtttaaacggttggttttaacgtttaaacggggtcggttaaacggttacccggggaaccgggtaacccgggttaaaccggtccccgggtttaacccggg

SEQ ID NO: 220427 - DNA, 811 bp, Homo sapiens
  misc_feature: GYAE6OF01ANR81.38.22.B11.1.454.CMB.1.raw
  modified_base (129)..(129): a, c, t, g, unknown or other
  misc_feature (129)..(129): n is a, c, g, or t
  modified_base (288)..(288): a, c, t, g, unknown or other
  misc_feature (288)..(288): n is a, c, g, or t
tcagtcgatcacgtcacgaccggtgctcgatttagacgacagctcagggtcttcgtggctcacgtccaccaccacgcatgtgacctcaggggtccgggagatcatgaggtgtccttgggtttggggganaggaagactgacggtcccccagcagcaacaggtgccactcccaggttcagctggtgcagtctcggtagctgaggtgaagagccgtgggcctcagtgaggtctccgtgcgaagcttcgtggttacctacctttaccgattagtggtatacaacgtgggtnaccgacgacgccctaggacctaagggtcgtgaggtgagtacgggtatggactcgacgtacgtacctttaacaaaattaaacgaaaccctacctaaaccgacgttaacgttacgaccgtaaactaaacgggtaaacgttacccggaacgggtaacgaacggtaacggtttacccggaaacccggttacggaacccgaaccgggtaacccaaaccgtaaccgtaccccgtaaacggaaacccgacgtaaccgaaccgtacccgaaacttaacgtaagggtaacgggtttaacgaacggggtactaccgttaacgggaacgtacgttacggtaacgggtaaccgggaaccgtaacccgggttccggttaacgtttaaccgtaaccggtttaggtacgggtaaccggtaaacgggtaacggttaacgtaacggtttaaaacggttacgttttaaggttaccgttaaccgggtaaccgtttaaccgggtaaccgggggaacccggtcgggttaaaccccggttacggg

SEQ ID NO: 220428 - DNA, 505 bp, Homo sapiens
  misc_feature: GYAE6OF02I7XNE.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtatcccagccagggtcagtggcagtgggtctgggacagagttcactctcaccatcagcagcctgcagtctgaagtattttgctagtttatttctgttcagctattacaattactggtcctcctacgtggtaccgttcggccaggggaccaaggtcggaaatccaaacgaactgtagctgcaccatctgttac

SEQ ID NO: 220429 - DNA, 487 bp, Homo sapiens
  misc_feature: GYAE6OF02GTG6I.38.22.B11.1.454.CMB.1.raw
tcagtcgatcacgtcacgaccggtgctcgatttagacgacagctcaggggaggaactgctcagttaggacccagacggaaccatggaagcccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccagggtcagtggcagtgggtctgggacagagttcactctcaccatcagcagcctgcagtctgaagattttgctagtttatttctgtcagcattacaattctgcctcctacgtgacgttcgccagggaccaaggtggaaatcaaacgactgtggctgcaccatctgtc

SEQ ID NO: 220430 - DNA, 494 bp, Homo sapiens
  misc_feature: GYAE6OF02F81DY.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccagggtcagtgcagtggctgggacagagttcactctcaccatcagcagcctgcagtctgaagtattttgctagttttatttctgttcagtctattacattactggtcctcctacgtggacgttcggccgagggaccaggtggaaatcaaacgactgtgctgcaccatctgtc

SEQ ID NO: 220431 - DNA, 565 bp, Homo sapiens
  misc_feature: GYAE6OF02IBJVU.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggcctcccaggcctcctcatctatggtgcatccaccagggcccacgtggtactcccagccagggtcaggtggcagtgggtctggggacaggattcactctcaccatcagcagcctgcagtctgaagtattttgcttagttttatttcgtgttcagtctattacaatttactggtccttccgtacgttcggtacgtttccgggccgtaggggacctaagggttacggaaacgttaccgaaaacggtaaccgttggttacggccgttaggacctaacccgtacgttaccgtgtttaccc

SEQ ID NO: 220432 - DNA, 493 bp, Homo sapiens
  misc_feature: GYAE6OF02H64LI.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccacagggccactggtatcccagccagggtcagtggcagtgggtctgggacagagttcactctcaccatcagcagcctgcagtctgaagtattttgctagttttatttctgtcagctattacaattactgcctctacgtggacgttcgccgagggaccaaggtggaaatcaaacgactgtggctgcaccatctgtc

SEQ ID NO: 220433 - DNA, 515 bp, Homo sapiens
  misc_feature: GYAE6OF02G81JB.38.22.B11.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcagcaacttagcctggtaccagcagaacctggccaggctcccaggctcctcatctatggtgcatccaccagggccactggtactcccagccagggtcagtggcagtgggtctgggacaggagttcactctcaccatcagcagcctgcagtctgaagtattttgctagttttatttctgtcagtctattacaatttactgtcctcctacgtcggtacgttcggccgaggggaccaagggtcgaaagtacgaaacgtacgtgtaggctggacctaccgatctgtcc

SEQ ID NO: 220434 - DNA, 546 bp, Homo sapiens
  misc_feature: GYAE6OF02IV8YA.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtactcccagccagggtcagtggcaggtgggtctgggacaggtagttcactctcaccatcagcagcctgcagtctgaagtatttgcttagttttatttctgtcagtctattactaatttactcggtccttccgtacggttggtaccgtttccgggccgtacggggtacctaagggtacggaaacttaccgaaacggtaacgtggtaggacgtgacctacctagttccgtgttcc

SEQ ID NO: 220435 - DNA, 583 bp, Homo sapiens
  misc_feature: GYAE6OF02JQBD8.38.22.B11.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccacctctcctgcagggccagtcagagtgttagcagcaacttagcctggtaccagcagaaacctggaccaggctcccaggcctcctcatctatggtcncatccacgagggcccacgtggtactcccgagcccgagggtccaggtggcaggtcgggtactgggacaggtagttcactctcaccatcagcagcctgcagtctagtaatatttgcttagttttattctgtactagctaattacaatttaccgtgtaccttaccgtacggttcggtaaccgttcggaccgtaaggggtacctaagggttacggaaagttaaccggaaaggtaaccgttaggttacggtaccgtacggtacccaaccgtactttaccgtcgtttacccg

SEQ ID NO: 220436 - DNA, 508 bp, Homo sapiens
  misc_feature: GYAE6OF02J0UB7.38.22.B11.1.454.CMB.1.raw
  modified_base (195)..(195): a, c, t, g, unknown or other
  misc_feature (195)..(195): n is a, c, g, or t
  modified_base (497)..(497): a, c, t, g, unknown or other
  misc_feature (497)..(497): n is a, c, g, or t
tcagtcgatcacgtcacgaccggtgctcgatttagacgacagctcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggcccactggtactcccagccagggtcaggtggcagtgggtctgggacaggagttcactctcaccatcagcagcctgcagtctgaagtatttgctagtattatttctgtcagtctattacaattactggtccttctacgtggtaccgttcgaccgagggaccaaggtggaaatacgaaacgtacgtgtaggtcngcacctatctg

SEQ ID NO: 220437 - DNA, 527 bp, Homo sapiens
  misc_feature: GYAE6OF02HYKW6.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcaagaaacctggccaggctcccgaggcctcctcatctatggtgcatcccacagggccacgtggtactcccagcccgaagggtcaggtggcaggtggtctgggacaggtagttcactctcaccatcagcagcctgcagtctagtagtattttgcttagttttattctgtcagtctaattacaattactcgccttcgtacgtggtacgttcggaccgaggggacctaaggtacggaaatacgaaacgtaactgtggtctgaccactatctgtcc

SEQ ID NO: 220438 - DNA, 538 bp, Homo sapiens
  misc_feature: GYAE6OF02I0OYB.38.22.B11.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (395)..(395): a, c, t, g, unknown or other
  misc_feature (395)..(395): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccagtcagagtgttagcagcaacttagcctggtaccagcagaacctggccaggctcccaggctcctcatctatggtncatcccacgagggccactggtactcccaggcccagggtcaggtggcaggtgggtctgggacagagttcactctcaccatcagcagcctgcagtctagaagtnttttgcttagttttattctgtcagctattactaattccgtcgtccttacgtacgtcggtaccgtcgaccgacgggtacgaagggttacggaaacgtaccgaaacgtacgttcggtacgtcgtcgacctacctgttctgttacc

SEQ ID NO: 220439 - DNA, 577 bp, Homo sapiens
  misc_feature: GYAE6OF02GPG94.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccacgtggtactcccagccagggtcagtggcaggtgggtctgggacaggagttcactctcaccatcagcagcctgcagtctagaagtatttgcttagttttatttcgtgtcagtctaattacaatttacctggtcccttaccgtacgttcgggtaccgtttccgggaccgtaagggggtaccctaagggttaggaaaacgttaccgaaaaccggtaacgttacgggtacggtaccgtacggtaccgtaacccgtacttaccgtcgttaccg

SEQ ID NO: 220440 - DNA, 529 bp, Homo sapiens
  misc_feature: GYAE6OF02IJ3L2.38.22.B11.1.454.CMB.1.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaanagcccaccctctcctgcagggccagtcagagtgttagcagcaattgcctggtaccagcagaaacctggccaggcctccgaggctccncatctatggtgcatccaccgaggccactggtatcccagccagggtcagtgcagtgggtcngggacagagtcactctcacatcagcagcctgcagtcagaatntttgcttagttttattctgtacagctattactaattctgcctcgttacgtggtacgttcggaccgtaggggacctaaggtcggaaactaccgaaacgtaacgttagtacggtcgtacgcctaaccgtattccgtagttacc

SEQ ID NO: 220441 - DNA, 545 bp, Homo sapiens
  misc_feature: GYAE6OF02H4W9R.38.22.B11.1.454.CMB.1.raw
  modified_base (524)..(524): a, c, t, g, unknown or other
  misc_feature (524)..(524): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggcctcctcatctatggtgcatcccaccagggcccactggtactccccgagccgagggtcaggtcgggcgaggttcggggtcgtggggacaggtagtttcacttctcaccatcagcagcctgcagtctagagtattttgcttagttttatttctgtcagtctaattactaatttactcggtcctcgtacgtggtacgttcgggaccgtaggggaccgtaagggtaggaaactccgaaacgtacgttgnggctgaccaccgtatctgttc

SEQ ID NO: 220442 - DNA, 577 bp, Homo sapiens
  misc_feature: GYAE6OF02I25K6.38.22.B11.1.454.CMB.1.raw
  modified_base (201)..(201): a, c, t, g, unknown or other
  misc_feature (201)..(201): n is a, c, g, or t
  modified_base (422)..(422): a, c, t, g, unknown or other
  misc_feature (422)..(422): n is a, c, g, or t
tcagtcgatcacgtcacgaccggtgctcgatttagacgacagctcaggggggaggaacctgctcagttaggacccaggacggaaccatgggaagccccagtcgcagcttctcttcctcctgctactctggctcccagactaccactggagaaatagtgatgacgcagtctcagccacctgtctgtgtctccgaggggaaancgccacccgtctccgtgccgagggccagtcagagtgttagcagctaacttgccttggtaccagacaagaacctggccaggcctcccgaggcctcctcatctacgtggtcgcatccgacgagggcccatggtactcccgagccagggtcaggtggcaggtcggctgggacaggtacgttcactctacgacctatcacgctacgcctcgcagtctagtaagtnttttcgacttagtttacttcgtgtcagtactattactaacgttacgtcgtacctacctacgtcggtacgttcgaccgtacgggaccgtaaggtacggtaaactacgaaacgtaacgttaggtcggacgtcggaccgtacgtacgttcgtgttccg

SEQ ID NO: 220443 - DNA, 698 bp, Homo sapiens
  misc_feature: GYAE6OF02F1BKI.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagttgatgaacgcagtctccacgtccaccctgtctgtcgtacgtcgaggggaagcgccctaccctctccgtgcgacggcctagtcgagtacgtgtacgcagactaacgttacgccgtacggtaaccaggaccaacgtaaaccgtggaccgtacggccgtcccagggccttccctagtacttactagtcggtctacctactccggaccagggtccacgtcggtaactcccgaggtccgagggtccgaggtcgggcgtagggtcgggtacgtacggggtacaggttacgtcacctcgtaccaccgatccgacgtcacgtccgtgtacgtacgtccgtagtaacgttattttacggtacttagtttactttcgtacgttactagtactaacttaacgtacttaccgttccggtaccttacccggttacggttacggtaccggttaccgggaccggtaacggggtacctaagggtacggtaaactaccggtaaacggtaccggttagtaccggtaccttacgccgttaaccgtacgttaccgttgtttaccccg

SEQ ID NO: 220444 - DNA, 568 bp, Homo sapiens
  misc_feature: GYAE6OF02FYNAC.38.22.B11.1.454.CMB.1.raw
  modified_base (196)..(196): a, c, t, g, unknown or other
  misc_feature (196)..(196): n is a, c, g, or t
  modified_base (393)..(393): a, c, t, g, unknown or other
  misc_feature (393)..(393): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccgagggcccatggtactcccagccagggtcagtggcaggtgggtctgggacagagttcactctcaccatcagcagcctgcagtctagaagtnttttgcttagtttatttctgtcagtctatttaacaatttacgtggtcccttcgttacgttcggtaccgttccggaccgacggggtaccgtaagggtacgggtaaaactaccgaaaaccggtaacgttaggttacggtaccttacggacctaacccgtacttccgttaggttaccc

SEQ ID NO: 220445 - DNA, 564 bp, Homo sapiens
  misc_feature: GYAE6OF02H6472.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccagtcagagtgttagcagcaacttagcctggtaccagcaagaaacctggaccaggcctcccgaggcctcctcatctatggtgcatccacgagggccacgtggtactcccgagcccgagggtcaggtcggctaggtgggtcgtgggacaggtagttcacgtctcaccatcagcagcctgcagtctagaagtattttgacttagttttattctgtcagtactattaactaattcgtcgtccttccgttacgtcggtaccgttccggaccgtaggggacctaagggtacggaaagtaccgaaacggtacgttaggtcggtactcggacctacctacgttcgtgttacc

SEQ ID NO: 220446 - DNA, 509 bp, Homo sapiens
  misc_feature: GYAE6OF02GTDHX.38.22.B11.1.454.CMB.1.raw
  modified_base (507)..(507): a, c, t, g, unknown or other
  misc_feature (507)..(507): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggcccactggtactcccagcccagggtcagtggcaggtgggtctgggacaggagttcactctcaccatcagcagcctgcagtctgaagtattttgcttagttttatttctgtcagctattacaattactggtcctcctacgtcggtacgttcggccgagggaccaaggtggaaatacaaacgaactgtggctgccaccatctntc

SEQ ID NO: 220447 - DNA, 554 bp, Homo sapiens
  misc_feature: GYAE6OF02II9AK.38.22.B11.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttagcagcaacttagcctggtaccagcagaaacctggccaggctcccaggctcctcatctatggtgcatccacagggccactggtactcccagccgagggtcaggtcggcaggtgggtctgggacaggtagttcactctcaccatcagcacgcctgcagtctagaagtattttgcttaagttttatttctgttcagtctaattacaatttactcggtcccttaccgtacgttcggtaccggtttccggacgtacggggaccgtaagggttaggaaactaccgaaacgtaacgttaggtacggactacgccgacctagtccgtgttccc

SEQ ID NO: 220448 - DNA, 778 bp, Homo sapiens
  misc_feature: GYAE6OF02JMS1Z.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttgcctggtaccagcaacgaaacctggaccaggcctcccgaggcctcctcatcctagtcggtcgacactcccaaccgagggcccaacgtcggtactccccgaagcccgagggtcaggtggacctagggttcgggtctggggaaccagggtacgtttaccacgttcctaccgaaccgtagtccgaacggtaccaacggtcccgtacggacccgtaacggttaccgttaggtaaacggtttacgttttttacggaccgtttaaggttttttaacgttttccgttaggttacctaacggtacctttaaacgtttaaccttaaacgttttaccggtaccgggttaccccgtttacccgttaacgggttaccgggttaacccggtttaccggggtacccgggtaacgggggttaacccggtaacggggttaacggtaaaaccggtttaaccggaaaaccgggttaaaccgttacggggttaccggtaaccggttacggtaacccgttaacccgtaaccggtttaccgttaccgggtttaaccc

SEQ ID NO: 220449 - DNA, 718 bp, Homo sapiens
  misc_feature: GYAE6OF02JMZF7.38.22.B11.1.454.CMB.1.raw
  modified_base (266)..(266): a, c, t, g, unknown or other
  misc_feature (266)..(266): n is a, c, g, or t
tcagtcgatcacgtcacgaccggtgctcgatttagacgacagctcagggggaggaacgtgctcagttaggacccagacggaaccatggaagccccagcgcagcttctcttcctcctgctactctggctcccagataccactggagaaatagtgatgacgcagtctccagcccaccctgtctgtgtctccgaggggaaagagcccaccctcgtccctggaccacgggccaggtccagtacgtgttagcagcaaattgcctggtaccngacagaacctggccaggcctcccgaggctccctcgactctagtcgggtcgaccacgttcccaaccgacggggcccaacgtggtacaccccgtagcccgagggtccaggtcggacgtggtcgggtacgtcggggaactaggtacgtttaccgaccgttcctaccgaaccctagttacccgaggaccctaaggcccgttcgaccgtaagttccgttaaggaaaccgttatttttcgggaccttaaggtttttacttcgtagtcctaaggtaccttagttaactaacgtttaccgtcggtaccgtacccttacgggttacggtacggttacgggaccgaaccggggttaacgtaaacgggttacggtaaacggttaacctaaaaccgggttaacgttacggttaccgggtcgttaacgaccgtacccgtaaaccggtttccttacggtttaaccg

SEQ ID NO: 220450 - DNA, 524 bp, Homo sapiens
  misc_feature: GYAE6OF02JE93F.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggcccacgtggtactcccagccagggtcagtggcaggtggtctgggacagagttcactctcaccatcagcagcctgctagtctagaagtattttgcttagtttatttctgtcagctattactaattactgtccttccgtacgtcggtacgttcggaccgagggaccaagggtaggaaactacgaaacgtacgtgtacggcgtcgcctaccacttcgtgtc

SEQ ID NO: 220451 - DNA, 531 bp, Homo sapiens
  misc_feature: GYAE6OF02GWV77.38.22.B11.1.454.CMB.1.raw
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggcccactggtactcccagccagggtcagtggcaggtgggtctgggacagagttcactcgtcaccatcagcagcctgcagtctagaagtnttttgnttagttttatttctgtcagctattactaatttacgtcgtccttccgtacgtggtaccgttcggaccgaggggaccaagggtacggaaactacgaaacgaacgttgtcggtctggccaccacttctgttacc

SEQ ID NO: 220452 - DNA, 694 bp, Homo sapiens
  misc_feature: GYAE6OF02GRIUF.38.22.B11.1.454.CMB.1.raw
  modified_base (278)..(278): a, c, t, g, unknown or other
  misc_feature (278)..(278): n is a, c, g, or t
tcagtcgatcacgtcacgaccggtgctcgatttagacgacagctcagggggaggaactgctcagttaggacccagacggaaccgatggaagaccccagcgcagcttctcttcctcctgctactctggctcccagataccactaggagaaatagtgatgacgcagtctccagccaccctgtctgtgtctccgaagggaagcgccaccctctcctgcacgggccagtcagagtgttagcagcaacttagcctggtaccagcagaaacctggaccaggccncccaggcctcctcactctatggtgcatccgaccagggccacgtcggtactcccaagcccgagggtccaaggtcggcaggtcgggtcgttggggactaggtacgttcacgttctaccaccgtattaccgacgtctaacggtccctaggtacctaagtttcgtaggaaacgttatttttcggaccttaagtttttactttcgtagttacacgtacaatttaacgtaacgttttaccgtcggtacccgtttacccttagggttcggttaacccggtttccggaacccggtaacgggggtaaccccgtaaggggtaacggtaaaaccgttaaccggtaaaaaccggtaaccggttagggttacgggtacccgttacggtaccccgtaaacccgtttagttacccgttcggttttaacccc

SEQ ID NO: 220453 - DNA, 532 bp, Homo sapiens
  misc_feature: GYAE6OF02G47Z7.38.22.B11.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (388)..(388): a, c, t, g, unknown or other
  misc_feature (388)..(388): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctcccaggcctcctcatctatggtncatccaccagggccactggtactcccagccagggtcagtggcagtgggtctgggacagagtcactctcaccatcagcagcctgcagtctgaatntttgcttagttttatttctgtctagtctattactaattcgtggtccttcgttacgtcggtacgttccggaccgacggggtacctaagggtacggaaattaccgaaacgtacgtaggtaggacttgacctacagttctgttaccg

SEQ ID NO: 220454 - DNA, 496 bp, Homo sapiens
  misc_feature: GYAE6OF02GVK1W.38.22.B11.1.454.CMB.1.raw
  modified_base (490)..(490): a, c, t, g, unknown or other
  misc_feature (490)..(490): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtactcccagccagggtcagtggcagtgggtctgggacaggagttcactctcaccatcagcagcctgcagtctagaagtattttgctagtttatttctgtcagctattacaattactgtcctctacgtggtacgttcgcgagggacaaggtaggaatacaaacgactgtggctgcacntctgtc

SEQ ID NO: 220455 - DNA, 536 bp, Homo sapiens
  misc_feature: GYAE6OF02F3OIY.38.22.B11.1.454.CMB.1.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggctcccaggcctcctcatctagtggtncatccaccgagggcccacgtggtactcccgagccgagggtcaggtggcaggtggtctgggacagagttcactcctcaccatcagcacgcctgctagtctagaagtattttgacttagtttatttctgtcagtctattacaattcgtcgtccttcgtacgttcgtaccgttcggaccgagggtacctaaggtacggaaataccgaaacgtaactggtaggactggacctacgtactcgtgtc

SEQ ID NO: 220456 - DNA, 568 bp, Homo sapiens
  misc_feature: GYAE6OF02FRMJT.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggcctcccaggcctcctcatctatggtgcatcccacgagggccacgtggtactcccgagccagggtcaggtggcaggtgggtctgggacaggtacgttcactctcaccatcagcacgcctgctagtctagaagtatttgcttagtttatttctgtcagtctaatttaacaatttcgtcggtcccttaccgttacggtcggtaccggttccgggaccgtaacggggaccaagggttacgggaaacttaccgaaaacggtaacgttggtacggtcgtacggaccaccgtacgttactgttacc

SEQ ID NO: 220457 - DNA, 519 bp, Homo sapiens
  misc_feature: GYAE6OF02IS6TL.38.22.B11.1.454.CMB.1.raw
  modified_base (343)..(343): a, c, t, g, unknown or other
  misc_feature (343)..(343): n is a, c, g, or t
  modified_base (424)..(424): a, c, t, g, unknown or other
  misc_feature (424)..(424): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactggtgcgacaggccccctggacaagggcttgagtggatgggatggatcagcgcttaacaataataacacacactatnacacagaagttcaggcagagtcaccgtgaccacggacacatccacgagcacagcctacatggagttgagagcctgagatcngacgacgacgggccgtgtattacgtgtgacgagagtacgaagtaatagttagttatggtactacgtcgggccagggaccctaggtccaccgtacc

SEQ ID NO: 220458 - DNA, 561 bp, Homo sapiens
  misc_feature: GYAE6OF02G2OGA.38.22.B11.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctcccaggctcctcatctatggtncatccaccagggccactggtactcccagcccagggtcaggtggcaggtcgggtctgggacagagttcactctcaccatcagcagcctgcagtctagagtattttgcttagtttattctgtcagtctattactaattactcggtacctccgttacgtcggtaccgttcgggaccgtacggggtaccgtaagggtacggtaaacgttaccgaaaacggtaaccgttagtacgggtacctcggtaccgtaaccctagttccgtgttacccg

SEQ ID NO: 220459 - DNA, 568 bp, Homo sapiens
  misc_feature: GYAE6OF02GS2BH.38.22.B11.1.454.CMB.1.raw
  modified_base (196)..(196): a, c, t, g, unknown or other
  misc_feature (196)..(196): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctcctgcagggccagtcagagtgttagcagcaacttagcctggtaccagcagaaacctggccaggctcccaggctcctcatctagtggtgcactccaccagggccacgtggtactcccagccagggtcaggtggctaggtgggtctgggacaggacgttcactctcaccntcagcacgcctgcagtctagtaagtnttttcgacttagttttactttcgtgttcagtactaatttacaatttactcggtcccttacgttcggtggtaccgttcggaccgtaggggtacctaagggtacggtaaacgtaccgaaacggtacttaggtacggtactacggaccgtacctagttccgtaggttcc

SEQ ID NO: 220460 - DNA, 566 bp, Homo sapiens
  misc_feature: GYAE6OF02G3X3U.38.22.B11.1.454.CMB.1.raw
  modified_base (198)..(198): a, c, t, g, unknown or other
  misc_feature (198)..(198): n is a, c, g, or t
  modified_base (405)..(405): a, c, t, g, unknown or other
  misc_feature (405)..(405): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgccaccctctcctgcagggccagtcagagtgttagcagcaacttagcctggtaccagcagaaacctggccaggctcccgaggcctcctcatctatggtgcatcccaccgagggccacgtggtactcccagccgagggtcaggtggcaggtgggtctgggacaggtacgttcactctcaccatcagcacgcctgcagtctagaagtntttgacttagttttattcgtgtcagtctattactaatttcgtcgtaccttccgtacgttcggtaccgttccggaccgtacggggtacctaaggggtacggaaaacttaccgaaacggtacgtacggtacggtacgtcgacctaccgtattccgttagttcc

SEQ ID NO: 220461 - DNA, 581 bp, Homo sapiens
  misc_feature: GYAE6OF02G4ILD.38.22.B11.1.454.CMB.1.raw
  modified_base (196)..(196): a, c, t, g, unknown or other
  misc_feature (196)..(196): n is a, c, g, or t
  modified_base (363)..(363): a, c, t, g, unknown or other
  misc_feature (363)..(363): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggctcccaggctcctcatctatggtgcatccaccagggccactggtactcccgagccagggtcagtggcaggtgggtctgggacagagttcactcncaccatcagcagcctgcagtctagaagtattttgcttagtttatttcgtagtctagtctattaactaatttacgtcggtcccttaccgttacggttcgggtaccggtttaccgggaccgtaacgggggaccgtaaggggtacggtaaacgttaccgtaaaacggtaacgttacggtacgggtacgttacggacctaaccgtacttcgttacgttaccc

SEQ ID NO: 220462 - DNA, 621 bp, Homo sapiens
  misc_feature: GYAE6OF02FQ991.38.22.B11.1.454.CMB.1.raw
  modified_base (134)..(134): a, c, t, g, unknown or other
  misc_feature (134)..(134): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (412)..(412): a, c, t, g, unknown or other
  misc_feature (412)..(412): n is a, c, g, or t
tcagtcgatcacgtcacgaccggtgctcgatttagacgacagctcagggggtagggaactgctcagttaggacccagacggaaccatggaagccccagcgcagcttctcttcctcctgctactctggctcccanataccactggagaaatagtgatgacgcagtcctccagcccaccctgtctgtgtctccaggggaaangccaccctntcctgccagggccagtcagagtgtagcagcaacttagccctggtaccagcagaaccttgccaggctcccaggctcctcatctatgtgcatccaccagggcccacgtggtactccccagcccaggggtcaggtggccaggtgggtctggggaccaggacgttcacctctacacccatccagcacgcctgccagtctagaacgtntttgccttagtttactttctgtctagtcctaatttaccaactttacgtacggtacccgttaccgttaaccgggttacggtacccgggttaccggtacccgaacgggggttacccaaacgggttacggtaaaacttaccgtaaaacccggtaaccttcgggttacgggaccgttacggacccgtaaccctacgttccgttacggttaccc

SEQ ID NO: 220463 - DNA, 545 bp, Homo sapiens
  misc_feature: GYAE6OF02JDF1X.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggcccactggtatcccagccagggtcagtggcagtgggtctgggacagagttcactctcaccatcagcagcctgcagtctgaagtattttgcttagttttatttctgtcagctattacaatttactggtcccttccgttacggtcggtaccgtttcgggccgtacggggacctaagggtggaaaacgttccgaaaacggtaacgttggtacggtctacggaccaacctagttacctgttcc

SEQ ID NO: 220464 - DNA, 543 bp, Homo sapiens
  misc_feature: GYAE6OF02GPK7X.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttgggtttggggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaactgggtgcgacaggcccctggacaagggcttgagtggatgggatggatcagcgcttacaataataacacacactatgacacagaacgttccagggcagacgtcaccgtgaccacggacacatccacgagcacacgccctacagtggagttggaggagcctagagatctagacgacgacgggcctgtacttacgtgtcgcgagagtacaagtaattagttagttagtacggtacttacggtgggggacctaggggtaccctcggg

SEQ ID NO: 220465 - DNA, 713 bp, Homo sapiens
  misc_feature: GYAE6OF02IB948.38.22.B11.1.454.CMB.1.raw
  modified_base (310)..(310): a, c, t, g, unknown or other
  misc_feature (310)..(310): n is a, c, g, or t
tcagtcgatcacgtcacgaccggtgctcgatttagacgacagctcaggggtacccgaaaaaccaacgaaccctaccgttgggacgaatccccttagatccaccacgacgtccctcaccgacttccggacgtcggaccctggacgccagtccttttccttcggtgggcagcagcaacgacggtgcccactcccaggttcagctggtgcagtctggagcgtgaggtgaagagccgtggggcctcagtgaaggtctccgtgacaaggtcttcgtaggttactacctttacaacttatggtatcaacgtgggtncgacacggcccctggaacaagggtcttggaggtggagtgggagtggatcgagcgacttaacaaataaactaaaccaacactactaatcgactaacgaaggtaaacgttcccgaagggacaaggtacgtaccgaaccggtacggaacccaacgggaaccaacgacgtaccgaacgacgaccaaaccgagaccctaacgagtacgggtaagttacggaacgggacgtccgttaggaacgtaacgtaccgtacggaaccggtaaccgaccggggtacccgttagttaacgtttacgtaggtacggaacgtaagtacgtaaccgaaggttaaactagtttacgttacgtacggtaacgtacgggttacgggaccgtacggaccccggtaggtacccgtaccggtacc

SEQ ID NO: 220466 - DNA, 546 bp, Homo sapiens
  misc_feature: GYAE6OF02G92IH.38.22.B11.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtncatccaccagggccactggtactcccagccagggtcagtggcaggtgggtctgggacagagttcactctcaccatcagcagcctgcagtctgaagtatttgctagtttatttctgtcagtctattactaatttactcggtccttcgttacgtggtaccggtttcgggacccgtagggggtacctaagggtacggaaactaccgaaaacggtaacgttggtaggtctaggacccaaccgtattccgttgttcc

SEQ ID NO: 220467 - DNA, 552 bp, Homo sapiens
  misc_feature: GYAE6OF02HZOMA.38.22.B11.1.454.CMB.1.raw
  modified_base (415)..(415): a, c, t, g, unknown or other
  misc_feature (415)..(415): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttacaactatggtatcaactgggtgcgacacggcccctggacaagggcttgagtggatgggatggatcgagcgtcttaacaataataacacacactatgcacagaagttcaggcagagtcacgtgacacggacacatccagagcacagacctacgatggagttgagganccgtagacgatcgtagaccgacgaccggcgttgtacttacgtggtacgcgagagtacaagtaagtagtttagttagtggtaccgtacggtacggggacccgtaacggggtaaccccgttggtaccgtaccgttaccg

SEQ ID NO: 220468 - DNA, 713 bp, Homo sapiens
  misc_feature: GYAE6OF02HFRRK.38.22.B11.1.454.CMB.1.raw
  modified_base (210)..(210): a, c, t, g, unknown or other
  misc_feature (210)..(210): n is a, c, g, or t
tcagtcgatcacgtcacgaccggtgctcgatttagacgacagctcaggggggaggaactgctcagttaggacccaggacggaaccatgggaagccccagtcgcagcttctcttcctcctgctactctggctcccagactaccactggagaaatagtgatgacgcagtcctccgagcccacccgtgtcgtgtcgtctccgaagggggaaancgcccacccgtctccgtagccgagggccagtcgaggagtgttagcagctaacttgcctggtaccagcaagaacctggccaggcctcccgagggcctccctcacttcgtacgtcggtgccagtcccgaaccggaggggccctaacgttcggtaactccccgagcccggtaggggtccaggtcgggcagggttcgggtacgtaggggaacaggtacgtttcccacgttccgacctaaccgtatccgaacgtcctacggccgtagaccgtacgtcctaggtaacgttacgttttcggacttacgttttacgtttcgtagttacgacgtacttaacgttaaccgtaagtttcccggtacggttacccttacccgttacgggttcgggttacccggttccgggtaccggtaaccggggaccgtaacggggtacggtaaacgttaccgtaaaacggttaccgtagggtacggtaccggtcggaccgtaccgtacgttcgttacgttccg

SEQ ID NO: 220469 - DNA, 712 bp, Homo sapiens
  misc_feature: GYAE6OF02F3488.38.22.B11.1.454.CMB.1.raw
  modified_base (202)..(202): a, c, t, g, unknown or other
  misc_feature (202)..(202): n is a, c, g, or t
tcagtcgatcacgtcacgaccggtgctcgatttagacgacagctcagggggtagggaactgctcagttaggacccagacggaaccatggaagccccagcgcagcttcgtccttcctcctgctactctggctcccagatacactggagaaatacgtgatgacgcagtctccagccaccctgtctgtgtctccgaggggaaacngccaccctctcctgcagggccagtcagagtgtagcagcaacgttagccgtggtaccagacaacgaaacctggacctaggcctacccgaggcctcctacaacttaccgtaagtcggtcgacctaactcccgaccgtacgggaccctaacgtacggtacctccccgagtacccgtagggtcctaggtcggactagggtcgggtacgtcgggactaggtacgttccacgttcgacgtaccgtagtcgacggcgacgtcctcggcctagtcgtaacgtaagttcttttcgacgttacgttttacttcgtacgttactaacgtacttaatttaccgtaagttttaccgtaccggttacccttaccgtttaacgggtacggttaaaccggtttaccgggacccgtaacggggtacccgtaaaggggtaccggtaaaccgttaacgtaaaaccgggttaaccgttagggtacggtaccgtacggaaccgtaaccgtacgttaccgtacgttaacccg

SEQ ID NO: 220470 - DNA, 579 bp, Homo sapiens
  misc_feature: GYAE6OF02IEPXV.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccagtcagagtgtagcagcaaacttgcctggtaccagcagaaacctggccaggctcccaggctcctctatctatcggtgcaatccaccagggcccaacgtggtactcccagccgagggtcagtggcaggtggtctgggacagtacgttcgactctcgaaccagtcaagcaggcctgctaggtctagtaacgtattttgacttaagttttctttctcgttcgaacgctatttaacgtaaatttacgtgtcccctacgttaggtcggtaacttccgggtcgacggggaccctaagggtaacggtaaacgtacgaaaacggtaacgtacgtggtacgacggtccaccggtaactcgtagtttcc

SEQ ID NO: 220471 - DNA, 557 bp, Homo sapiens
  misc_feature: GYAE6OF02GQ6R1.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaacctggccaggctcccaggctcctcatctatggtgcatccaccgagggcccacgtggtactcccagccgagggtcaggtcggctaggtgggtctgggacaggtacgttcactctacaccatcacgcagcctgcagtctgaagtattttgcttagttttactttcgtgttcagtctatttactaacttacgtcgtcctccgttacgtcggtacgttcggaccgtagggtaccgtaaggtacggaaacgtaccgaaacggtacgtagtcggtacgtcggacctaccgtacgttcgtgttacc

SEQ ID NO: 220472 - DNA, 705 bp, Homo sapiens
  misc_feature: GYAE6OF02JZWRQ.38.22.B11.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
tcagtcgatcacgtcacgaccggtgctcgatttagacgacagctcaggggaggaacgtgctcagttaggacccagacggaaccatggaagccccagcgcagcttctcttcctctgctactctggctcccagataccactggagaaatagtgatgacgcagtctccagccaccctgtcctgtgtctccaggggaaangccacctctccgtgcgtagggccagtcagagtgttacgcaggacaacgttgcctggaccngcagaaacctggccaggctacccgaggcctccgtcagttccagtcgggtancaacttcccaaccgagggtaccccagttgggtacctccccgagtcccgaaggggttcacggttcgaccgtaggtcgggtctaggggaccaggtacgtttccaacggttctaccgaactgtactacggcgacggtacctcggaccgtagtctaggtaacgttatttacgcgtttaaggttttaccttacgttcgttaccgtaggtactttaaagttaacttaacgtttaccggtcggttaaccttccggttaacgttcggttaaccgtttccgggtaaccggtacggggtaacccggttaaggtaaccgggtaaacgtttaaccggaaacgttaaccggttacggttcgggtaaccgtttcgggaacccttaacggtaacgttccgttaacggtttacc

SEQ ID NO: 220473 - DNA, 543 bp, Homo sapiens
  misc_feature: GYAE6OF02IOMDB.38.22.B11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagcagcaacttgcctggtaccagcagaacctggccaggctcccaggctcctcatctatggtgcatccaccgagggcccaactggtatcccagcccagggtccaggtggcaggtcgggtctgggacaggtagttcactctcaccatcacgcagcctgcagtctagtaagtattttgcttagttttactttctgtctagtctattactaatttactggtcccttcgtacgttcggacggttcgaccgtagggaccaagggtacggaaactacgaaacgtaacgtggtacggtcgtcgaccacctacgttctgttcc

SEQ ID NO: 220474 - DNA, 529 bp, Homo sapiens
  misc_feature: GYAE6OF02GAKON.38.22.B11.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (525)..(525): a, c, t, g, unknown or other
  misc_feature (525)..(525): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctccncatctatggtgcatccaccgagggcccacgtcggtactcccagccagggtcaggtggcaggtgggtctgggacagtagttcactctcaccatcagcagcctgcagtctagaagtattttgcttagttttatttctgtcagtctattactaattactcggtccttcgtacgtcgacgttcggcgacggggaccaagggtacggaaactacgaaacgtacgtggtacggctgaccactactctnttac

SEQ ID NO: 220475 - DNA, 612 bp, Homo sapiens
  misc_feature: GYAE6OF02G8QWG.38.22.B11.1.454.CMB.1.raw
  modified_base (272)..(272): a, c, t, g, unknown or other
  misc_feature (272)..(272): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtncgacaggcccctggacaagggcttgagtggatgggatggatcgagcgactaacaataataacacacactatcgacacagaacgttccgagggcagagtcgaccgtgaccgacggaacacactcccgaacggagaccacgagtactaacaagtcggagttaggaggacgtccgtaggacgattcgtaggaaccggacgaccgggtccgttagttaactttacgtgtacggcggtaagtacgtacgaaggtaagtttaagttaggtttaagtacgggtaaccttacgggtacgggggtaccgtacggggtaaccccgttcgggttacctaacccggttcccg

SEQ ID NO: 220476 - DNA, 562 bp, Homo sapiens
  misc_feature: GYAE6OF02HQRQB.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcaagaaacctggccaggctccgaggcctctcatctagtggtcgcactccaccgagggcccacgtggtactcccgagccgagggtcaggtggcaggtgggtcgtgggacagtacgttcactctcactatcagcagcctgctagtctagtaagtattttgacttagttttacttcgtgtactagtacttaattaactaatttcgtcggtccttaccgtacgttcgggtacgttccggacgacgggtacctaagggtacggaaactacgtaaacgtacgttggtacgtctacggaccacgtactcgtctcc

SEQ ID NO: 220477 - DNA, 566 bp, Homo sapiens
  misc_feature: GYAE6OF02GAC85.38.22.B11.1.454.CMB.1.raw
  modified_base (197)..(197): a, c, t, g, unknown or other
  misc_feature (197)..(197): n is a, c, g, or t
  modified_base (403)..(403): a, c, t, g, unknown or other
  misc_feature (403)..(403): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaacctggccaggctcccaggcctcctcatctatggtgcatccaccgagggccactggtactcccgagccagggtcaggtggctaggtcgggtctaggggacaggagttcactctacaccatcagcagcctgcagtctagtaagtnttttgcttagttttactttctgtcagtctaatttaacaacgtttacgtcggtacccttccgttacgttcggtaccggtttccggacgtacggggtaccaagggtacggaaacttacgaaacggtacgtcggtacggcgtacgacctaccgtattccgtgttcc

SEQ ID NO: 220478 - DNA, 547 bp, Homo sapiens
  misc_feature: GYAE6OF02HO2BX.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtatcccagccagggtcagtggcagtgggtctgggacagagttcactctcaccatcagcagcctgcagtctgaagtattttgcttagttttatttcttgtcagtctattaacaatttactggtcccttaccttacgtggtaccgttcgggaccgaggggtacccgaagggtacggtaaactaccgtaaacgaaccttggtaggtacctaggaccaaccgtacttaccgtgttccg

SEQ ID NO: 220479 - DNA, 573 bp, Homo sapiens
  misc_feature: GYAE6OF02IZ9HM.38.22.B11.1.454.CMB.1.raw
  modified_base (197)..(197): a, c, t, g, unknown or other
  misc_feature (197)..(197): n is a, c, g, or t
  modified_base (441)..(441): a, c, t, g, unknown or other
  misc_feature (441)..(441): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaattagcctggtaccagcaagaaacctggacccaggcctacccgaggcctcctcaatcctaagtcggtgcaactcccaaccgagggcccaacgtcgggtaactccccgaggacccaaggggtccaaggtcggacgaggtggggtctaggggacaggagtttaccacgttcctacaccatcgagtcagcctgcagtctgaaagtnttttggctagttttattctgtcagctattacaattcgcgtcctaccgtagtgtaccgttcggaccgtagggacctaagggtagaaactcgaaaacggtactggtacgactggaccctaacgtattctgttac

SEQ ID NO: 220480 - DNA, 804 bp, Homo sapiens
  misc_feature: GYAE6OF02H6RWV.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagccacctgtctgtgtctcgaaggggaaanacgccacctctcctgcgagggccagtcagagttgttagcagacaacttgcctaggtaccagacaagaaacctggaccaggcctcccgaggccttcctacatccttaagttgggtacgccactacccgaaccgacggggcccaacgttacggtaactccccgaaggtcccgtaaggggtcctaaggtcgggactagggttcggggtcgtagggggaactaagggtacgtttaccaaccgttcctaccgaaacctaagttaccgaacggacccgtaacggtcccgttacggaccgtaacggttccgtaaggtaaacggttaacgttttttacgggtaacgttttaagttttttaacgttttcgtttacgttacgtaacggtaccttaaacgtttaaacttaaacgttttaccgtttaccggtaccccgtttacccggttaaccgggtttacgggtaaccgggtttaccggggacccgggtaaaccggggggtaaccggtaaacgggggttaacggtaaaaacggttaacccggtaaaaaccggttaaccggttacgggtacggtacgttacggtaacccgtaacccggtaacttccgttacgtttaccg

SEQ ID NO: 220481 - DNA, 734 bp, Homo sapiens
  misc_feature: GYAE6OF02HKF4D.38.22.B11.1.454.CMB.1.raw
  modified_base (309)..(309): a, c, t, g, unknown or other
  misc_feature (309)..(309): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtcctgtcgtctccgaggggaaacagcccaccctctcctgcagggccagtcagagtgtagcagcaacttgcctggtaccagcaacgaaccgtggaccaggcctcccgaggcctcctcattcctagtcgggtcnctactcccgaaccgcgggaccctacgttcggtactccccgagcccgaggggtccaggtcgggacgtagggttcgggtacgtaggggactaggtacgttccaccgttcctaccgaacctatccgaacgtccagcccgtcggactacggttctagggtaacgttagtttttacggtccgttttaaaggtttttctttaccgtttagtaccgtactaaccgtttaatttaaaccttaacgttttaccgtcccgttacccgtttacccgttaacgggttccgggttaacccggttccggggtacccggttaacggggggaacccttaaagggggttacgggtaaaccttaaccgggtaaaaccggttaaccggttacggtaccggtacgttaccggacccgtaaccgttcgttaccgttacgttacccg

SEQ ID NO: 220482 - DNA, 535 bp, Homo sapiens
  misc_feature: GYAE6OF02IX2CX.38.22.B11.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (389)..(389): a, c, t, g, unknown or other
  misc_feature (389)..(389): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaacctggccaggctcccaggcttccncatctatggtgcatccaccagggccactggtactcccagccagggtcagtgcagtggtctgggacagattcactctcaccatcagcagcctgctagtctgaagtnttttgacttagttttattcgtagttcagtctagtttactaattacgtcgtccttacgtacgttggtaccgttcggacgtacgggtacaaggtaggaaactacgaaacgtacgttacgtggtactcggccacgtacttcgtgttacc

SEQ ID NO: 220483 - DNA, 537 bp, Homo sapiens
  misc_feature: GYAE6OF02IB12D.38.22.B11.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (400)..(400): a, c, t, g, unknown or other
  misc_feature (400)..(400): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaangcccaccctctcctgcagggccagtcagagtgttagcagcaacttgcctggtaccagcagaaacctggccaggctcccaggctcctnatctatggtncactccaccngggccacgtggtactcccagccgagggtcaggtggcaggtggggtctgggacaggtacgttcactctcaccatcagcagcctgcagtctagaagtnttttgcttagttttatttctgtctagtctattactaattactcgtccttccgttacgtggtacgttccggacgagggaccgaagggtaggaaactacgaaacgtacctggtacggctcggaccacctatccgtgtcc

SEQ ID NO: 220484 - DNA, 548 bp, Homo sapiens
  misc_feature: GYAE6OF02JGJB9.38.22.B11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagtcaccctntcctgcagggccagtcagagtgttagcagcaacttagcctggtaccagcagaacctggccaggctcccaggctcctcatctatggtgcatccaccgagggccactggtactcccagccagggtcagtggcaggtggtctgggacngagttcactctcacatcacgcacgcctgcagtctgaagtatttgcttagtttatttcgtgttcacgtctattactaacttacgtcgtccttaccgttacgtcggtaccgttccgggccgtaacggggtaccgaagggtaggaaactaccgaaacggtaacgtggtcggacgttcgacctaccgtacttctagttacc

SEQ ID NO: 220485 - DNA, 555 bp, Homo sapiens
  misc_feature: GYAE6OF02GFRXE.38.22.B11.1.454.CMB.1.raw
  modified_base (197)..(197): a, c, t, g, unknown or other
  misc_feature (197)..(197): n is a, c, g, or t
  modified_base (393)..(393): a, c, t, g, unknown or other
  misc_feature (393)..(393): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctcgtctgtgtctccaggggaaangccaccctctcctgcagggccagtcagagtgttagcagcaacttagcctggtaccagcagaaacctggccaggctcccaggctcctcatctatggtgcatccaccagggccacgtggtactcccagccagggtcaggtggcaggtgggtctgggacagagttcactctcaccatcagcagcctgcagtctgaagtntttgcttagtttatttctgtcagtctattaactaattactcggtccttaccgtacggttcggtaccggttcggaccgtacggggaccaagggtacggtaaacgtaccgaaaacggtaacgtcggttacggactacggaccaccgtacgttacgttcgttacc

SEQ ID NO: 220486 - DNA, 586 bp, Homo sapiens
  misc_feature: GYAE6OF02FHWTO.38.22.B11.1.454.CMB.1.raw
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcagcaacttagcctggtaccagcaagaaacctggaccaggcctcccaggcctcctcatctatggtcgcatcccaccgagggcccatggtactccccaggccgagggtcaggtggcaggtgggtcngggacaggagttcactcacaccancagcacgcctgctagtctaggtaagttatttgcttagtttcttttctgttcagtcttaattaactaatttaccgtcgtcccttacgttaaccggtcggtaaccggtttccgggaccgtaacgggggacctaagggtagggtaaaactccgaaaacggtaacgttggtacgggtactccggacctaaccgtacttcgttcggttacc

SEQ ID NO: 220487 - DNA, 543 bp, Homo sapiens
  misc_feature: GYAE6OF02HR30K.38.22.B11.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcagcaacttgcctggtaccagcaagaaacctggccaggcctcccgaggcctcctcattctagtggtgctatccaccgngggccacgtggtactcccagccgagggtcaggtcggcgtaggtcgggtctgggacagggtcttcactctcacctatcagcagcctgcagtctagaatatttgcttagttttnttctgtcngtctattactattctcgccttcgtacgtcggtacgttcggacgtacggggacctaagggtacggaaactaccgaaacgtacgtaggtgtactcggaccacctagtctgttcc

SEQ ID NO: 220488 - DNA, 647 bp, Homo sapiens
  misc_feature: GYAE6OF02GH5LO.38.22.B11.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
tcagtcgatcacgtcacgaccggtgctcgatttagacgacagctcaggggaggaacgtgctcagttaggacccagacggaaccgatggaagcccagcgcagctctcttcctctgctactctgctccagactaccactggagaatagtgatgacgcagtctccagccaccctgtcctgtcgtctaccgagggaanacgtcaaccctctacctgcacgggtccagtcacgngttctagcagccgaattagcctggtaccnggcagaacctgaccagcctaccacggtctcctcgactcgttacgnggttcgctaactcccacacgggccacgtcggtaatcccgacgccacgggttcacggtaggctaacggtggtccttcgggganaacggtcgttaccgcttacggccactacgcacgacncggactcgagtcgtacgtcgaacgtntttacgacttaacgtttcgtttattcgtacgtagtacgtactttaacgtaattaccgttacgttcccttacgttaccggttacgttaccgttaacggttccggaccgggttactaacccggggtaaggttaacgtaaaccgtaacgtaaaccggttcgtaaccgggttcgtaccgaccgtacggactacggttagtaccc

SEQ ID NO: 220489 - DNA, 586 bp, Homo sapiens
  misc_feature: GYAE6OF02GF48Q.38.22.B11.1.454.CMB.1.raw
  modified_base (406)..(406): a, c, t, g, unknown or other
  misc_feature (406)..(406): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggctccaggtctcctcatctatggtgcatccacagggcccacgtggtactcccgagccgagggtcaggtggcaggtgggtctgggactaggacgttcactcgtacaccatcgagcacgcctgctagtctaggaagttnttttgacttagttttatttcgttgtacgatcttattacctaagttcgtacgtccttaccgttacgttcggtaccgttccgggacgtaacggggtaccgtaagggtaaggtaaacgttaccgaaacggttacctagggtacggtaccgtacggtacccaaccgtacttccgtagttacccg

SEQ ID NO: 220490 - DNA, 759 bp, Homo sapiens
  misc_feature: GYAE6OF02IZUX4.38.22.B11.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcagaacctggccaggcctcccgaggcctcctcatctagtggtncactccaccagggccacgtcggtactcccgaggcccgagggtcaggtggcgtagggtcgggtcgtggggactaggtacgtttcacttcctaccacctataccgagtccacggcccttggaccgtacggttacctaggtaaacgttacgtttttcgaccgtttagtttttactttcgttacggttacctaacggttaccttaactttaaaccgttaaacgttttaccgtcgggttacccctttacccgttaaccgggtttaccggggttaacccggtttacccggggaaccccgggttaaacggggggttaaccccgtaaaacggggggtttaaccgggtaaaaaccgtttaaacccgggtaaaaaccgggttaacccggtttacggggttaaccgggtacccggttaaccgggtaacccgtaacccggtttacgttttacccggttacgggttttaaccccc

SEQ ID NO: 220491 - DNA, 711 bp, Homo sapiens
  misc_feature: GYAE6OF02JYRJJ.38.22.B11.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
tcagtcgatcacgtcacgaccggtgctcgatttagacgacagctcaggggaggaacgtgctcagttaggaccagacggaaccatggaagcccagcgcagcttctcttcctcctgctactctggctcccagactaccactggaanaatagtgaatgacgcagtctccagccaccctgtctgtcgtctccgaggggaaanacgccaccctctcctgcagggccagtcagtagtcgttagcagcaacgttagcccttggtaccagcgaacgaaaccgtcggaccagggcctcccagggtcctccgtcacgttacctagtcgggttcacgtactccccaacgtacggggaccctacgtgggtaaccctcccgagtacccgagggttaccaggtacggcgtaaggtcggggttcgacgggacaacggtacgttctacgtaccgtcaaccgagttcccgagaccgacgtcgacggtaccagtacgtagaacgttcgttttacggattacgtttttaacttcgttacgtactacggtacttagtttaaccttaacggtttacctacgggtaccttacccggtttaacgtccgggtaaacgtttccgggaaccgtttaccggggaaaccgtaggggtaacccgttaaagtaaccgtaaacgtaaaccggttgtacgggtaaccgggttcaacccgaccggttattaccggttacgttcg

SEQ ID NO: 220492 - DNA, 546 bp, Homo sapiens
  misc_feature: GYAE6OF02GEBZN.38.22.B11.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcagcaacttagcctggtaccagcaagaaacctggccaggctcccgaggctcctnatctatggtgcactcccaccgagggcccacgtggtactcccagccgagggtcaggtcggcaggtcgggtctgggacaggtacgttcactctcacccatccagcacgcctgcagtctagtaagtgttttcgcttaagttttctttcgtgtctagtctattactaattcgtcgcctcgtacgtgtacgttcgacgacgggtacaagggtacgaaactcgaaacgacgttggtcgtcgtacgccgactacgtctggttacc

SEQ ID NO: 220493 - DNA, 663 bp, Homo sapiens
  misc_feature: GYAE6OF02H0LPQ.38.22.B11.1.454.CMB.1.raw
  modified_base (199)..(199): a, c, t, g, unknown or other
  misc_feature (199)..(199): n is a, c, g, or t
  modified_base (490)..(490): a, c, t, g, unknown or other
  misc_feature (490)..(490): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgcccaccctctcctgcgagggccaggtcagagtgttagcagcaacttgcctggtaccagcaacgaaccgtggccaggcctacccgaggcctccctcacttcctagttcgggtcgtactactcccgaaccggacggggcccctaacgtcgggtacctccccgaacggtcccggtaaggggtccaacggtcgggtccgtaggggttcggggtcgtaggggaacctagggtacgtttccaccgttcctaccaaccgtactcgagccgacgccgtgcagttcgtagtaacgttnttttcgcgtttagttttactttcgtgtactagtacttaattaacctaacgtttacgtcggtacccttaccgttacgttcgggtaccgttccgggaccgtacggggacctaagggtaccgaaagtaccgtaaacgtaacgttcgacgtcgtacgactacctagttcctgttacc

SEQ ID NO: 220494 - DNA, 548 bp, Homo sapiens
  misc_feature: GYAE6OF02GEU1F.38.22.B11.1.454.CMB.1.raw
  modified_base (484)..(484): a, c, t, g, unknown or other
  misc_feature (484)..(484): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaacgtgggtgcgacacggcccctggacaagggcttggagtggagtgggatggatcagcgcttaacaataataacacacactatgcacagaagttccgagggcagacgtcaccgtgaccgacggacacatccacgacgcacacgacctacagtaggagttaggaggacgcctagagtatcgtagacgacgacggcgtagtattacgngtgacgagagtacgagtaatattgtagtacgtacgtacggtcgggaccgacgggtaccctcggg

SEQ ID NO: 220495 - DNA, 587 bp, Homo sapiens
  misc_feature: GYAE6OF02HS25Y.38.22.B11.1.454.CMB.1.raw
  modified_base (294)..(294): a, c, t, g, unknown or other
  misc_feature (294)..(294): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtncactccaccgacgggccacgtggtactccccaggcccgagggtcaggtcgggcaggtggggtctggggacaggtagttcactctacaccatcagcagcctgctagtctagaagttattttgcttagttttattcgtgtacagtactatttaactaatttaccgcgttaccttccgttacgttcgggtacgttccgggaccggtacggggtaccgtaagggtacggaaacgttaacgaaaaccggtaacgttcggtacggtacgtcggacctaccgtacttccgttgttacccg

SEQ ID NO: 220496 - DNA, 708 bp, Homo sapiens
  misc_feature: GYAE6OF02JUXIE.38.22.B11.1.454.CMB.1.raw
  modified_base (286)..(286): a, c, t, g, unknown or other
  misc_feature (286)..(286): n is a, c, g, or t
tcagtcgatcacgtcacgaccggtgctcgatttagacgacagctcagggtcttcgtggctcacgtccaccaccacgcatgtgacctcagggtccgggagatcatgaggtgtccttgggttttggggggaagaggaagactgacggtccccccagcagcaacaggtgcccactcccaggttcagctggtgcagtctggagctgaggtgaagagccgtgggcctcagtgaaggtctctgcaaggcttcgtggttacacctttaccaacttatggtatcgaagtgggtncggacacggcccctgggacaaggggcttggagtggaatggggatggatcgacggcgtctttaacaaattaaactaacgaaccactacttaagtgccaacgtaaggaacgtttcccgaaggggcaaggtacgtaccctaaccgggtgaacccgaacgggaaccacgtaaactcccgaaaccggacgacaacccgtagacccttaacgacggtagggtagtttaggaacgggtacgccgttaggaacgtagttacctacggaaccgaaccgtaccgggtacccgttagggttaaactttaaccgtggttaccggacggtaacggtacggtaaaccggtaaggttaaacttaacggttttaagttaagttacgggttaacgtaccgggtttaggggacccggttaaccggggaacccggttcggg

SEQ ID NO: 220497 - DNA, 708 bp, Homo sapiens
  misc_feature: GYAE6OF02JVVSR.38.22.B11.1.454.CMB.1.raw
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagtcgatcacgtcacgaccggtgctcgatttagacgacagctcaggggaggaacgtgctcgagttaggacccagacggaaccatggaagcccagcgcagcttctcttcctcctgctactctggctacccagactaccactggagaaatagtgatgacgcagtctccagcccaccctgtcctgtgtctaccgaggggaacacggcccaccctcgtaccctggaccaggggcccaaggttccgaagtaggttcgttaacgccgaaacggcctaaaacttttcgccccgttagggttaacccctaggccaaacggaaaaacccttcgggacccaaggggtccctaaccccgacgggtcctcccggtactacggtacccttagtcggttcgacctacgttacccgaacgccgggtcccaacggtcggttaactccccggaacgtccgaagggttccgaggttggcctaggtcgggtacgtggacgagtacgtcctacgtcgtaccaactntccgagcgtacncgtgacctagtcgtcgtagtactttgacgttagtttcttcgtgtacctagtcctattacgtaacttactccgtaccttacgttaaccgtggttaaccgtcgggtaccgtacggtacgagggtacggtaacttaccgaaacgtacgtcgtaaggtaccgttagacccgttacgtctaccttaggttacc

SEQ ID NO: 220498 - DNA, 597 bp, Homo sapiens
  misc_feature: GYAE6OF02GN3BI.38.22.B11.1.454.CMB.1.raw
  modified_base (196)..(196): a, c, t, g, unknown or other
  misc_feature (196)..(196): n is a, c, g, or t
  modified_base (406)..(406): a, c, t, g, unknown or other
  misc_feature (406)..(406): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaacctggccaggctcccaggcctcctcatctagtggtgcatcccaccgagggcccacgtggtactccccgagcccgagggtcaggtggcaggtgggtctgggacaggtagttcactctcacctatcagcagcctgctagtctagtaagtntttgcttagttttatttcgtgttacagtacttaattaactaagtttccgtcggtacccttaccgttacggttcgggtaccggtttccgggacccggtaacggggtaccgtaagggtacggtaaacgtaccgaaaacggtaaccgttacggtacggtaccgtacggacctacccgtagttccgttagttacc

SEQ ID NO: 220499 - DNA, 628 bp, Homo sapiens
  misc_feature: GYAE6OF02HLOZ8.38.22.B11.1.454.CMB.1.raw
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcgagtgaaggtctcctgcaaggcttctggttacacctttaccaactatgtatcaactggtncgacncggcccctggacaagggcttgagtggagtgggatggatcgagcgtacttacgaataataacacactactagtcgacaacagaacgttccgaggcagagtcaccgtcgaccacggacacgactccgacacgccacgacgacctacgagtaggagttggaacggacgtaccgttaggaacgtacgtccgtaggaacccgaaccggaccgggtccgtacgttaacgtttaccgtcggtacggtacggagtacggtacgaaggttaaacgttagttaggtttaagtacggtaaccgttaacggtccggggacccgtaacggggtaccccgttagggtacccctacccggttacccg

SEQ ID NO: 220500 - DNA, 747 bp, Homo sapiens
  misc_feature: GYAE6OF02HIX6L.38.22.B11.1.454.CMB.1.raw
  modified_base (390)..(390): a, c, t, g, unknown or other
  misc_feature (390)..(390): n is a, c, g, or t
tcagtcgatcacgtcacgaccggtgctcgatttagacgacagctcgagggtcttcgtggctcacgtccaccaccacgcatgtgacctcaggggtccggagatcatgagggtgtccttgggttttgggggaagaggaagacgtgacggtccccccagcgagcaacaggtgcccactcccaggttcagctggtgcagtctggagctgaggtgaagaagccgtggggcctcgagtgaggtctcgtgcaaggtcttcgtggttactacctttaccaactatggtatcaacgtgggtgcgacacggccctaggacgaagggtcttggaggtggagtgggataggatcgagcgacttaacgaaataaagtaacacgtaaccaactagtcgaacaanaagtaaacgttcccgagggtaccaaggacgtaccgtaaccggtacgaacccgtaaccggaacacgtaactacccgaaggtaacgactaacgaaccgtaccaaccgtaaggttacgggtaagttacggaacgggacgtacccggtaggtaacgtaccgttacgtaaccggaaccgtaaaccggtaccgggtacccgtttacggtttaaacgtttaccgtaggtacgggtacggaaacgggttactaaacgggtaaagtttaaacgtttaacggttttaagtttaacggttacgggtaaccgttaccggggttaaccggggggtaacccgtaaacccggggtacccggtttaaccgggg

SEQ ID NO: 220501 - DNA, 583 bp, Homo sapiens
  misc_feature: GYAE6OF02GYUUQ.38.22.B11.1.454.CMB.1.raw
  modified_base (197)..(197): a, c, t, g, unknown or other
  misc_feature (197)..(197): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggcctcccaggcctcctacatctatggtgacactcccaccgagggcccacgtcggtactcccgagccgagggtcaggtcggctaggtcgggtctgggacagtagttcactctcacctatcagcagcctgcagtcagaagtntttgcttagttttattcgtntactagtcttaattactaacttcgcgtccttaccgtacgtcggtacgttacggaccgtaaggggtaccgtaggtaacggaaacgttaaccgaaaacggtacggttagggtaccggtacgtacggaccctaaccgtacgttaccgttgttaccc

SEQ ID NO: 220502 - DNA, 734 bp, Homo sapiens
  misc_feature: GYAE6OF02HKEUC.38.22.B11.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaancgcccaccctctcctgcagggccaggtcagngtgttagcagctaattgcctggtaccagcaagaaacctggccaggcctcccgaggcctcctcatctatggtcnccactcccaccgagggccagttggtactcccagccgtagggtcaggtcggacgtaggttcggggtcgtggggactaaggttacgtttcccgacttccgtaccgaaccacgtaccaacgtccacggtcccgttcggaccgtaacggttccgttaggttaaacggtttacgtttttacggaccgttttaaggttttttacttttaccgttaggttacctaacgtacctttaaagtttaacccttaaagttttacccggtccgggttaccccttaccggtttaaccgggttccggggttacccggtttacccgggacccgggtaacggggaccggtaaagggttacggaaaacggttaacccggaaacggttaacggttacggtaccgggtacgttacccggaccgtaacccgttacggttaccgttccgtttacg

SEQ ID NO: 220503 - DNA, 612 bp, Homo sapiens
  misc_feature: GYAE6OF02GKSRZ.38.22.B11.1.454.CMB.1.raw
  modified_base (456)..(456): a, c, t, g, unknown or other
  misc_feature (456)..(456): n is a, c, g, or t
  modified_base (481)..(481): a, c, t, g, unknown or other
  misc_feature (481)..(481): n is a, c, g, or t
tcagtcgatcacgtcacgaccggtgctcgatttagacgacagctcagggggaggaactgctcagttaggacccagacggaaccatggaagccccagcgcagcttctcttcctcctgctactctcggctcccagataccactggaagaaatagtgatgacgcagtctccagccaccctgtctgtgtctccgaggggaaagagccaccctctcctgcgacgggccagtcagagtgttagcgagcaacttagcctggtaaccagacaagaaaccgtggaccaggcctcccgaggcctcctacatctagtggtgaccatcccgacgagggccctagtggtactccccgaggacccgtaggggtctacggtggacgtaggtcgggtactgggaactaggtacgttcacctcgtaccaaccactacgacgtccacggcctggactagtctaggtaaacgttnttttcgacttaggttttactttcgngtaccgatcctaattaacaagtttcgtcggtcccttacgttacgtcggtacgtcggacggtacggaccgaaggtaacgaagtaaccaaacgtacgtaggtcgacgtacgaccacgtacttcgtacttaccg

SEQ ID NO: 220504 - DNA, 612 bp, Homo sapiens
  misc_feature: GYAE6OF02H8YL9.38.22.B11.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgttagcagcaacttacgcctggtaccagcaagaaacctggaccaggcctcccgaggcctcctcatcctagtggtncactccaccgagggcctagtcggtactcccagccgagggtcaggtggcgaggtgggtctgggacaggtcgttcactctaccgactatcagcacgcctgcagtcgtagtaacgttattttgacctttaagtttttactttcgtgttcacgtacttaactttaactaatttccgtacggttcccttaccgttaacggtccgggtacgttcccgggacgtaacggggtaccgtaagggtacggtaaactaacggaaaccggtaacgttcggtaggtcctacggaccctaaccgtacgttcccgtagtttccc

SEQ ID NO: 220505 - DNA, 581 bp, Homo sapiens
  misc_feature: GYAE6OF02I2ERP.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcagcaacttgcctggtaccagcagaaacctggccaggcctccccaggcctccctcacttctagtggtcgcactccgaccgacgggccacgtcggtactcccgagcccgagggtccaggtcggcaggtgggtctgggacagtagttcactctcaccatcagcagcctggcagttcagtaagttagtttcgacgttagttttactttcgtacgttctacgtcttaattactaactttacgtcggtccctccgttacgtcgggtaccggttccgggacgtacggggacaagggtacggtaaactacgaaacgtacgtgtaggtcgtacgaccgtacctatcgttcgttacc

SEQ ID NO: 220506 - DNA, 632 bp, Homo sapiens
  misc_feature: GYAE6OF02HFV33.38.22.B11.1.454.CMB.1.raw
  modified_base (197)..(197): a, c, t, g, unknown or other
  misc_feature (197)..(197): n is a, c, g, or t
  modified_base (376)..(376): a, c, t, g, unknown or other
  misc_feature (376)..(376): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcagcaacttgcctaggtaccagcaacgaaacctggaccacggcctcccgaggcctcctcactctagtgggtcacctactcccaaccgacgggccctacgtcggtactcccgagccgagggtcaggtggctagggtcgggtcgngggacaggtcgttacacgttcaccgaacctagtcgaacggccaacgcccgtaggcctagttccgtaaggtaactttgttttacgctttaagtttttatttccgttgtacagtccttaatttaactaacgtttccgtcgtcccttaccggttaacggttcggtaacccgttcgggaccggtaacggggtactaaggggtacgtaaactacgaaacgtacgttggtacgtcgtacgacctaacctgttctagttaccg

SEQ ID NO: 220507 - DNA, 578 bp, Homo sapiens
  misc_feature: GYAE6OF02FUDU1.38.22.B11.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttgcctggtaccagcagaaacctggccaggcctcccaggctcctcatctatggtncactccacgagggcccagtggtacncccagccagggtcaggtgcaggtggtcngggacaggtacttcactctacacctatcagcagcctgctagtctagtaatntttcgattaagtttntttcgtgtactagtctaagtttacaagtttaccgtcggtacccttcgttaacggtcggtaccggttccgggaccgtaaggggtaccctaagggtacggtaaactaccgtaaaacggtacgttagggtacggtacgtcgacccgtaacctacgttccgttgttccg

SEQ ID NO: 220508 - DNA, 811 bp, Homo sapiens
  misc_feature: GYAE6OF02JLOQP.38.22.B11.1.454.CMB.1.raw
tcagtcgatcacgtcacgaccggtgctcgatttagacgacagctcagggtcttcgtggctcacgtccaccaccacgcatgtgacctcaggggtccgggagagtcatgagggtgtccgttggggttttggggggaaggaggaagacgtgacggtcccccagcagcaacaggtgcccactcccaggttcagctggtgcagtctggagctgaggtgaagaagccgtggggcctgagtgaaggtctcctgcaaggcttcgtggttacctacctttaccaacttatggtatcaacgtgggtgcgacgaggccccctggacaagggcttggagtggatggggatgggattcgaggtccgtacgttaacaaagttaaataaaccgactaacctaaacgttaattacggaccaaccgtaaggtaaaaccggtttcccgaaagggggaccctaaagggtacgggttacccgaaacccggtttcggaaaccccggaaccgggtaaccgtaaacccaacgttaaccccgaaccgggtaacgaacccgaacgaacggtaacccccttaaccgaaagttccgggggtaaaggtttacgggaacggggtaaccgtacccggttacgggaaggtaaaccgttccgttaaccgggaaccgtaaacccgggaccggggtacccgtttaaggttaaacctttaaccggttaggttccggacggtaaggaacggttttaaacccgaagtaaacggttaagttttaccggttaagtacgggtaaccttaccgggaccggggttacccgaaccgggggtaacccttacgggg

SEQ ID NO: 220509 - DNA, 662 bp, Homo sapiens
  misc_feature: GYAE6OF02F9BP8.38.22.B11.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagccgtggtaccagcaagaaacctggccaggcctccccgaggcctcctcatctagtggtcncactcccaccgagggcccagtcggtactcccgagccgagggtcaggtggctaggtcgggtctgggacaggtacgttccacttccgtccaccctatccgaagccgacgcccgtaggcctacgttacgtaggtaaacgttagttttcgtactttaagtttttactttccgtgttcgtacgtcttaaactttaacctaactttccgtcggtcccttaccgttacggttcgggtacccggtttaccgggacccggtaacgggggtacccgtaagggttacgggtaaaactaaccggtaaaaccggtaacggttcggtaaccggtccggttacgtacccgtaaccgtacgttccgttacgttccg

SEQ ID NO: 220510 - DNA, 607 bp, Homo sapiens
  misc_feature: GYAE6OF02IH1S7.38.22.B11.1.454.CMB.1.raw
tcagtcgatcacgtcacgaccggtgctcgatttagacgacagctcagggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttcgtggttacacctttaccaactatggtatcaactgggtgcgacaggcccctggacaagggcttgaggtggagtgggatggatcgagcgcttaacaataataacacactactatcgacaagagaagttccgaggcaagacgtcacgtcgaccacggacacatccacgagcacacgcctacgagtaggaggttaggaggacgccgtaggacgtatccgtaggaccgaaccggacggccggttagtacgttacgtggtcggacgagtagtacaagtaacttagttacggtttaacgtcgggtaacttaacgggtacggggtacccggtaaacggggttacccccggtacgggttacccgtacccggttaccccg

SEQ ID NO: 220511 - DNA, 627 bp, Homo sapiens
  misc_feature: GYAE6OF02IJO1F.38.22.B11.1.454.CMB.1.raw
  modified_base (507)..(507): a, c, t, g, unknown or other
  misc_feature (507)..(507): n is a, c, g, or t
tcagtcgatcacgtcacgaccggtgctcgatttagacgacagctcagggtcttcgtggctcacgtccaccaccacgcatgtgacctcaggggtccgggagatcatgagggtgtcctttgggttttggggggaagaggaagactgacggtccccccagcagcaacaggtgcccactcccaggttcagctggtgcagtctggagctgaggtgaagaagccgtggggcctcagtgaaggtctcctgcaaggcttctggttacacctttaccaactatggtatcaacgtgggtgcgacaggcccctggacaagggcttaggaggtggagtgggagtggatcgagcgacttaacaataataacacacactatcgacaacaagtaacgtccgaggggaccaaggacgtaccgaacccggttaggaacccgaacgggaaccaaccactacccaacggacgaccaacaacgcctaacgagtaggtacgttaggaaggacgacctagagactacgngacgacgacggtccgtatacgttaacgtgtacggacgaaggtacgtaacgaagtaacgttagttagtttaagtacgggaaccgttacggacggggtaccgtaaccgggtacccgttcggg

SEQ ID NO: 220512 - DNA, 833 bp, Homo sapiens
  misc_feature: GYAE6OF02FHI2F.38.22.B11.1.454.CMB.1.raw
  modified_base (772)..(772): a, c, t, g, unknown or other
  misc_feature (772)..(772): n is a, c, g, or t
tcagtcgatcacgtcacgaccggtgctcgatttagacgacagctcaggggacccaaaaaccacacccctccttgggagaatcccctagatcacagctcctcaccatggactggacctggagcattcctttcttggtggcagcagcaacaggtcgcccactcccaggttcagctggtgcagtctggagctaggaggtgaagaacgccgtggggcctcgagtgacggtctccgtgcgaacggtcttcgtcggtttaacctaccctttaaccaacgttagtcggttaactccgaacgttgggtacgacgaccgtaccggaccccgttagggaaccgtaacggggtcctttaggaggtttacgggagttcggggtaacttacgggtaaacttcgaacgggtaccgttaaccttaaaacgtaaaacgtttaaaacccgttaaaccaaacccgtaacctaaccgttaacgttaccggaaccgtaaaccggtaaaggttaaacccgggtttaccggaacggggtacctaacgggtaaccgtaacccgggtaacccggttaacgaaccccggtaaccgaacctaaccgaaccgacccgaacggtacgaaccctaaccggaccgtacccgtaaagtacggttaagggtacgttaacgggacggtaacccgtacgtagacgtacgttaccgggaacgtacccggaaccggttaccggtacgtttaaagttaaccgttcgggactacgggacttaacgaacgttacaacgtaagttttaacgnggttaaccgacggtacccgtagggtccggaccggtaccggtaccgtcggtacctccgtacc

SEQ ID NO: 220513 - DNA, 652 bp, Homo sapiens
  misc_feature: GYAE6OF02GBW81.38.22.B11.1.454.CMB.1.raw
  modified_base (284)..(284): a, c, t, g, unknown or other
  misc_feature (284)..(284): n is a, c, g, or t
  modified_base (439)..(439): a, c, t, g, unknown or other
  misc_feature (439)..(439): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtcccccagcagcaacaggtgcccactcccaggttcagctggtgcagtctggagctgaggtgaagaagctggggcctcagtgaaggtctcctgcaaggcttctggttacacctttacaactatggtatcaacgtgggtncgacgacggcccctggacgaagggcttggagtggagtgggatggatcgagcgtacttaacaagtaaataacacaacactatgcaagagtaagttccgaagggcaagagtccacgtgaaccacggaacacactccgacgagccaacacgtaccaanagtaggagtttgaagggacgtaccgtggaatcgtacgtagaaccggtaccgaaccggggtccgtttaacgttaagtttaaccgtagggttaccgggacggtaaacggaacggtttaaccggaaaggttaacgttttaacggtttaggtttaagtaccgggtaacgtttaccgggaccgggggtaccctaaacggggggtacccccttacgggg

SEQ ID NO: 220514 - DNA, 592 bp, Homo sapiens
  misc_feature: GYAE6OF02GCR55.38.22.B11.1.454.CMB.1.raw
  modified_base (423)..(423): a, c, t, g, unknown or other
  misc_feature (423)..(423): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtgcgacaggcccctggacaagggcttgagtggagtgggatggatcgagcgctaacgaataataacacactactatgacacagaacgttccgaggcaggacgtacaccggtagaccgacggaccacactacccacgaagccaacacgaccctanacgtagggtagttaggaacggacgtaccgtggatatccgagaccgacgaccgggtccgttgttatttacgtgtaggcgagtagtacagtaagttacgtttagtaagtcggtacgttacggtacggggacccgtaacgggtaccccttacgggtaccctacccggttccg

SEQ ID NO: 220515 - DNA, 853 bp, Homo sapiens
  misc_feature: GYAE6OF02HSTB9.38.22.B11.1.454.CMB.1.raw
tcagtcgatcacgtcacgaccggtgctcgatttagacgacagctcagtgtcttcgtggctcacgtccaccaccacgcatgtgacctcgaggggtccgggagatcatggagggttcgtccgtttgggggttttggggggaagaggaagactggacccggtccccccagcagacaacgaggtcgcccactcccgaggttcagtctggtgctagtcgtggagcgtggaggtagaaagacgccgtggggcctcgaggtggaacggtcctccgtgacgaaggtcctttcgtacggttacctaacccttttaaccaacttagtcggtactaccgtaacggttgggtcgaccgaaccgaccggtccccgtagggaaccgtaaggggtcgttaggaacgggtgggtacggttaggggagtgggacttaccgaggtaccggttaacctttaaacaaaagttaaactaaaccaacgtaaacctaacttaagtaccgaaccgtaaacgtaaacggttaaaccggttccggaagggacgtaacggtacgtacccgaacccggtacgaacccgaaccgggaacctaaccgtaccgtacccgaacgacgacccgaaccgaaccgtacccttaacgtacggttacgggtaaggttacggaacgggtaccgtaccgtaggtaacgtacttccgtaacggaacccggtaccgtaccgggttaccggtttacgttaaaccgtttacggtggtacgggtaacggtaaacggtaacgtaacgtaaacggttaagttacggttttaggttaacggttacgggtaacccgtttaccggggtaccggggtaaccccggtaaccgggttaaccccgg

SEQ ID NO: 220516 - DNA, 543 bp, Homo sapiens
  misc_feature: GYAE6OF02FPHG3.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtgcgacacggcccctggacaagggcttgagtggatgggatggatcagcgcttacaataataacacacactatgacacagaagttccagggcagagtcacgtcgaccacggacacactccacgagcacgagcctacagtggagttagaggagcctagagatcgtagaccgacgacggccgtagtacgttactgtgcgagacgtacagaagttagttagttagtggtactacggtcggggaccgacggggtaaccctgggtacccgaccgttccg

SEQ ID NO: 220517 - DNA, 597 bp, Homo sapiens
  misc_feature: GYAE6OF02IP89R.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgttagcagcaacttgcctggtaccagcaagaaacctggccaggcctcccgaggctcctcatctagtggtgcactccaccgagggccacgtggtactccccgagccgagggtcaggtggcgtagggtcgggtcgtagggactaggtacgttacacgtctaccacctatcgagaccagccctgccagttcgtagtaagttagttttcgacttagttttactttcgttgttcagtctaattaactaagtttactcggtacctaccgttacggtcggtacggttccgggaccgtacggggtaccgtaagggtacggtaaataccgaaacggtacgttaggtacggtctacgacctacctagtccgtagttcc

SEQ ID NO: 220518 - DNA, 736 bp, Homo sapiens
  misc_feature: GYAE6OF02J2QSF.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttggggttttggggggaagaggaagactgaccggtcccccagcagcaacgaggtcgcccactcccaggttcagctggtgcagtctggagctgaggtagaaggaacgccgtgggggcctcgaggtggaacggttcctccgtggaccaacgggtcctttcgttacggtttaaccaaccccttttaacaacttagttcggtactccgtaagttgggtcggaccgaaccgaccgggcccccgttagggaaccgtaagggggtcttagggaagtgggaggtggggtaatggagtcgagtaccggtacttaataaacgtaaacaaccgaacacaacgtatcgactaacgagtaacgttcggacgggactaacgcgtaccaccggtcgaccgacgacactacgaccgacgaagaccgaactaccggtctaacgtggttaggtacgggtagaacggtagccgtagaacgttacgtacgaaccggacccgtaacggtccggtacgttacgttacgtcgtagggtacgacggaacgtaacggtacgtaacgtaattacggttacggttaacggcgggttacccggtaaccgggtccgggaacccggttaaccggggaccccttaaccgggg

SEQ ID NO: 220519 - DNA, 675 bp, Homo sapiens
  misc_feature: GYAE6OF02HGHNF.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgagggaaagacgccaccctctcctgcgagggccagtcagagtgttagcagcaactgctggtaccagacaagaacctggaccacggcctacccgaggtcctcctacacttccttaagtcggtcgacctactcccaacgacgggcctacgtggtacctcccgagccggagggtcaggtcggcagggttgggactaggggactaggtacgtttacaccgttctacccactacgtcacgcgacgtccgtagcctagtctaggtaacgttagttttacgtacgtttaacgttttactttacgttcgtactaacgtacttaacttaattaaaccgtttctaccggtcccttaccgttacggttaccggtaaccggttccggtaccgggtaacggggtacccgtaaagggttaccggtaaacgtaaccgtaaaaccggtacggttacggtacgtaccgtaccggtaacctaccgtacgttccgtacgtttacccg

SEQ ID NO: 220520 - DNA, 602 bp, Homo sapiens
  misc_feature: GYAE6OF02GAA8J.38.22.B11.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (296)..(296): a, c, t, g, unknown or other
  misc_feature (296)..(296): n is a, c, g, or t
  modified_base (407)..(407): a, c, t, g, unknown or other
  misc_feature (407)..(407): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctntcctgcagggccagtcagagtgttagcagcaacttagcctggtaccagcagaacctggccaggcctcccaggcctcctcatctatggtncatccacgagggccagtggtactccagccgagggtcaggtggcaggtgggtcgtgggactaggtacgttcactctacaccatcagcacgcctgcctagtctaggtaagttnttttcgacgtttagttttatttccgtgttacgacgtacttaatttaacctaagtttaccgtcgtacccttacgttacggttcggtaccggtttccgggaccggacggggtacctaaggggtacgtaaacttaccggtaaaaccggtacgttgggtacggtaccgtacggacctacgtacgttccgttcttacccg

SEQ ID NO: 220521 - DNA, 634 bp, Homo sapiens
  misc_feature: GYAE6OF02H7NG6.38.22.B11.1.454.CMB.1.raw
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtggggcctcagtgaaggtctcctgcaaggcttctggttacacctttacaactagtggtatcaacgtgggtgcgacacggcccctaggacgaagggcttaggagtagggatggggatggaatcgagcgacttaanaataataacacanactatgacagagtaacgttcgaagggtcagacgtcacggtacgaccgaacgggacacgacgtccgaacgacgacaacgacgtacctacacgtaggtaggttacggacggacgtaccggtgtaacgacgtacgtacggaacccgaacggacccgggtaccgttagttaacgtttaccgtggtacggacggttaacggagttacgaagttaacgtgtttagttagtacggtaacgtacggtacggggaccgtaaccgggtaacccgtacggtcccgaccgttcccg

SEQ ID NO: 220522 - DNA, 558 bp, Homo sapiens
  misc_feature: GYAE6OF02GNBTN.38.22.B11.1.454.CMB.1.raw
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (433)..(433): a, c, t, g, unknown or other
  misc_feature (433)..(433): n is a, c, g, or t
  modified_base (478)..(478): a, c, t, g, unknown or other
  misc_feature (478)..(478): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttacaactatggtatcaactgggtgcgacaggcccctggacaagggcttgagtggatgggatggatcagcgcttacaataataacacacactangcanagagttcagggcagagtcaccgtgaccacgacacactccacgagccacacgcctacagtcggagttgaaggtanccgtgaacgatcgtagacgacgacggtccgtgtacttacgtgtgngaggacgtaacgaagtaaagttagttagttaacgtacggtaccgttaacgtcggggaccctacggggtaccccttacggg

SEQ ID NO: 220523 - DNA, 578 bp, Homo sapiens
  misc_feature: GYAE6OF02F4UBH.38.22.B11.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcagcaacttagccttggtaccagcaagaaacctggaccaggctcccaggcctcctcatctagtggtnctatcccacgagggcctacgtgtactcccgagccagggtcaggtggactaggttgggcgtaggacaggtagttccacttcacaccatcgacgcacgctcgactacgtcgtaggtaagttattttgacttagttttacttcgtgtcagtactaattactaattcgtgtaccttcgttacggtcggtacgttcggaccgaacgggtacgtaaggtacgtaaacgtactaaaacgtacgttggtacggtcgtacgaccgtaactaccgtacgttcgttacc

SEQ ID NO: 220524 - DNA, 655 bp, Homo sapiens
  misc_feature: GYAE6OF02FE99N.38.22.B11.1.454.CMB.1.raw
  modified_base (133)..(133): a, c, t, g, unknown or other
  misc_feature (133)..(133): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (368)..(368): a, c, t, g, unknown or other
  misc_feature (368)..(368): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaanaggaagactgacggtccccccagcagcaacaggtgcccactcccaggttcagctggtgcagtctggagctgaggtgaagagcctggggcctcagtgaaggtctcctgcaaggcttcgtcggttaccaccttttacaacttancggtatcaacgtgggtncgacacggcccctggacaagggtctgacgtggatggatggatcgagcgtactacaaataactaacacactaactangaactaaaagacgttaccgagggcaagacgtcaccgtagaaccgacgacacgactccgaacgtacgacacgtaccgcctaacgagtacggaaggttacggaagggtaccgaccgttaggaacgtacgttacgacggtaaccgaaccgtaccgggacgtttacggtactttaacgtgttcggacggtacgtacgtaacaaggtaaatttacgttaacgtttaacgtacgggtaccttaccgggtaccggggaacccgtaaccggggtaaccccgttagggtaaccccg

SEQ ID NO: 220525 - DNA, 528 bp, Homo sapiens
  misc_feature: GYAE6OF02HCO8O.38.22.B11.1.454.CMB.1.raw
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaactgggtgcgacaggcccctggacaagggcttgagtggatgggatggatcagcgcttacaataataacacacactatgcacagaagttccagggcagagtcaccgtgaccacggacacatcccacgagcacagccctacatggagttgacggngcctgagatctgacgacgacggccgtgtattacngtgcgagacgtacagtattattgttagtggtacgtacgtcggggacacggggtaccctcggg

SEQ ID NO: 220526 - DNA, 568 bp, Homo sapiens
  misc_feature: GYAE6OF02FKEVL.38.22.B11.1.454.CMB.1.raw
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcagtgaaggtctcctgcaaggcttctggttacacctttaccaactatggtatcaactgggtgcgacacggcccctggacaagggcttgagtggatgggatggatcgagcgacttacaataataacacacactatgcacagacgttccgagggcagagtcacgtgaccacggacactactccacgacgacacacgcctacagtaggtagttgaacggagccgtagacgtatccgtagaccgacgaccggtacgtagttacgttacgtggtacgacgagagtacaagtaagttattaggttattacggacttacggcggggaccgtaaccgggtacccgtaggtacccgtaccgttcccg

SEQ ID NO: 220527 - DNA, 856 bp, Homo sapiens
  misc_feature: GYAE6OF02GWJ3U.38.22.B11.1.454.CMB.1.raw
tcagtcgatcacgtcacgaccggtgctcgatttagacgacagctcaggggacccaaaaaccaacacccctccttcgggagaatcccctagatcacagctcctcaccatggactggacctggagcatccttttcttggtggcagcagcaacaggtgcccactcccaggttcagctggtgcagtctggagctgaggtgaagaagccgtggggcctgagtgaaggtctcctgcaaggcttctggttaccacgtttaccaactagtggtactcaactgggtgtcgacgacggccccgtaggaacgtaagggcttaggaggtggagtgggagtaggagtacgacgtcggtacttaacaaataaataaccacgtaaccaagttactaggactaaccgaaggtaaacgttccgaacggggactacgggtaaacgttcccggaaaccggttagggaaaccccgaaccgggtaacgaaaccgtaccttaacccccaaaggggacaacccggaaaccgtaacggtaccccctaaagttaacgtacggggtaagtttaagggaccggggttaacgtacccgttaggaacgggtatttaacccgacgggtaaaccgggaacccggtacccggggtacccggttttaagttaaacccggttttaaccgtaccgggtttcggaaacccgggtaaagggtaaccggtttaacggtaaaccggttaaaaggttttaacggtttaacggttttaaccgggaaggttaaaacccggtttacccggggtaacggggggggttaacccccgttaaaggggggtaacccccccggttttaggggttaacccccgtttaacccgggtttaccccccgg

SEQ ID NO: 220528 - DNA, 665 bp, Homo sapiens
  misc_feature: GYAE6OF02FNFMB.38.22.B11.1.454.CMB.1.raw
  modified_base (203)..(203): a, c, t, g, unknown or other
  misc_feature (203)..(203): n is a, c, g, or t
  modified_base (335)..(335): a, c, t, g, unknown or other
  misc_feature (335)..(335): n is a, c, g, or t
  modified_base (400)..(400): a, c, t, g, unknown or other
  misc_feature (400)..(400): n is a, c, g, or t
tcagtcgatcacgtcacgaccggtgctcgatttagacgacagctcgagggggaggaactgctcagttaggacccagacggaaccatggaagccccagcgcagcttctcttcctcctgctactctggcctcccagataccactggagaaatagtgatgacgcagtctccagcccaccctgtctgtcgtcctccgaaggggaaancgccctaccctctccctgccgacgggccagtccaagtagttgttacgacaaactaacttaggccctaggtacccagcgaacgaaacccgtggaccacggcctccccgaggtcctcctcactctagtgggtcncctaactcccgaaccgacgggaccctacgtacgtacctccccgagcccgtaggggtcagggtcgnggtaggttcgggtcgtacgggactagggttacgttccacgttacctaccgactaacgtcgacggccacgtcctgacgtacgttcgtagtaacgtttgtttcgtagtttagttttcgttcgttagtctacgtcttaacgttaactaacgtttacctcgtacccttacgtacggttcggtaccgttcggaccggacgggtaccgttaggacggtaaactcgaaacggtgtcggttacgcctagaccgtatcgtacctgttaccttcg

SEQ ID NO: 220529 - DNA, 636 bp, Homo sapiens
  misc_feature: GYAE6OF02H8OCT.38.22.B11.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (469)..(469): a, c, t, g, unknown or other
  misc_feature (469)..(469): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaacncgccaccctcncctgcagggccagtcagagtntagctagcaacttacgctggtaccagcgaagaaacctggccaaggctaccccgaggcctccgtacattcgtagttggacgtcaacgttccaccgagggtcccacgtggtacctcccaggccgtacgggtcaacgggtcgacgtacgggtgggtctgggacaggtcgtcacgtctacactatcagctagccttgaccacgtctacggtaattcgttttgacttagtttttactttacgngttacacgtacttaattaacgttacgttccgtacgtaccgttccgttacgggttaccggtacgttccgggtacggtaacgggtaccgttaacgggtaacgaaacgttaaccgaaacggtaacgtacggtcggtacgtaccgtacaccgttacgttccgttagttacc

SEQ ID NO: 220530 - DNA, 552 bp, Homo sapiens
  misc_feature: GYAE6OF02HC3KZ.38.22.B11.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (350)..(350): a, c, t, g, unknown or other
  misc_feature (350)..(350): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanacgccaccctntcctgcagggccagtcagagtgttagcagcaacttgcctggtaccagcagaaacctggccaggcctcccaggcctcctcatctacgtggtgccactccaccgagggcccacgtggtactcccgagccgagggtcagtggacgnggtcgggtcgtgggacaggtacgttacactctcacctatcgagcacgcctgctagtcagagtatttgacttaggttttattcgttgtcagtacgtattactattacgtcgtcctacgtacgtggtacgtcggcgagggtacgaggtacggaatacgaacgtacgtcggtaggtactcggtaccaccgtataccgtgttaccg

SEQ ID NO: 220531 - DNA, 618 bp, Homo sapiens
  misc_feature: GYAE6OF02H5QP9.38.22.B11.1.454.CMB.1.raw
  modified_base (443)..(443): a, c, t, g, unknown or other
  misc_feature (443)..(443): n is a, c, g, or t
tcagtcgatcacgtcacgaccggtgctcgatttagacgacagctcaggggacccaaaaaccacacccctccttgggagaatcccctagatcacagctcctcaccatggactggacctggagcatcctttttctggtggcagcagcaacaggtgcccactcccaggttcagctggtgcagtctggagctgaggtgaagaagccgtggggcctcgagtgaaggtctcctgcaaggcttcgtggttactacctttaccaacttatggtataccaacgtgggtgacgacacggcccctaggacgaacgggtcttggagtggatgggagtggatcgagcgtacttaacaataactaacacacactatcgacaacagaagttccgaggcaagtacgtacgacggtagacccgacggaacacactacccgaagacgcaacgacgacctanagtgggtagttgaaggtacgccgtaggagactcgacggaacctacgacggtccgttagttacgttacgtggtacgacgtagtacgtaacgagtaacgttgtttagtaggtacggttacctacgggtcggggaacccgtaacggggtaacccgttacggtcccgaacggttccccg

SEQ ID NO: 220532 - DNA, 525 bp, Homo sapiens
  misc_feature: GYAE6OF02GZPFI.38.22.B11.1.454.CMB.1.raw
  modified_base (197)..(197): a, c, t, g, unknown or other
  misc_feature (197)..(197): n is a, c, g, or t
  modified_base (361)..(361): a, c, t, g, unknown or other
  misc_feature (361)..(361): n is a, c, g, or t
  modified_base (518)..(518): a, c, t, g, unknown or other
  misc_feature (518)..(518): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagcagcaacttagcctggtaccagcagaacctggccaggctcccaggctcctcatctatggtgccactcccgaccgacggggcccacgttcggtactccccgagcccagggtcaggtcggcaggtgggtcngggacaggtagttccactcctcaccatccgagcagcctgcagtctagagtattttgcttagtttatttctgtcagtctattactaattcgtcgtcctcgtacgtgtacgttcgcgtagggacgaaggtgaactacgaacgtacgtgtgctcgctacntctgttc

SEQ ID NO: 220533 - DNA, 709 bp, Homo sapiens
  misc_feature: GYAE6OF02IVFVH.38.22.B11.1.454.CMB.1.raw
  modified_base (226)..(226): a, c, t, g, unknown or other
  misc_feature (226)..(226): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtcccccagcagcaacaggtgcccactcccaggttcagctggtgcagtctggagctgaggtgaagaagccgtggggcctnagtgaaggtctcctgcaaggcttctggttacacctttaccaactatggtatcaacgtgggtgcgacaggcccctaggacaagggcttgaggtggagtggggatggatcgagcgtattaacaataaattaaaccactaactaactaatagaccaacagtaaacggttaccgagggacaagacgtaccaaccggtcgaacccaacgggaaccaactaactacccaacggagtaccgaacacgaccctacgagtacgggtagttacggaagggtacgccgtaggaacgtagtacgtaggaaccggaccgtaaccggggtccggtttacggttaaactttaccggttagggtaccggtacgggtaacggtaacgggttaaccaaagggttaaacgttttagtttaacgggtttaagttaacggggtaaccgtttaaccgggtacggggggtaaccccggtaccgggggtaaaccccgtttaccgggg

SEQ ID NO: 220534 - DNA, 652 bp, Homo sapiens
  misc_feature: GYAE6OF02FK1G1.38.22.B11.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcagcaacttagcctaggtaccagcaagaaacctggccaggcctcccgaggcctcctnatctatggtgctactccacgagggccacgtggtaccncccgaaggccgaggggtcaggtcggctaggtcgggtcgagggacaggtacgttcacttcctacacctatccgagccgacggtcctgacacggttctaggtaaacgtttgttttacggtacgtttaagtttttactttccgtagttactacgtaccttaatttaactaacgtttacccgtacggttccccttaccggttaacgggtacggttacccggttccgggacccgggtaaggggtaacccgtaaagggtaacggtaaaacgtaaccggaaaacggtacgttaggtaccgacgtacgtaccctacgtacttcgtacttaccg

SEQ ID NO: 220535 - DNA, 684 bp, Homo sapiens
  misc_feature: GYAE6OF02IBNFB.38.22.B11.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagcccaccctgtctgtgtctccgaaggggaaancgccaccctctccgtgacgagggcctagtcagtagttgtaagcagactaacgttagcctaggtaccagacaacgaaacctggaccaggcctacccgaggcctcctntactctagtggtcaccaactcccaaccgagggccctaacgtcgggtactacccgaggaccgagggtcacggtggactagggtcgggtcgtagggacaggtacgttccaacgttcctaccaaccgtagtaccgaacgtcgaacggccccgttaaggacctaaggttccgtaagtaaaggttctttttacggactttaaggtttttacttcgtaccgttgaactactttaacttaaacgtaatttaccgtccgttaccttaccgttacggtcgggtaacgtttcgggaacccgtaggggaaccgttaagggtacgtaaactaacggtaaacgtacggttcggacgtactaccgaactaacccgttagtccgttagttacc

SEQ ID NO: 220536 - DNA, 835 bp, Homo sapiens
  misc_feature: GYAE6OF02H1ZGZ.38.22.B11.1.454.CMB.1.raw
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgagggaacagcccaccctctcctgcacggccaggtcagacgttgttacgcaacgctaacttcgccttaggtaccacgccgaacgaaacccgtcggaccaggaccccgttcccgacgggtccttccctactattccgttaagtcgggtacgctaccgtcccgaaccgaccggggtaccctacgttaccggtacctaccccgacggaccggtacgggtacctaggtccgggacgtagggttccggggtacgttcggggactaggttacgttccacgttcctacccacgtaccgtacgacgacctacggtcctacgtacgttagttccgtaacggtaagttttccgtttacgttaccgtttacgttttttaattcccgttaggttacttaccggttaactttaaccgttaaaccgttaacggttttacccgttaccgggttacccccgttttaccggttaaccgggtttaaccggggttcccgggtttaccccggaaacgggggggtacccgggttaaacccggggttaaacgggggttaacccgggtaaaactttaacccgggtaaaaccggttcgttaaccggggttaactaccgggtttaccggaaacccgttacccgtaacgttttcccggttacgtttaccccgg

SEQ ID NO: 220537 - DNA, 692 bp, Homo sapiens
  misc_feature: GYAE6OF02IJQY7.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcaagaaacctggaccaggcctaccccgaggccttccctactactctagtggtcgacactacccaccgacgggccctacgttggtacctccccgagccgacgggtcaggtcggcgagggttgggtacgtagggactaggtacgttaccacgttccaccgaacctagttaccgaaggaccgacgtcccttaggaccctaggttcctaggtaaacgtttgtttttacgacgtttaggttttttacttccgttgttacaacgtacttaacgtttaaacctaagtttaccgtcggtaccccttaccggttacggttacgggtacccggttaccgggacccggtaacgggggtaccctaaggggtacggtaaaacgttaaccgaaacggtaacgttcggtaacggccgttacgacctaaccgtagtttccgttacgtttaccg

SEQ ID NO: 220538 - DNA, 668 bp, Homo sapiens
  misc_feature: GYAE6OF02IJ6LY.38.22.B11.1.454.CMB.1.raw
tcagtcgatcacgtcacgaccggtgctcgatttagacgacagctcagggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaaagaagccgtggggcctcgagtgaaggtctcctgcaaggcttcgtggttacacctttacaactatgtatcaacgtgggtagcgacacggccccgtaggacaagggtcttggagtggatgggataggatcgagcgacttacgaaataataaccacacatagtcgacacgaagtaacgtccgaaggacagacgtacacgtacgaccacggacaacgacgtaccgaacgacgactaaccgacgccctaaagagttagggtagttaacgggaaggacgtaccgtaggagtaacgtaccgttaggaaccggaacgtacccggggtaccgttagttaacttaccggttcggtaggaaccgggtaggtaaagtaccggtaaagtaaggtttaacgtttaggttaacgtaacgggtaataccgggttaccggggaacggttaaccggggtacccgttacgggtccctaaccggttcccg

SEQ ID NO: 220539 - DNA, 549 bp, Homo sapiens
  misc_feature: GYAE6OF02F8FGQ.38.22.B11.1.454.CMB.1.raw
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (521)..(521): a, c, t, g, unknown or other
  misc_feature (521)..(521): n is a, c, g, or t
  modified_base (531)..(531): a, c, t, g, unknown or other
  misc_feature (531)..(531): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcagctaacttagcctggtaccagcaagaacctggaccaggcctcccgaggcctcctcactcgtagtggtnacctactcccgaacgacggcctacgtggtacctcccgagccgagggtcaggtggctagggtcggtcgagggactaggtacttcactcacacatcgagcacgcctgctagtcagaattnttcgatttagttnttctagtctagtactattaactacttcgtcgtccttacgtacgtcgtacggtccgacggcggactaggacgtaaacgacgtaacgngtcgcgtacncgactacctntcgtntac

SEQ ID NO: 220540 - DNA, 649 bp, Homo sapiens
  misc_feature: GYAE6OF02F2CXB.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaangccacctctcctgcagggccagtcagagtgtagcagcaacttagcctggtaccagccagaaacctggccaggcctcccgaggctccctcatctagtggtcgcactcccaaccgacgggacccacgtggtactcccaggccaggggtcaggtggctaggtgggtcgtggggactaggagttcgactctacgaccgtatccgacgcacgccgtgctagttcgtaggaacgtattttcgtacgttagtttttactttcgttacgtacgtacgtacctaagtttaactaacgttttaccgtaccggttcccctttaccttaccgggttaccgggtaaccggtttaccgggacccggtaacgggggacccgtaagggtacggtaaaacgtacccggaaaacgtaccggttacggtacggtacgttacgacccgtacgtaacgttccgtacgtttccg

SEQ ID NO: 220541 - DNA, 608 bp, Homo sapiens
  misc_feature: GYAE6OF02IEJBU.38.22.B11.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagngtgttancagcaacttagcctggtaccagcaagaacctggaccaggcctcccgaggcctcncatcctagtggtncactcccaccgagggccagtggactcccagccgaggtcaggtgcagggtcggtctagggacaggtacttcacttcacgacctagtcgagcacgccgtagccgtagttctaggtaagttactttggacctttagtttttacttccgtgtacagtacttagtttaaccaacgtttcgtccgtacctttaccggtacgttacggtaccggttaccgggacggtacggggtacctaagggttacgtaaacgtacccgtaaacggtacgttcgggtaggtctacgtacccgtatacgtttcgtacgtttacccg

SEQ ID NO: 220542 - DNA, 647 bp, Homo sapiens
  misc_feature: GYAE6OF02G3EMM.38.22.B11.1.454.CMB.1.raw
  modified_base (184)..(184): a, c, t, g, unknown or other
  misc_feature (184)..(184): n is a, c, g, or t
  modified_base (275)..(275): a, c, t, g, unknown or other
  misc_feature (275)..(275): n is a, c, g, or t
  modified_base (345)..(345): a, c, t, g, unknown or other
  misc_feature (345)..(345): n is a, c, g, or t
  modified_base (543)..(543): a, c, t, g, unknown or other
  misc_feature (543)..(543): n is a, c, g, or t
tcagtcgatcacgtcacgaccggtgctcgatttagacgacagctcaggggacccaaaaaccacacccctcctgggagaatccctagatcacagctcctcaccatggactggacctggagcatccttttctggtggcagcagcaacaggtcgcccactcccaggttcagctggtgcagtctgganctgaggtgaagaacgccgtggggcctcgagtgaaggtctcctgcaaggcttctggttaccacctttaccaactgtggtatacgaatgggtnacgtacacggcccctggaccgaacggggctttaggagtaggagtagggatgggatcgagcggtacttaanaaagtaataacaacaacgtactaagtcgactaacgagtaacgttacgagggacaggtactcgaaccggtagaacccgacgaacacactaccgaacgagaccgtactaacggccaacgagtacggtaagttcggaaggtacgaccgttaggacgaacgttcgaggtaaccgaccgtaccgggacgttagtaacttacgnggtacgacggtagaacgtacgaagtaacgtagttacgttacgtacggtacgtacggtcggggtaacccgtacgggtaccccgtaggtaccggtaccttacccgg

SEQ ID NO: 220543 - DNA, 600 bp, Homo sapiens
  misc_feature: GYAE6OF02I3XT3.38.22.B11.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (378)..(378): a, c, t, g, unknown or other
  misc_feature (378)..(378): n is a, c, g, or t
  modified_base (414)..(414): a, c, t, g, unknown or other
  misc_feature (414)..(414): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagngttgtagcagcaattgcctggtaccagcagaaacctggccaggcctcccaggcctcctcatctatggtcgcactccacgacggcccacgtggtactcccgagccgagggtcaggtcggcaggttgggtcgtgggacaggtacgttcaccttcncacctatcgagccagcctgactacgtctagtaagtntttgtacgttagtttttatttcgtgttacgacgtacgtaatttaactaactttaccgttcgtacccttaccgttacggtcgggttaccggttccggacccggaggggtaccctaagggtacggaaactacgaaacggtaacgtcggtaccggtcttacggacctaaccgtacttccgtcgttaccg

SEQ ID NO: 220544 - DNA, 641 bp, Homo sapiens
  misc_feature: GYAE6OF02FY8ZY.38.22.B11.1.454.CMB.1.raw
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgcagtctggagctgaggtgaagaagcctggggcctcgagtgaaggtctcctgcaaggcttcgtggttactacctttaaccaacttatggtatcaagtgggtgcgacgacggccccgtggacgaagggtcgttggaggtggagtgggagtggatcgagcgtacttaacaaataataacacacaactatgacanagtaacgttacgaggcagacgtacaccgtcgaaccacggacacacncccgaagacgacacacgtacctacgtacgttaggtaggttagggaacggacgtcgtacggaagtaccgtcgtacggaccgtaaccgacgggtaccgttagttacgtttacgtaggttcgacggtaacggtaggtaacgtaagttaaattacgtttaaggttacgtacggtaacggttaccggtacggggacccggtaccgggtaccgttacggg

SEQ ID NO: 220545 - DNA, 599 bp, Homo sapiens
  misc_feature: GYAE6OF02IMHTE.38.22.B11.1.454.CMB.1.raw
  modified_base (198)..(198): a, c, t, g, unknown or other
  misc_feature (198)..(198): n is a, c, g, or t
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaactagcctggtaccagcaacgaaacctggaccaggcctcccgaggcctcctcatcctagtcggtgctactccaccgngggccagtgtactcccgagccgaggtcnggtcggctagggtcgggtcgtagggactaggtagttccacttccncgaccatacgagccacgcctggcctaggtctaggtaattgttttgacgttagtttttacttcgtgttctagtacttaacttaactagtttaccgtcgtcccttaccgttacggttggtaaccggtccggaccggaggggtacctaagggtacggtaaactacggaaacgtacgtggtacggctacgtaccgaccgtacttcgtacgttcc

SEQ ID NO: 220546 - DNA, 807 bp, Homo sapiens
  misc_feature: GYAE6OF02I00OJ.38.22.B11.1.454.CMB.1.raw
  modified_base (655)..(655): a, c, t, g, unknown or other
  misc_feature (655)..(655): n is a, c, g, or t
  modified_base (699)..(699): a, c, t, g, unknown or other
  misc_feature (699)..(699): n is a, c, g, or t
tcagtcgatcacgtcacgaccggtgctcgatttagacgacagctcaggggacccaaaaaccacacccctccttgggagaatcccctagatcacagctcctcaccatggactggacctggagcattccttttctggtgcagcagcaacaggtcgcccacctcccaggttcagtcgtggtgcagtctggagctggaggtagaagagccgtgggcctgagtggaggtctccgtgacgaggtcttcgtcggttaccacccgtttaaccaacgttagttggtaattccgtaaacttggggtacgccggaaccacggggccccccttaggggaaccctaacggggggtcctttaggggaaacggtttgggggaaacgtttggggggaaatttcggggaaacgttccggaaggtccggtaacgttttaaccgaaaagttaaacgtaaaaccgtaacctaaacctaaccgttaaatacggacaaaaccgtaaggtaaacggtttacccgaacggggtaccgtaaacggtaacggttacccgtaacccggttacgggaaaccccgtaaccgggaacctaaccgaaccgtaacccgaacggaaccgaccgaaccgtaacgacccgtaacgaacgtacgggtaacgtaggaacggtagtaccgtanaggacgtaccgtcacgggaccgtacggaccgtacgtacgttacngggtacgcgacgtagtacgtagaacgtaagttgtttaacgtacggtaacgttacgtacggggtacccggtaaggtaaacccggttaccggttcggtacccgttaccgg

SEQ ID NO: 220547 - DNA, 592 bp, Homo sapiens
  misc_feature: GYAE6OF02FJP5A.38.22.B11.1.454.CMB.1.raw
  modified_base (196)..(196): a, c, t, g, unknown or other
  misc_feature (196)..(196): n is a, c, g, or t
  modified_base (406)..(406): a, c, t, g, unknown or other
  misc_feature (406)..(406): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgccaccctctcctgcagggccagtcagagtgttagcagcaacttgcctggtaccagcagaaccctggccaggcctcccaggcctcctcatctatggtgcatcccacgagggccacgtggtacctcccgagccaggggtcaggtggctaggtcgggtctgggacaggacgttcacttcacaccatccagcagcctgcagtctagtaagtnttttgcttagtttactttcgtcgttacagtacctaagttaacctaatttaccgtcggtacccttaccggttaccggttacggtacccggtttccgggacccgtaggggtaccctaagggtacggtaaactaccggaaacgtacgttcggtacggtcacggtacctaccgtagttaccgtcgttacc

SEQ ID NO: 220548 - DNA, 766 bp, Homo sapiens
  misc_feature: GYAE6OF02H8AOP.38.22.B11.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgccagggccagtcagngtgttagcagcaaacttcgcctggtaccagacaagaacctggccaggcctcccgaggctccgtnactctaatgggtcgactactcccgaccgacgggacctacgttggtactcccgagtacccggagggttcaaggtcgggtctagggttcgggtacctaggggaaccaggttaccggtttaccaacgttccgtaaccgacctacgttacgacgtaccgacgtccccgtttagaccgtacggttactaacgggtaaacgtttacgtttttacggaaccgtttaacggtttttttaatttacccggttacgttaccgtaacggttaacctttaacgtttaaaccttaaacggtttaccgtaccggtacccgtttaccggtaacggggtttacggtaacccggtttaccggacggggtaaccgggttaaccgtaagggggttaacctaaaacggttaaccggaaaacggttacccgttagggtccggttaccttaacggacccgttaaaccgtacggttttaccgtaccggttttaaccc

SEQ ID NO: 220549 - DNA, 653 bp, Homo sapiens
  misc_feature: GYAE6OF02F93CV.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgcagtctggagctggaggtgaagaacgccgtggggcctcgagtgaaggtctcgtgcaaggcttcgtggttaccacctttacaacttgtggtatcaacgtgggtcgacgacgcggcccctggacgagggtctaggagtggagtcgggatgggactcgagcgtacttaacaataataaccacactactagtcgacacgagtaacgttaccgagggacaggtacgtacgaccgtacgaaccgtacggaacacgacaccgacgacgacacgacgtaccagtagtggaacgttggacgacgtactaggaatcgtacgtacggaccgtacggtaccggtaccgtagtttacgtaccgtgtacgtcggtaacgtacggttaaacgagtttaaacgttacgtttaggttaaccgtacggtaaccggttaccgggtacgggtaacccgggtaccggtaccccggttaaccggg

SEQ ID NO: 220550 - DNA, 638 bp, Homo sapiens
  misc_feature: GYAE6OF02HTPL9.38.22.B11.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaatagtgatgacgcagtctccagccacctgtctgtgtctccgaggggaaagngcccaccctctcctgcagggccagtcagngtgttacgcagcaacttgcctggtaccagcaagaacctggaccaggcctacccaggcctcctcattctagtgggtcnctacgtcccaccgacgggccaacgtcggtactcccgagccgtagggtcaggtcggctaggtgggtcgtagggacagtacgttcacgtctacacagtcagactagcctagccgtagtcgtacggtagttagttttcgacgtttaagtttttacttacgttggtactaggttaccttattaaccgtaagttaccgtcgggttcccttacgttacgggttcggtaccggtttaccggaccggtaacgggaccgtaaagggttaacgggaacgttaaaccgaaacggtaaccgttggacgggtcctacggtaccgaaccgtacgttcgtacggtttacc

SEQ ID NO: 220551 - DNA, 681 bp, Homo sapiens
  misc_feature: GYAE6OF02G4P3Y.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagcccaccctgtctgtcgtctaccgagggaaacgacgccaccctccgtcctgccgacgggccagtaccagagtattacgggggcagactaacttacgccgtacggtaccagcaacgtaaacctcggaccgaggcctccgagtcctccactatctagtggtcgactactaccaccgacgggtcctacgtacggttacctcccgaacggtccggtaacgggtccgtaacggtcgggtaccgtagggttcggggtcggtacgggacgtagggtacgtttcaccgttactccgaacctaagtccgtaacggcctacgccgtcgacgtacgtcgttaaggagttacgttttgacgttagtttttacttcgtacgtactacgtacttaattactaaactttcggccgttctaccgttgtcgtaccgttcggaaccgggttacggacggtacgtacggtaactacgaaacggtacgttacggtcgtaccgacggtaccctacgtacgttacttacgttccg

SEQ ID NO: 220552 - DNA, 748 bp, Homo sapiens
  misc_feature: GYAE6OF02JI4EY.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgaggtgtccttgggttttgggggagaggaagactgacggtcccccagcagcaacaggtgcccactcccaggttcagctggtgcagtctggagctgaggtgaagaagcctggggcctcgagtgaacggtctccgtgacaagggctttcgtggttaccaccctttaccaaacttatggtaactccgaacttggggtagtcgaaccagggtaccccccttgggaacgaaaggggtcctttaggaaggttgggaattgggggaatttcggggaattccgaaggccggtacttaacgtaaattaaactaaccactaaactacctaattggaccaacgtaggtaaaacgtttcccgaaggggtacaacgggtaacggttccaacccggtaggtaacccgaccgggaaccgaacctaaggcccaacggacgacctaaccacggaccctaacgagtagggtaacgttggaacgggacgtccgtagaacggtaacgttaccagggaaacccgttacggaacccgggttcgtaaggtttaacttaccgtagggtcgtacggtaaggtacggtaaccgaagttaaacgtatttacggttaattcggtaaccgttaccggaagggggtacccgaaggggttaacccccttagggg

SEQ ID NO: 220553 - DNA, 744 bp, Homo sapiens
  misc_feature: GYAE6OF02GCLSX.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaaacctggccaggcctcccaggctcctcatctagtggtgcactccgaccagggccacgtcggtactccccgagcccgtaggggtccaggtcggacgagggttcgggtcgtggggacaggtacgtttcaccttcctaccgacccaagttccaacgtaccacggtcccctggacctacggttccgttaagggtaaacgtttacgtttttacggtaccgtttaaggttttttactttttccgttacggtttaccgtaacggttaccttaaacgttttaaacctaaacgtttttacccggtaccgggttccccgtttacccgtttaacgggtttacgggttacccggttttacccggggacccgggttaacgggggtacccggtaaaggggttaaccgggtaaaacgttaaccggtaaaaccggtaacggttacgggttacgggtaccgttacggtaacccgtaccgtaacgttccgttacgtttacccg

SEQ ID NO: 220554 - DNA, 631 bp, Homo sapiens
  misc_feature: GYAE6OF02FNINK.38.22.B11.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccaccctctcctgcagggcccagtcagagtgttagcagcaacgttagcctggtaccagcagaaacctggccaggctcccgaggctcctcatctatggtgcactccaccgtaggcccatcggtactcccagccagggtcagtggctaggtgggtctgggacctaggtacgttccactctccgaacccagtccgaacgctacggccccttgggcctaggttccgtaggaaacgtacgttttggtacttaacgtttttacttttcgttacgtctacggtacttaatttaaccgtaagttttaccctacgggttccccttaccgttacggtcggtaccggtttcggaccgtaaggggtacccaaaggggtacgtaaaacgtacgaaaccggtaacgttcggtacggtcgtacgaccgtaactcgttcttacgttccg

SEQ ID NO: 220555 - DNA, 628 bp, Homo sapiens
  misc_feature: GYAE6OF02F5TKC.38.22.B11.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccagtcagagtgttagcagcaacttagcctaggtaccagcagaaacctggccaggcctcccaggcctcctcatctatggtncactcccaccgaggccacgtgtactcccagccagggtcaggtggcgtaggtgggtctgggactaggtacgttcactctacacctatcgacgcacgtcccgtgacgagttctaggtaacgtagtttttcgactttagttttatttccgttgtctagtacctagtttaactacgtttacgtcgtcccttaccgttacggttacggtaccggttccggacccggtaacggggaccgtaacggggttaggtaaacccgttaaccgtaaaacggtaacccgttggtaccgggtaccgttcggaacccgtaccgtacgtttccgttacgtttacccg

SEQ ID NO: 220556 - DNA, 612 bp, Homo sapiens
  misc_feature: GYAE6OF02GYMFL.38.22.B11.1.454.CMB.1.raw
  modified_base (198)..(198): a, c, t, g, unknown or other
  misc_feature (198)..(198): n is a, c, g, or t
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccaccctctcctgcgagggccagtcagagtgttagcagactaacttagcctggtaccagcaacgaaacctggaccaggcctcccgaggcctcctcactctagtggtgaccactcccaccgacgggccacgtcggtactccccgaggacccgtagggtccaggtcggcgtagggttcgggtcgtagggacaggtagttccacttcaccacgtatccgacggccacgcctggctagtccgtagtaacgttattttggactttagtttttntttcgtgttcagtactattactaagtttcncggtccttaccgtcggttcggtaccgttacgggaccgagggtaccgtaaggtacggaaacgttaacgaaacgtacggttggtaggtccgagtacccacgtacgttcgtgttacc

SEQ ID NO: 220557 - DNA, 637 bp, Homo sapiens
  misc_feature: GYAE6OF02G64RY.38.22.B11.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
tcagtcgatcacgtcacgaccggtgctcgatttagacgacagctcagggggaggaactgctcagttaggacccagacggaaccatggaagcccccagcgcagcttctcttccctcctgctactctggctcccagataccactggagaaatagtgatgacgcagtctccagcccacctgtctgtgtctccgaggggaancgccaccctctcctgcagggcagtcagagtgtagcagctaactcgcctggtacagcaagaacctggccagccaccgagtcctccgctactcgtagtggtcacctacnccgaaccgngggccctacgtcggtactccccgaggcccgtaggggtcaggtggccgtgggttcggtcgtagggactagtacgttacaccgttcaccacctatccgagtccacgtctacncggtatcgtacggaatttacggtttnacgtttcgttttactttcgtgttactacgtacttaacgttactaacgttcgtcggttaccctaccggttagggtccggttaccggttccgggacggtacggggtactaacgggtagtaaaaccgtaccggtaaagaccggttcggtaccggtacgtacggaacccgacttacgttcgttaccttacg

SEQ ID NO: 220558 - DNA, 556 bp, Homo sapiens
  misc_feature: GYAE6OF02F70EN.38.22.B11.1.454.CMB.1.raw
  modified_base (288)..(288): a, c, t, g, unknown or other
  misc_feature (288)..(288): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (445)..(445): a, c, t, g, unknown or other
  misc_feature (445)..(445): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggtttttggggggaagaggaagactgacggtccccccagcagcaacaggtgcccactcccaggttcagctggtgcagtctggagctgaggtgaagaagcctggggcctcagtgaaggtctcctgcaaggcttctggttacacctttaccaactatggtatcaactgggtncgacgacggcccctggacaagggcttggagtggagtgggatggatcgagcgcttaacaataataacacactactatgacacagaacgttcgagggacagatcaccgtcgaccacgacacatccacgancaacncgacctacagtggagttgaggacncgtagagatacgtacgacgacgaccggtccgtagtacttacgtgtgcgaggacgtaacgagtaattagttagtagtacggtactacggtacgggacgacgggtaccgtcgg

SEQ ID NO: 220559 - DNA, 768 bp, Homo sapiens
  misc_feature: GYAE6OF02HZTHJ.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactaggaagaatagtgatgacgcagtctccagcccaccctgtcgtgtcgtcctaccggaaggggaaagacgaccctacccttctccgtgacgacgggccagtcgagtagttgttacgacgagacctaacgttagccgtaggtaccacggacaacggaaccgtcggaccgacggcctacccggaggtcccttcctacgtacttccgtaggtcggtaccgactaccctacccgaccgaccgggacctacggttacgtacctaccggacggtccggacggtacgtaggtcggcggtagggtcgggtacgagggtaacgtaggtaccgttactaccgttacctaccggaacctacgtaaccgacgaccgtacccgtcggtacgtacgttaacggtacgttaacggttaagtttcggtttacgttacggtttaactttttagttacgttagtacgtaacttacttaagttaaccgttacgttaccggtaccgtacccgttcgttaacgggtaccgggttaacggtccggtaaaccggggtacggtaaccgggttaaggtaaccggaaaccgttaacggaaacgttaacgggtcgaccgggtctaccggaaccttacctcggttccttaccgttacg

SEQ ID NO: 220560 - DNA, 704 bp, Homo sapiens
  misc_feature: GYAE6OF02GXJLS.38.22.B11.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (443)..(443): a, c, t, g, unknown or other
  misc_feature (443)..(443): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccaccctctcctgcgagggccagtcagagtgttagcagcaacttgcctggtaccngcagaacctggccaggcctcccgaggctcctcatctagtggtncactccgaccgngggcccacgtggtactcccgagcccgaagggtccaggtggacctgggtcgggtctggggacaggtacgttcacgttcctacaccctagtccgagcccgacggccttacggcctaggttcctaggtaaacgttnttttacggacgtttaagtttttactttcgttacgtacctacgttacgttaactttaccgtaaacgttttcgttacccggtacccgtttacccgtttaaccgggttccgggtaacccggtttaccgggacccggtaaccgggggtaaccgtaacggggttaacggtaaaaccgtttaaccggaaaaccggttaacggtttaccgggtacgggtaccgtttaccggacccgttaaaccgtaccgttcccggtttagttacccg

SEQ ID NO: 220561 - DNA, 671 bp, Homo sapiens
  misc_feature: GYAE6OF02FXGFZ.38.22.B11.1.454.CMB.1.raw
tcagtcgatcacgtcacgaccggtgctcgatttagacgacagctcaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagccgtgggcctcagtgaaggtctctgcaaggcttcgtggttacacctttaaccaactagtggtactcaacgtgggtgcgacacggcccctggacgaagggcttggagtgggagtgggatggatcgagcgtacttaacaaagttaaactaacacgaacaactagtacgacacaagtaacgtacgacgggacgtaagacgtaccgaaccgtcgaacccgaacggaacctacgacctaccgaacgacgaccaacgacgacctaacgtagtaggacgttaggacgggtacgtaccgtaggaacgtacgtacgtacgaaccggaccgtaccgggtaccgttagttaccgttacgtcggtcgacgggaacggtagtacgtaagtaacgtttaagttaacggttacggtacggtacgttacgggtaccggggtaaccggtaaccgggtaacccggttcggtaccgtacccgttacccg

SEQ ID NO: 220562 - DNA, 708 bp, Homo sapiens
  misc_feature: GYAE6OF02HRKC1.38.22.B11.1.454.CMB.1.raw
  modified_base (159)..(159): a, c, t, g, unknown or other
  misc_feature (159)..(159): n is a, c, g, or t
tcagtcgatcacgtcacgaccggtgctcgatttagacgacagctcagggggacccaaaaaccacacccctaccttacgggagaatcccccttagatcacagcctcctcaccagtaggactggacctggagcagtccttttcgtggtgcagcagcaacgnggtgcccactcccaggttcagctggtcgcgagtcgtgggagtcgtaggaggtggaagaaggccgtgggcctacgaggtcgaaggtcctccgtgcgaaggtcttcgtacggttaccacccgtttaaccaacttagtcggtactacctaacgttcgggtacgaccgtacgaccggtaccccgtaggacgtaacgggtcttacggaggtcggagtcgggagtggatcgagcgtacttaacgaaataactaaccgactacgtaactagtacgactaacgtagtaacgtaccgaggacgaaggtacgtaccgaaccggtacgaccgaacggaccaactaacgtaccgaacgaacgcaacgacgtactaacgacgtaggagttaggacggtacgcgtgaagtcgtcgacgaccgtacgacggtacgtagttaaccgttacgtacggtcgacgtagtaacgtagaaggtaacgtttagtttacggttaagtcggttaaccgttagggtaccggtaaccgtaacgggttacccgtaggtacccgtaaccggttcccg

SEQ ID NO: 220563 - DNA, 791 bp, Homo sapiens
  misc_feature: GYAE6OF02F26BF.38.22.B11.1.454.CMB.1.raw
  modified_base (206)..(206): a, c, t, g, unknown or other
  misc_feature (206)..(206): n is a, c, g, or t
tcagtcgatcacgtcacgaccggtgctcgattttagacgacagctcgagggggaggaactgctcagttaggacccagacggaaccatggaagccccagcgcagcttctcttcctcctgctactctggctcccagactaccactggagaaatgtgatgacgcagtctccagccaccctgtctggtcgtccgtaccgaggggaaaacncgcccaccctctcctgccacgggccagtcagtagtcgttagcagacaacgttagcctggtaccagccgaagaaccctggaccagggcctaccccgaggcccttccgtacacttcgttaacgtggtactaccgaacttccccgaaccgtacggggccctacggttacgggtactaccccgacggcccgtaaggggtccaaggttcgggcgtaagggttcggggttaccgtacggggaactaggttacgtttacccgtaaccgtttccgtaacccaaccgtacgttccgacggtaccgtaacggtcccgttcggaccttacggttaccgtagggttaaacgttttacgttttacggtaccgttttaagttttttaccgttttacgttaacggttaccgtaggtaccgtttaacttttaaaccgttaacgttttacgttcccgttaccgttaccggttacggttacggttaacccggtttccgggaaccggttaacgggtaccgtaagggtaacgtaaccgttaaccgaaaccgttacgtacggtaccgtacgtaccgtaccgaaccgttacgttcttacgttacccg

SEQ ID NO: 220564 - DNA, 674 bp, Homo sapiens
  misc_feature: GYAE6OF02GSRBB.38.22.B11.1.454.CMB.1.raw
  modified_base (493)..(493): a, c, t, g, unknown or other
  misc_feature (493)..(493): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttcttggtggcagcagcaacaggtgcccactcccaggttcagctggtgcagtctggagctggaggtgaagaagccgtggggcctcgagtgaaggtctcctgcaaggcttcgtggttacacctttacaactagtggtatacaacgtgggtgcgacacggcccctggacgaagggtcttaggagtggagtgggatgggactcgaggccgtacttaacaaagtaaactaaccactacaatagtacgacacgtaagtacgttcgaaggtcaggacgtacgaccgtcgaacccgtacggaacacgactaccgacgaacgccaacgacgacctaacgagttacgggagttaggacggtacgtccgtagganacgttacgacggacctaccggaaccggtccgttaaggttacttacggtcgtaacggtacgtagtaacgttagaacgttaagtttaggttaaggttaacgtaacgggaaccgttaacggggtaccggggtaaccgggtaacccggttaacccggttccgggttacccgtaccgttacccccg

SEQ ID NO: 220565 - DNA, 658 bp, Homo sapiens
  misc_feature: GYAE6OF02HZSOZ.38.22.B11.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (460)..(460): a, c, t, g, unknown or other
  misc_feature (460)..(460): n is a, c, g, or t
tcagtcgatcacgtcacgaccggtgctcgatttagacgacagctcagggtcttcgtggctcacgtccaccaccacgcatgtgacctcgaggggtccgggagatcatggagggtgtccttggggttttgggggaagaggaagactgacggtcccccagcagcaacgaggtcgcccactcccaggttcagcgtggtgcagtcgtggagctggaggtgaagagcgtgggcctnagtgagtctcngacagtctcgtggtacaccttacaatgtggtatcaagtgggtcgacgacgacggtcccgtaggaacgaacggtcgttaggaaggttcggagttgggagttacggactacgagtccgactttaacaaattaaacaacgacaactactagcgactaacgaaggtaacgtccgaggaactagacgtcgaaccgtcgaaccacggacacgtactacgaacganaccaacgacgaccctaagagttaggtagttaggaacggtaccgtcgtaacggtacgtaccgttacgtacggaaccgtaaccggtaccggtaccgttagttaccttacggttagccgacggtacgtaacgtaacgtaacgtaagttattacggtaagtcggtaacgtcggtaacggggacccttaacgggaccgtacgg

SEQ ID NO: 220566 - DNA, 554 bp, Homo sapiens
  misc_feature: GYAE6OF02IE1LW.38.22.B11.1.454.CMB.1.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcaagaaacctggccaggcctccgaggcctcctcatcctatggtgcatccaccgngggcccagtggtactcccgaggccggggtcaggtggcaggtgggcgtgggacagacgttcactctcacatcagcngcctgcngtctagtaagtntttgacttagttttacttcgtgtcagtctaattacaagtttcgcgtccttcgtacgtcggtaccgttcggaccgaggggtacctaagggtacgtaaacgtaccaaacggtacgtggtacgtcgtcgaccaccgtatcgttcgttacctacg

SEQ ID NO: 220567 - DNA, 591 bp, Homo sapiens
  misc_feature: GYAE6OF02FUAXI.38.22.B11.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctgcaggctcccagctcctnatctatggtgcatccaccagggccatggtatcccagccagggtcagtggcagtggtctgggacagagttcactctcaccatcagcagcctgcagtctagaagtagttttgacttagtttatttctagtctaacgtctaatttactaaatttacctcggtcccttaccgttaacggttcggtaaccggtttccgggacccgtaacgggggtaccgtaaagggtaacgggtaaaacttaaccgtaaaacggtaacgttacggttacgggtaccgttacggaaccgtaaccgtacgttaccgttaggttacccg

SEQ ID NO: 220568 - DNA, 761 bp, Homo sapiens
  misc_feature: GYAE6OF02HVJ1D.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggagccccagcgcagcttctcttcctcctgctactctggctcccagataccactggagaaatagtgatgacgcagtctccagccaccctgtctgtgtctccgaggggaaagngcccaccctctcctgcagggccagtcagtagtgttagcagcaacttagcctaggtaccagcaagaaaccctggaccaggcctcccaggcctcctcatctagtggtcgctactccgaccgagggccctacgtcggttactccccgaagccccgaggggttaccaggtcggcgtagggttcggggtctacggggactacggtacgtttccaccgttctaccgaacctacgtacgaacgtcgtacgccgtaggaccgtagttacgtaggtaaacggtttactttttacgacgttttaaggttttttactttacggtttacgttaaccgtacggtaacctttaacgtttaaccgtttaaacgtttaccgtttaccgggttacccctttaccggttaaccgggttaccggggtttaacccggtttaccggggacccggttaaccggggggtaacccgttaacggggtaaccgggtaaaacgttaaacccggaaaccggttaaaccggttaggtaacggtaccgttacggtaccccgtaaccgttacggtttacccgtggttttaacccg

SEQ ID NO: 220569 - DNA, 769 bp, Homo sapiens
  misc_feature: GYAE6OF02G8LL4.38.22.B11.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaangcccacctctcctgcgagggccagtcaggagtgttagcagctaacttacggcctggaccagacaacgaaaccgtcggccgacggtcctacccgnggtcctcctctactctaggtggtcgacctacgtcccgaacggtacggcctacgttcggtactccccgaaggtcccgtagggtccgtacggtacggccgtagggttacggggttcgacggggtacgtaaggttaccgttcgtaacttcccgtacaacccgtacgtacgtacggacctacggtcccgtaggccgtaaggtttcgaaaggttaacgtttagtttttccggacgttttaacgtttttaacgtttccgttacgtcgttaacgtaacttaactttaacgtaaactttcccggttacggttaacccctttaccggttacgggttccggggttaaacgtcccgggttaacgggtaacccggggtaacgggttaacggggtaacggtaaaccgtaaaaccggtaacggttaaacggtaccggtaggtacccgttaacgacccggttaccgtaacgttttccgtaccgtttaaccgg

SEQ ID NO: 220570 - DNA, 597 bp, Homo sapiens
  misc_feature: GYAE6OF02FNGBI.38.22.B11.1.454.CMB.1.raw
  modified_base (430)..(430): a, c, t, g, unknown or other
  misc_feature (430)..(430): n is a, c, g, or t
  modified_base (476)..(476): a, c, t, g, unknown or other
  misc_feature (476)..(476): n is a, c, g, or t
tcagtcgatcacgtcacgaccggtgctcgatttagacgacagctcaggggacccaaaaaaccacacccctccttgggagaatcccctagatcacagctcctcaccatggactggacctggagcatccttttcttggtggcagcagcaacaggtgcccactcccaggttcagctggtgcagtctggagctgaggtgaagagccgtggggcctcaggtgaacggtctcctgcaaggcttcgtggttaccacctttaccaactagtgtatcaacgtgggtacgcgacacggccccgtggacgaacgggtcttgaggtggagtggggactggatcgagtcgtacttaacaataactaacactactactatcgacgacgagtaacgtccgaaggacacgtacgtcgaccgtagaccgacggacacactacacgancacgactctactacgtagtagtaggaggcgacgtgacgtagtacgngtacgacgtacgtccgtagttacttacggtcgacgtacgagtagacgtagtaagttagtgttaacgtacggttactcggtacgggaccgtacgggtaaccgtcggtaccgtaccgtacccg

SEQ ID NO: 220571 - DNA, 666 bp, Homo sapiens
  misc_feature: GYAE6OF02H0LA9.38.22.B11.1.454.CMB.1.raw
  modified_base (233)..(233): a, c, t, g, unknown or other
  misc_feature (233)..(233): n is a, c, g, or t
  modified_base (309)..(309): a, c, t, g, unknown or other
  misc_feature (309)..(309): n is a, c, g, or t
  modified_base (462)..(462): a, c, t, g, unknown or other
  misc_feature (462)..(462): n is a, c, g, or t
  modified_base (482)..(482): a, c, t, g, unknown or other
  misc_feature (482)..(482): n is a, c, g, or t
  modified_base (511)..(511): a, c, t, g, unknown or other
  misc_feature (511)..(511): n is a, c, g, or t
  modified_base (540)..(540): a, c, t, g, unknown or other
  misc_feature (540)..(540): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccacctgtctgtgtctccgaaggggaaagacgccctaccctctcctgccagggccagtccgagngtaggttagaccaggaccaacttcgcctggtacccaggcaacgaaacctcggaccacggcctcgaacggcctcctntaatcttagtgtacgaccagtcccctacgacgggccctaacgtcggtaactccccaaggcccgaggggtacctagggtcggaccgtagggttcgggttcgacggggaactaggtacgttcgaacttcctacaccagtcacgactacgccggtntacgagttcgtagaacgttnttagccgttaatttttctagttcgtaagnttaaccgtattaaacctacgtttcggacncccgttacgttacggtccgggttaccgtccgggtaaccgaacgggggttacctaagggtaaccgattaaccgaaaggtaccggttagtccgggaatcccggaataccggtacttggttaccgttac

SEQ ID NO: 220572 - DNA, 938 bp, Homo sapiens
  misc_feature: GYAE6OF02IFO6I.38.22.B11.1.454.CMB.1.raw
tcagtcgatcacgtcacgaccggtgctcgatttagacgacagctcagggtcttcgtggctcacgtccaccaccacgcatgtgacctcaggggtccggagatcatgagggtgtccttggggtttgggggaagaggaagactgacggtccccccagcagcaacaggtcgcccactcccgaggttcagctggtgcagccgtggagcgtggaggtagaaggaacgtccgtcggggcctcgaggtaggaacggtctccgtaggacgtaacggtctttacgttacggttacctaaccttttaaccgaacgttagtacggttactaccgtaacggttcgggtcgtaccggtaaccgaccgggtcccccgttagggaacccggtaagggtccgttaggtacggggttaggtacggttacggggtacgttagggtaccgttcggtaacggtaccgttaaccgttaaaacgtaaaacgtaaaacgtaacccgaaccgtaactaaccgttagaccggtaaccgaacgttaaacggttaaccggttaaccggacggggtaaccgttaaacggtaccgggttacccgtaaacccgggtttaaccggaaacccgtaacccgggtaacctaaaccgtaacccgtaacccccggtaaacggaccggtaacccgaaaccggtaacccgtaacccgttaaccggtaacgggttacgggtaacgggttaccgggaaccgggtaccgttacccggtaaggtaaaccgttaccgttaacgggaaccggaacccgtaaccgggtaaccgggttcctttaacgggttaaactccgggttagtaccgggtagggtaaccgttaacgtaacgttaaggtaaacgttttcggttaacgttaacggttacgggtaaccggttaccgggtaacgggtaaccggttaccgggttacccgttaccggg

SEQ ID NO: 220573 - DNA, 883 bp, Homo sapiens
  misc_feature: GYAE6OF02JB9UU.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaanacgccacccttctcctgcgacgggccaggtcagacgttgttacgcaaggcctaaacttacggccttcgggtaacccagaccgtaacgaaacccgtcggacccgaacgggcccttaccccgaagggtccttcccgtacgtacttaccgttaagtcgggttacgacctaccgtacccgaacccggtacggggtacccctaacggttacggttaacctacccccgaacggtcccggtaaacggggtaccaagggttaccgggaccggtacggggtttacgggtccgggtttacggggaacgtaacgggttacgtttacccgaaccgtttaccgtaacccgtacccgtaacgttacccgtaacggacccgtaacggtacccgttacggtacccgtacggttacccgttaaggtaacgtttacggtttttacggaccgttttaacgtttttacgtttacggttaccgttacgtacttaaccggttaacgtttaaccgttaacgttaccgttccggttaaccccttaccggttaccggttaccgggttacggttacccgggtacgggttaacccgggtaccggttaaacgggtaaccgggttaaaccgttaaccggtaaaccggttaacgttacggttacggtacccggttacgtaacccgtaacgtacccgttaccgtttaccgttacccg

SEQ ID NO: 220574 - DNA, 648 bp, Homo sapiens
  misc_feature: GYAE6OF02IXZ1G.38.22.B11.1.454.CMB.1.raw
  modified_base (196)..(196): a, c, t, g, unknown or other
  misc_feature (196)..(196): n is a, c, g, or t
  modified_base (469)..(469): a, c, t, g, unknown or other
  misc_feature (469)..(469): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaancgccaccctctcctgcagggccagtcagagtgtagcagctaactagcctaggtaccagcaacgaacctggacccaggcctcccgaggtcctccctcacttacctagttcgggtgacctacgtacccgaaccggacggggcccaacgttcgggttactccccggaggcccggtaggggtccaggtcgggacgtagggtcggggtctaggggaactaggtacgttccacttcctaccgacctatcgacgaccgagcctgctagtctaagtagttntttgcttagttttattctgtacacgtactattaactaactttacgtcggtacccttcgtacgtcgggtacggttaccggaccgtaacggggtacgtaagggtaacggtaaacgttaaccgaaaccggtaagttcgggtaggtacgtcgaaccgtaaccgtacttaccggtcgtttaacc

SEQ ID NO: 220575 - DNA, 700 bp, Homo sapiens
  misc_feature: GYAE6OF02IN397.38.22.B11.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
tcagtcgatcacgtcacgaccggtgctcgatttagacgacagctcagggggaggaactgctcagttaggacccagacggaaccatggaagcccagcgcagcttctcttcctctgctactctggctcccagatacactggagaaatagtgatgacgcagtctccagcctacctgtctgtctctcgagggaacncgcctaccctcncctgcgacgggtcagtcagngttgtagcagctaattcgccgtggtaaccngacgaacggaaaccgtcggaccaggtccgttaccgacggtccttaccgactactctaagtcggtcacacgtaccaaccggagggacctacgttcggtaacctccccgaacggccgtaagggtcctaagggtcgccgtagggtcgggttcacggggaactagttacggtccacgttccgaaccacgtacgtacgaacgcgtaacggtctaacgtcgtacgtaccgtaaggttaaccgttgtttacggtacgtttaaggttttactttccggtagtacgttaacggtactttaacgttaaacttaccgttacgttccggtacgttacccgtaggttaccggtaccgttcggaaccgggtacggtaccggtaagtaacggtaaacgtacgtaaacggtaccggttaggttaaccgacgtactaacgaccggtattacgttccgttaacc

SEQ ID NO: 220576 - DNA, 646 bp, Homo sapiens
  misc_feature: GYAE6OF02JQK54.38.22.B11.1.454.CMB.1.raw
  modified_base (154)..(154): a, c, t, g, unknown or other
  misc_feature (154)..(154): n is a, c, g, or t
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (361)..(361): a, c, t, g, unknown or other
  misc_feature (361)..(361): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
tcagtcgatcacgtcacgaccggtgctcgatttagacgacagctcgaggggacccaaaaaccacacccctcttgggagaactcccctagatcacagcctcctcaccagtggactggacctggagcactccttttcttggtggcagcagcaaccnggtgcccactcccaggttcagctggtcgcagtctggagcgtgaggtgaacgaggccgtgggcctcagtgacgtcgtctgcagctcgtgttacncttacatatgtactcacgtggtnacgacaccggcctgacgaggtctggagtacgtagtaggcgtagacgtgacggtctacgttaagaaactaacgtacactacgtactaacgtnacgacgtagacgttaccgaggaacgaccgtaacgtcccgaactacgaaccgtacgaccacgtaactcgacgacgtaaccacgggactacgtagtcgtaagnggtaccggngacccttaggcctaagtcgtaccgaggaacgcgtaacgtcgtaagtagttacgtgtagcccgggtaagtaaccgtaggttaagaacccggttcgtttgtaaccggtagtaaccccggttaggaccccgggttacgtaccggtttaaccggcccggtttaaccgcccgtttaacgg

SEQ ID NO: 220577 - DNA, 583 bp, Homo sapiens
  misc_feature: GYAE6OF02JXLBS.38.22.B11.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (468)..(468): a, c, t, g, unknown or other
  misc_feature (468)..(468): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtcccccagcagcaacaggtgcccactcccaggttcagctggtgcagtctgganctgaggtgaagaagccgtggggcctcaggtgaaggtctcctgcaaggcttcgtggttacacctttaccaactatggtatcaactgggtncgacacggcccctggacaagggtcttggagtggatgggatggatcgagcgcttacgaataataacacacatangacanagaagtcagggcaggacgtcaccgtgaccacggacacactaccgacgacgacacacgacctacgtagtacggagttacggaggactccgtagagcttacgngacgacgaccggtcgttacgtacttacgtgtacgacgaagtacgtaagacgtaattagtttaggttaagtacggtaccgtacgttcgggggaaccgtacgggtacccgttacggg

SEQ ID NO: 220578 - DNA, 790 bp, Homo sapiens
  misc_feature: GYAE6OF02JJIQZ.38.22.B11.1.454.CMB.1.raw
  modified_base (193)..(193): a, c, t, g, unknown or other
  misc_feature (193)..(193): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaatagtgatgacgcagtctccagccacctgtctgtgtctcgaggggaanacgtccacctctcctgcagggccagtcagtagtgtagcagcaacgttagccttggtaccagaccgtaacgaaaccgttggaccgaagggtcccctaccccggtaagggtcccttaccccgtactaacgtttcccgttaagtcgggttccgacctaaccgttcccaaacccgggacggggcccccttaaggtttaccgggtaaccttcccccggaaacggcccgttaaggggtcctaagggtcgggaccgttagggtcggggtttacgagggtaaccctagggtaacctttcccgaccttccgtaccgaacccgtcgtacgaccgggactaaccgggtccttcgggtaccgtacggttcttaagggttaaacgtttcttttacgggaccttttaaggttttttacttaccgtgttacgtactaccgtttaacgttaactaaacgttttcgtaccggtcccgttaaccgttaggttacccgggtccgtttaccgggacggttaccgggtaaccgtaacgggttacgtaaacccgttagaaaaccggttcgtacggtaccggtctaacccggtatcccgtaccttacggttccttacccg

SEQ ID NO: 220579 - DNA, 1006 bp, Homo sapiens
  misc_feature: GYAE6OF02GKW0S.38.22.B11.1.454.CMB.1.raw
  modified_base (144)..(144): a, c, t, g, unknown or other
  misc_feature (144)..(144): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactgganaaatgtgatgacgcagtctccagccacctgtctgtgtcctccgaaggggaaacgagcccaccctctcctgacgacgggccagtcagtagtcgttagcacgtcaacgttacgccgtaggtaaccagacctaacgtaaacccgtcgggaccccaaggggtccccttacccccggaacgggtcccttacccttaccgtaacgttacccgttaagggttccggggttaccggaacccttaacccgtttacccccggaaaccccgggaccgggggtaaccccctaaccggttttaccgggggttaaccccttacccccgggaacggggaccccggttaaacgggggtccgtaacgggttacgggggtaccctaacgggggttccgggggttaccggtaacggggggtaaacctacgggtttaaacccggtttcccgaaacccggtttccgtaaccccgtaaacccgtacgttacccgaaggtacccgtaccgggtccttacggaccgttacgtaccggttaacggttaaacgtttacgttttacgggtaccgttttaagggtttttaaccttttaccggtcgttaaccgtaccgtttaaacgttaccgtttaaaacgttacggtttacccggtacccgggttaccccgttttaacgggttaacccggttacggggttaacccgggtttacccgggtaacccggggttaacccggggggtaacggttaaaccggggtttaaacccggtaaaacggttaaaaccccgggttaaaccgggtaaaccggttcggggtttaacccggtaacccgtaccgggttaacctaaccccggttttaaacgtttcccggttaacccggtttaccccgg

SEQ ID NO: 220580 - DNA, 642 bp, Homo sapiens
  misc_feature: GYAE6OF02GVAB8.38.22.B11.1.454.CMB.1.raw
  modified_base (168)..(168): a, c, t, g, unknown or other
  misc_feature (168)..(168): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
tcagtcgatcacgtcacgaccggtgctcgatttagacgacagctcagggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtcggagtcgtgggggagcgtggtccagccgtggggacgtccctgagacctctcctgtgcagcctgtggattcactttcgagttagttagtggcagttcgctacgtgggtcccncgaggtcctccgaggtcgaaggggctgggagtgggnacgtacgttatattanatggataggaaacttaatagaaacttcgtaagngactaaggtccttaccggaggaaaccgggtccgtaattacgagttacctacgttccgtaccgaagtaacgtaacctaaacgttaccgaaacgtaaccgaacgttcgttacgttactacgtaacgaactaaagtagaacttacgcgttagacgttagtacggaagtaccgtacgtagttacgtagttaacttacgtagttccgacgtaccgttaccggtaaccggtaaaggtttcgttaacgtagttaacgg

SEQ ID NO: 220581 - DNA, 711 bp, Homo sapiens
  misc_feature: GYAE6OF02FYUOS.38.22.B11.1.454.CMB.1.raw
  modified_base (352)..(352): a, c, t, g, unknown or other
  misc_feature (352)..(352): n is a, c, g, or t
tcagtcgatcacgtcacgaccggtgctcgatttagacgacagctcaggggacccaaaaaaccacacccctccttgggagaatcccctagatcacagctcctcaccatggactggacctggagcattcctttttcttggtggcagcagcaacaggtgcccactcccaggttcagctggtgcagtctggagctgaggtgaagagccgtgggcctcgagtgaggttctcctagaaggtcttcgtacgttacctacctttaacctaacttagtgttatacgaacgtggtgcgacgacggtccccgtaggacgagggtcttaggtaggtggagtgggatggatcgagcgtacttaanaataactaacacaacactagtcgacagtaacgtaagttccgaaggcgagtacgtacgacgtacgaaccgtaacgacctaacgacgtacccgaacgaccgaccgaactaccgtaccgtaacgtacgggttacggtaaggttacggaacgggaccggttacgtacggtacgtacgttaccggtacggaaccgacggtacccggttacggtacgttttaacgtaccggttggtaccgcggtaaagtacgttaaccgtagttaagtttcgtttaaggtatttaccggggtaacccgttacgggtaccggggtaccgtaaccggggtacccgttcgggtacccgttcccggtacccgttacccg

SEQ ID NO: 220582 - DNA, 723 bp, Homo sapiens
  misc_feature: GYAE6OF02FUXWW.38.22.B11.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (429)..(429): a, c, t, g, unknown or other
  misc_feature (429)..(429): n is a, c, g, or t
  modified_base (485)..(485): a, c, t, g, unknown or other
  misc_feature (485)..(485): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatggacgcagtctccagccaccctgtctgtgtctccgaggggaaancgccaccctntccgtgcagggccagtcagtgtcgttagcagctaacttacgccgtaggtaccaggtaccaacggaaacccgttcggacccgtaggacccttcccccgaagggtcccttaccctacgtaacgttcctaaggtttcggtacgcctaactccccgaaccgtacgggaccctagttcggtacttcccgagcccgaagggttccaggtggctagggtcggtacgnggtacaggtacgttactctccgtactactactacgacgcgacgtcctagctacgtntacgtaacgtttactttggacgtttacgttttacttgttacgtacgacttactagtttaactaacggtttcgtccggttacccgtttacgtaaccggttacgggttcccggttaacgggtacccgggtaacggggttaccggaaacgggtttaccgtaaaaccggtaccggtaaaaccgttcgtacgggttacgtccgttacggtaccctaacggtccgtaccgttacgtttaccccg

SEQ ID NO: 220583 - DNA, 730 bp, Homo sapiens
  misc_feature: GYAE6OF02HQIAP.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttggggttttggggggaagagggaagactgacgggtccccccagcagcaacaggtgcccactcccaggttcagctggtgcagtctggagctgaggtagaagaagccgtgggcctcagtgaacggtctccgtgacgaagcttctggttacctacctttaaccaactactaggtatactaacgtggtcgacgacgacggtcccgtaggaacgaacgggtcttaggaggtaggtaggtacgggagtacggtagtcgtacggcgtacttaaacgaaaattaaactaaactaactaacctaactaatcgacaactaaggtaacgttcgacgggtacgaagtacgtaccgaaccgtcgaaccgaacggacacgaacgtacccaaggacgaccaacgacgacctaacgagtcggggtaacggttaggaccgggtaacgtacggtagtaaggtccttaccggaggtaccgacgggtaacccggtcggttaacgtacttacggttgtacggacggtagtaacgtacggtaaggttaaacttacggttttaacgtcgggtttaggtaacccggttaccgggggttaccgggtaacccgggtaaccggggtaacccttcccggggg

SEQ ID NO: 220584 - DNA, 630 bp, Homo sapiens
  misc_feature: GYAE6OF02IIKAH.38.22.B11.1.454.CMB.1.raw
  modified_base (346)..(346): a, c, t, g, unknown or other
  misc_feature (346)..(346): n is a, c, g, or t
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagtcgatcacgtcacgaccggtgctcgatttagacgacagctcaggggacccaaaaaacccacacccctccttgggagaatcccctagatcacagcctcctcaccatggactggacctggagctattccttttcttggtggcagcagcaacaggtgcccactcccaggttcagctggtgcagtctggagctgaggtagaagaagccgtggggcctcgagtgaagtctctgacaaggtcttcgtgttaactcctttaaccaactagtgtatacaagtggtagcggacacggacccctggacgtaaggtctgagtcggtagtgggagtggatcgacgcgtactaanaaataataaacaacacaatagcgcaacagtaacgtacgaacggcaagtacgtacaccgtanaccgaacgacacacaccaacgacgtaaccaagaccacaagagtaggtacgttaggaggtacncgtaganatacgagtacgaacgtacgaccttagtagttaccgtgtacgaggtaagtacgaacgtaagtaacgttagtttaaggttaactcgggaaacgttaccggtacggggtaacccgtaaccgggttaaccgtaacgggttacccaacccggttacccc

SEQ ID NO: 220585 - DNA, 855 bp, Homo sapiens
  misc_feature: GYAE6OF02HQG7H.38.22.B11.1.454.CMB.1.raw
  modified_base (163)..(163): a, c, t, g, unknown or other
  misc_feature (163)..(163): n is a, c, g, or t
  modified_base (206)..(206): a, c, t, g, unknown or other
  misc_feature (206)..(206): n is a, c, g, or t
tcagtcgatcacgtcacgaccggtgctcgatttagacgacagctcagggggaggaactgctcagttaggacccagacggaaccatggaagccccagcgcagcttctcttcctcctgcctactctggcctcccagactaccactggaagaaatagtgatgacgnagtcctcagccaccctgtctgtcgtctacgaaggggaaacgcnccctaccgtctcgtagcgacgggaccaggtacaggtagttaggtacgctaacgactaaacgttcgtaccgtacggtaaccaaggtacctaaacggaaacccgtgggaacccctacgggtcccttaccccgaaggttcccttacccactaacgttaccctaagtccgggtacactaacgtacccgaaccgtacgggacctacggttacggtaacctaccggacggtacccggtaaacgggtcgtaaccgggttcgggaacgttaacggggttgggggtacgtaccgggggtaaactaacgggttaacggtttaccctaacccgttacccgtaaccgaaaccgttacgaaccgtacggtaccgtaacggtaccggtaccgtacggtaacgttacggtaacgttaaaggttacttttagaacgtttaacgttttacgttacgttacggtacgtaacgttacttaacgtttaaaccttaaattaccggtaccgtacccgttaacgttaccgggttcggtaacccggttaccggtaccggtaaacgggtaaccggtaacggttaaaccgggaaacgttaaaccggaaacgtaaccggttacgggtaccgtacgggtaacgaaccgttaccgttaacgttccggtttactaaccg

SEQ ID NO: 220586 - DNA, 621 bp, Homo sapiens
  misc_feature: GYAE6OF02JXV0H.38.22.B11.1.454.CMB.1.raw
  modified_base (459)..(459): a, c, t, g, unknown or other
  misc_feature (459)..(459): n is a, c, g, or t
tcagtcgatcacgtcacgaccggtgctcgatttagacgacagctcagggtcttcgtggctcacgtccaccaccacgcatgtgacctcagggtccgggagatcatgagggtgtccttgggtttgggggagaggaagactgacggtcccccagcagcaacaggtgcccactcccaggttcagctggtgccagtctggagctgaggtgaagagccgtggggcctcagtgaacggtctccgtgcaaggcttcgtggttacacctttaccaactataggtatacaagtggtagcgtacacggcccctggacgaaggtcgttgaggtaggagtgggagtggatcgaggcgtacgttacaactaaactaacgaacaacagtaactcgacacaagaacgttaccgagggtacagtacgtccgacgttcgacgtaacggacacataccaacgacacacgacgacctancgtaggtcgtaggacggacgaccgtagacggtacacgtacggacgaaccgacggtaccgttacgtagttacgaggtaccgacggaagtacggtaacgtaacgtaagttacgttaagttagtacggtacgtcgtaccggggaccgtaacgggtaccgtacggg

SEQ ID NO: 220587 - DNA, 728 bp, Homo sapiens
  misc_feature: GYAE6OF02G7X8B.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatggacgcagtctccagccaccctgtctgtgtctccgaggggaaagacgccaccctctcctgcgagggccagtcagtagtgtagcagctaactagccgtggtaccagcagaaacctcggaccgacggcctacccgaggcctcctacgctactagtggtacgcctaactcccaaccggacgggaccctacggtacggtaacctccccgaggtacccgtaggggtacctaacgggttcggaccgtaggggttccgggttacggtacggggaaccgtaaggtaacgttccgtaccttcctaacccgtaaccgtataccggaagacccgtacggtaccgttacggacgtaacggttcgtaaggtaaagtttacgtttttaggacctttaagtttttacgtttcgtacgtcgtagtacttaaacgttacgtaaacttttaccgcggttacctacccggttaagttcgggtaccggttaccgggacgtaacggggtaccctaaagggggtaccgtaaaacgtaaccggaaacggtaccgttcggtaggtaccctagaccctaattaacctcgtactttcccg

SEQ ID NO: 220588 - DNA, 764 bp, Homo sapiens
  misc_feature: GYAE6OF02HOFU2.38.22.B11.1.454.CMB.1.raw
  modified_base (131)..(131): a, c, t, g, unknown or other
  misc_feature (131)..(131): n is a, c, g, or t
  modified_base (311)..(311): a, c, t, g, unknown or other
  misc_feature (311)..(311): n is a, c, g, or t
  modified_base (433)..(433): a, c, t, g, unknown or other
  misc_feature (433)..(433): n is a, c, g, or t
tcagtcgatcacgtcacgaccggtgctcgatttagacgacagctcaggggaggaactgctcagttaggacccagacggaaccatggaagccccagcgcagcttctcttcctcctgcgtactctggctccanataccacgtggagaactagtgatgacgccacgtctccagcctaccctgtcctgtagtctccgaaggggaacagcccaaccctctcctgcgagggaccagtccagacgtgttacgacagtactaacttagcctaggtaaccaggccaagaaccgtggaccaggcctccgaggcctccgtanattctagtggtcgctatcccgacgacgggcctagtggtacctcccgagaccgtagggtacacggtggacctaggtcggggttctagggaacaggtacgtttaccacgttcctccgtaaaccncgttaccgacggtaccgtaacgtccccgtacgggacctaaacggttccgttaaaggttacggttaactttttacggccgttttaaacgtttttacttttaccgttaggttaccgtaagttaccgttaactttaacctaaagttttaccgtacgttaccccgttaccgtttaccggggttaacggtaccccgggttaccgggaaccggtaacgggggtaacccggttaagggtaaacgggtaaaacccgtaaccggtaaacgggtaaccgtttacggggtaccggtaccgttacggaacccgtaccgttaacggtcgttaccgtttacccgg

SEQ ID NO: 220589 - DNA, 805 bp, Homo sapiens
  misc_feature: GYAE6OF02GTWXS.38.22.B11.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (609)..(609): a, c, t, g, unknown or other
  misc_feature (609)..(609): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacccgtgtctgtgtctccgaggggaaangccaccctctcctgcagggccagtcagagtgtancagcaacttagcctggtaccagcaagaaacctggccagggcctacccgaggtcctcctcattccgttaagtcgggttcncctaacgtcccgaaccgtacggggcccctaacggtggttaacctcccccgtaggcccgtaaggggtccaagggtcggaccgagggttcggggtcgtaggggactagggtaacttccgaaccttcctaccgaaccctaagtttccgaaggacccgacggtccccgttacggtaaccgtaagtttcccgtaagggaaaccgtttaatttttaccgggaccttttaaagtttttaccgttttccggttaaggtcccgtaaaggtacccttaaacttttaaacccgaagtttttaaccccgngggttaacccccttaccggtttaacccggggtaccgggttaaccccgggttttaccgggacccgggttaacggggtaacccaaagggggttaaccggtaaaacgtaacccgttaaaaacccggggaacttttccgggacggttaaccgttaccgggaaccccgtaacccgttaacgtttcccgttaggtttccccg

SEQ ID NO: 220590 - DNA, 697 bp, Homo sapiens
  misc_feature: GYAE6OF02GX8T2.38.22.B11.1.454.CMB.1.raw
  modified_base (201)..(201): a, c, t, g, unknown or other
  misc_feature (201)..(201): n is a, c, g, or t
  modified_base (665)..(665): a, c, t, g, unknown or other
  misc_feature (665)..(665): n is a, c, g, or t
  modified_base (687)..(687): a, c, t, g, unknown or other
  misc_feature (687)..(687): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctcccagataccactggaagaaatagtgatgacgcagtctcccagcccaccctgtctgtcgtctccgagggaaanacgccaccctctcctggccagggccagtcgaagtagtcgttagcgagacctaaacgttcgcccgttacggtaccaggtaccaacggaaaaccgtcggacccacggccctacccgacggtccctcccgtactacttcgtagtggtacgcctacgtacccgaaccgtacgggtccctaaccgttacggtaccttacccccgaggtacccggtacgggtcgtacggtggaccggtgggttcgggtcgtacgggacgtaggtaccgttcctaccttcctaccgacctactaccgtagccgtacgtccgtcggactcgtacgtgttaaagttcgttttacgtacgttttacgttttcgttcgttactcgtagtccttaagtacctttaagtttccgtcgttacccttaggttaccgttcgggtaccgtccgggtacgagggtaacctagggtagaaacctagtaacgtntggacgtacgacgtacgtactnttcgtcttcg

SEQ ID NO: 220591 - DNA, 768 bp, Homo sapiens
  misc_feature: GYAE6OF02JBQVK.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccgttggggttttggggggaagaggaagactgaccggtccccccagcagcaacaggtgcccactcccgaggttcagctggtgcagtcgtggagctggaggtgaaggacgccgtggggcctcgagtgaaggtctccgtgacgaggtcttcgtagttacctaccttaaccaattagtggtactacgtagtcgggtcgaccgtacgaccgggtcccgtaggaacggtaggtcgttaggaggttacgggagttcggggagtcggtactcgacggtcgttaaccgttaacaaacgttaaacaaccgtactaacgagtacgtacgtacaacgtaacgttaacgtccgaacgggactacgggtacgtacccgtaccgtacgaaccgtacccggactaacgtaccaacccgacggtaacgtacccaacgtaccgtacctaaggtaacggtacgggtacgttacgggaaccgtcgtaccggtaaggacttaccggtacgtaacgggaacccgtacggtaacccggtgttaacgttacttaacgggccgtagtacccggtaagtaggttaaaccggactttaaaggtttcggttaaacgttccggtaacggtttacccggtaaccgggtacggggaccccggtttaacgggaccccgtttccggg

SEQ ID NO: 220592 - DNA, 798 bp, Homo sapiens
  misc_feature: GYAE6OF02JZAE1.38.22.B11.1.454.CMB.1.raw
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (483)..(483): a, c, t, g, unknown or other
  misc_feature (483)..(483): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagactaccactggaagaatagtgaatggaacgctagtcctaccgagtcccacccgttggtcctaggttgtcctaccggaaggggaaactcgaccctaccctctacccgtggccgaaggggccctaggtacgaacgtagtgttaacggccaaggtactaaccgtttcgccgttacggtaacccngtaaccgaacgtaaccgtcggacctagggtccctaccgaggccttccgtanacgtctaggtcggtcncgtaactccgaacgtcgggacctaggttacgtcgtaccacggacgtacggtacgacgtcgcggtagtcggtacgtaggactacgtgttaccgcgtaccttacnccgttagaccgtaacgccaacgttcgtcccggtaacggtaccgtacgttaaccggtaggtttaccttaggtaccgttttacgtttaccgtttcgtaaccggttcacggttacctttaaaaccgttcggttaaaccgtttcgttacccgggtacccgttaaacgggttaccgggttcgttaaccgggtccgggttaacggttaaccccgggtaaggttaccgtaacgggttaaccggtaaccgtaaccggttaacggttacggtacccggttatacccgggtaccttaaacgggtcgtttacccttgtttaacccg

SEQ ID NO: 220593 - DNA, 708 bp, Homo sapiens
  misc_feature: GYAE6OF02F6IH0.38.22.B11.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtcctcagcccaccctgtctgtntctcgagggaancgcccacctctcgtgcgnggccagtcagtgtgtancgagactacgtcgcctggaccagacaacgaaaccgtggaccagcctcccgaggtcctccgtactattccgtagtcgggtcaccgtactacccgaccggacggtccctacggtcgtacctaccccgaggacccggtagggtccgtaaggtcggacgttaggggttcggttcggtagggaaccgtaaggttaccggttaccgtaccttacccaccaacctagtaccgacgtccgtacgtcgacgtacgtaacgttgtaacggttactttagtttcgtaacgttttgttttacttcgtacgtacgttataccgttaactttaacgtagtttccgacgttacccgtagtaccgggttacgtacccgggttacgggaccgggtaaccgggtagttaaacgggtaaccggtaaagtaacccgttaaaggttcgtaccgggttaccgacctcgggttaacccaacgtttacggttctacgttccc

SEQ ID NO: 220594 - DNA, 691 bp, Homo sapiens
  misc_feature: GYAE6OF02F68SH.38.22.B11.1.454.CMB.1.raw
  modified_base (305)..(305): a, c, t, g, unknown or other
  misc_feature (305)..(305): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagcccaccctctcctgcgagggccagtcgagagtgttagcagctaacttgcctggtaccagacacgaaacctggccaggcctcccgaggcctcctctactcgtagtggngccactcccgaaccgagggcccacgtggtacctaccccgaggacccgtaggggtccaggtcgggacgtacgggtcggggtacgtggggaacgaaggtacggtttccacgttccctaccgtaccacgttccgacgtcgacggcccgttacgccgtaggttaccgtagtaacgtttagttttacgaccgtttaagtttttacgtttacttacggtactaacgtccttaagtttaaccttaaacgttcggtaccgttacccttaccgggttaccgggttacggttacccggtccgggaccgggtaaccggggtacgtaacgggtacgtaacgtaaccgtaaacggtaacgttggtacggtctaccggactacgtcgttacgtgttaccg

SEQ ID NO: 220595 - DNA, 612 bp, Homo sapiens
  misc_feature: GYAE6OF02F8UCL.38.22.B11.1.454.CMB.1.raw
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagcctggggcctcagtgaaggtctcctgcaaggcttctggttaccacctttaccaactatggtatcaacgtgggtncgacacggcccctggacagggcttgagtggagtcgggatggatcgagctacgttaacaaataataaacacacactangacacagtaacgttcagggcagancgaccgtcgaccgtacggacacactaccgacgacgacaccacgacccgaacacgtaggagttagagggactccgtgtaacgacgtacgtcgaacgaccgtaccggccgttagttacttaacgtcggtcgacggaaggtacgtaacgaagttaaacgttagtttacgttaaggtaccggtacgttaccggtacggggacccgtaaccggggtacccttacggg

SEQ ID NO: 220596 - DNA, 717 bp, Homo sapiens
  misc_feature: GYAE6OF02JPFY8.38.22.B11.1.454.CMB.1.raw
  modified_base (204)..(204): a, c, t, g, unknown or other
  misc_feature (204)..(204): n is a, c, g, or t
  modified_base (487)..(487): a, c, t, g, unknown or other
  misc_feature (487)..(487): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctcccagataccactggagaaatagtgatgacgcagtcctccagcccaccctgtctgtgtacctaccgaaggggaaancgccctaccctctccgtgcgaggcctagtcagtagtgtacgctagcctaaacttcgccgtaggtaacccagtaccgaaacgtaaacccgtggacccaacgggtcccttaccccgagggtcccttcccgtacgtaacgttccgtaagtgggtactacctaacgtccccgaaccggacgggccctaacgtcgggtaacctcccgaaggtcccgaggtcaggttcggacgtaggtcgggtacgaggaccgtaagtcgttaccacttccgacaaccacgtgacgacncggtctagcgtaatcgtaagtattacgtttcgagtttagttttaactcgttggtaactggtaactaacgtttaacctagttaccgtcgtaaccgttccggtacgttaccgggtacttaccgggtacgtaacgggtaccgtaaggtacggaaaccttaacgggaaaaccggttcgttacggtaccggtaccgtacgtacccgaaccgtttacttccgggttaaccttaccg

SEQ ID NO: 220597 - DNA, 681 bp, Homo sapiens
  misc_feature: GYAE6OF02IAP30.38.22.B11.1.454.CMB.1.raw
  modified_base (133)..(133): a, c, t, g, unknown or other
  misc_feature (133)..(133): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (471)..(471): a, c, t, g, unknown or other
  misc_feature (471)..(471): n is a, c, g, or t
tcagtcgatcacgtcacgaccggtgctcgattttagacgacagctcaggggacccaaaaaccacacccctccttgggagaatcccctagatcacagctcctcaccatggactggacctggagcattccttttnttggtggcagcagcaacgaggtgaccccactccctaggttccagcgtggtgctagtcgtggagtcgtgaggtgaagagccgtgggcctgagtgaagtctctagacaggcttcgtagttactactttagctagttagtggtntacagtcgtgggngacgacacggccgtagacgaggtntagagtggagtagggatggancgagtctacgtaanaagtagaacaagaatagtacgacaaagtacttaacgttaccgaggaactagtacgtactagtacataccgtacacgaaagacccaaacttcaccgtaacgacgtaccaacgtcgaaccttaacgnggttaaacgtaacgtaccgggaacgtaccgtaaggacttaactaccggacaaccggttaacgacccgtttaaactttaaggttaggttccctttaaggaccggtacgggtaaactaacgttaaaccgtttaactttaccccgttaacgttaaacttacgttaccggtaaacgttcggtaaggttaacggttacggtttcttttaacccgg

SEQ ID NO: 220598 - DNA, 812 bp, Homo sapiens
  misc_feature: GYAE6OF02JOBUT.38.22.B11.1.454.CMB.1.raw
  modified_base (199)..(199): a, c, t, g, unknown or other
  misc_feature (199)..(199): n is a, c, g, or t
  modified_base (380)..(380): a, c, t, g, unknown or other
  misc_feature (380)..(380): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatgtgatgacgcagtctaccagccacctgtctgtcgtcctcgaaggggaaacncgcccaccctcgtcctgacgacgggccagtccagagttcgttagcacgctaaacgttcgccgttacggtaccagacaacggaaacctcggaccacggtcctcccggaacggtcctaccctctacttcttacgtggttcgactacgtcccgaccgacgggcctacgtacggtacctacccgngtaccgtacgggtcgtacggtcgacgtagggtcggtaccggttagggaaccgtaggtacggtttccaaccgttcctaccgtaaccgtaccttacggaacggtacctacggtaccccgtacggtacccgtacggttaccgtaagttaaacgggtttacgtttttaaccgacggtttaacgtttttacgttttccgacggtttaaccgtaggtaaccctttaaacggtttaaacctttaacgtttaacccgggtcggtttaccccgttaccggttacgggttaccgggttaaccggtcccggggttaacccgggtaaccggggttaccgtaaacggggttaccgtaaaacggttaaccccgtaaagggtaacccgttcggggaaccggttcgtaaccgggtaccctaacggtttcttacgttaccggtttaccg

SEQ ID NO: 220599 - DNA, 703 bp, Homo sapiens
  misc_feature: GYAE6OF02GZ8BJ.38.22.B11.1.454.CMB.1.raw
  modified_base (512)..(512): a, c, t, g, unknown or other
  misc_feature (512)..(512): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagccgtggggcctcgagtgaaggtctcctgcaaggtcttctggttacctacctttaccaactatggtactcaacgttgggtgacgacacggccccctagggaaccaaggggtccttaggagttgggaacgttggggatggactcgagtccgtacttaacaaagttaaactaaccgaacaacctaacttaactacgacctaacgaaggtaacgttcccgaaggggaccaaggacgtaccgacccggtacgaacccgtacggaaccaccgtactacccgacgacgaccaccgagaccctanagtgggtacgttaggaacgggtacgtaccgtggaacgtacgtaccgtcggaacccgaaccggccgggtaccgttagttaacgttacggttcggtagtaccgggaagtacggtaacgaaagttaacttagtttaagttaagtcgggttaacctacgggtaccgggggaacccgtacggggtacccttccggg

SEQ ID NO: 220600 - DNA, 779 bp, Homo sapiens
  misc_feature: GYAE6OF02F4X7H.38.22.B11.1.454.CMB.1.raw
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (516)..(516): a, c, t, g, unknown or other
  misc_feature (516)..(516): n is a, c, g, or t
tcagtcgatcacgtcacgaccggtgctcgatttagacgacagctcagggggacccaaaaaccacacccctccttgggagaatcccctagatcacagctcctcaccatggactggacctggagcatccttttctggtggcagcagcaacaggtgcccactcccaggttcagctggtgcagtctggganctggaggtgaagagcctggggcctnagtgaagtctcctggacaggcttcgtacggttacacccttttaccaacttagtggttaatacgaaccgtgggtacggccggaaccgtacgggtaccccccgtgggaaccgtaaggggtccgtttaggacggttacgggtaaggttggggtaagtggggtaactcgacgggccgtaccgtttaaactaaagtaaacttaaccgaacacctaaccgtatacgacaacgtaagtacggtacgagggacagtacgtacgacccggtacgaacccgtaaccgggaccaccgaacgtacccgacgtaacnccgtaacgaaccgcctaacgtacgtaagggtcggtaggacggtacgccgtaggacgtacgttacgtaccgggaacgtaccggaccgggttaccgttaggtttaacgtttaccggttgtacgggaccgttaagtaacggttaccgaagttaacgtttaggtttaaagtttaacgggtaccggttaacgttaccggggttacccggggttaccggtaaacccggggtacccggtttacgggtaccccggttacccggttacccgg

SEQ ID NO: 220601 - DNA, 729 bp, Homo sapiens
  misc_feature: GYAE6OF02I0WNX.38.22.B11.1.454.CMB.1.raw
  modified_base (179)..(179): a, c, t, g, unknown or other
  misc_feature (179)..(179): n is a, c, g, or t
tcagtcgatcacgtcacgaccggtgctcgatttagacgacagctcagggggacccaaaaaccacacccctccttggggagaatccctagatcacagctcctcaccatggactggacctggagcatccttttcttggtggcagcagcaacaggtgcccactcccaggttcagctgggtcncgtagtctggagtctggacggtagaaagaacgccgtggggcctcgagtgacggtctacctgacaaggccttcgtggttacctaccttaaccacttagtaggtactacgaacgtgggtacacgacgacggtccccgtaggacgaaggtcgtaggaggtaggtacgtaggtaggtggtaactgtacggactacttaacgaaacgtaaataaaccactaactactacgtcgacaacgaagtaaccggttcgaacgggtacacggtaagttacccaccggtacggaaccgtaaccggacaaccgtctaacccgaagtcgactacgagttaccgaactaggtacggtaaggttcggaacgacgtctaacggtacgatacgggtacgtaacccggaaccgtaccgggtcgttagtttacttaacgggtcgtacggtagtaacggtacggtaacgttaacggaacgttaggtttaccgtagggtacggtaaccgttacgggtaacccgggggactttaaaccggggaacccgtttcggttaccccggattaccccgg

SEQ ID NO: 220602 - DNA, 830 bp, Homo sapiens
  misc_feature: GYAE6OF02HKB76.38.22.B11.1.454.CMB.1.raw
  modified_base (219)..(219): a, c, t, g, unknown or other
  misc_feature (219)..(219): n is a, c, g, or t
  modified_base (586)..(586): a, c, t, g, unknown or other
  misc_feature (586)..(586): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtcctccgagccaccctgtctgtcgtccgtccgaggggaaagcgcccacccgtctccngcgcgggccagtcgagaggttgttacgcagactaacgttacgccgtacggacctaggaccaacggaaaccgtcgggacccgacggtccccgtaccccgacggtctcccgtacgtactccgtagtcggtacgccaccgtcccgaaccggacggaccttacgtcgtaccgtacccgacggtaccggtacgggtacacgggttcgaccggtacggggtttaggggtaccggtggggaaaccgtacggttaccggttaccttaacccttccgaaccccgtaaccgttacgtaccgacgtaccgaccgtacgcgtaccggtaattaccggtaaacggttagtttacgttttcgtacgttttaaaggtttttntttaacctaggttacccgttgtaaaccgttttaaaccgtttaaactttaacccgtttaccggttacccggttacccctttacccgggttaaaccggggttccggttacccgggttaaccgggtacccggggaaacgggggttaaccggtaacggttaaggaaacccgtttaacccggaaacgggttacgtacgggttaccggtactaccggtaaccgaacttcgtttacccgttcgtttacccg

SEQ ID NO: 220603 - DNA, 645 bp, Homo sapiens
  misc_feature: GYAE6OF02JBNV1.38.22.B11.1.454.CMB.1.raw
  modified_base (403)..(403): a, c, t, g, unknown or other
  misc_feature (403)..(403): n is a, c, g, or t
  modified_base (630)..(630): a, c, t, g, unknown or other
  misc_feature (630)..(630): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctggtgtctccgaggggaacgagcccaccctctcctgcgagggccagtcagagttgttacgcagcaacgttgcctaggtaccagccaacgaaccgtcggaccgacggtaccctcccgaggtcctccctctacttctaggtcgggttcgacctacgtacccaccgacgggcctacgtcggtactaccgacggccgagggtacaggtgtaccgtagggtggtacggngggacaggtacgttcgacgtcctacacctagtcgacgcgtacgccagtctacggcttaagacgttattgctttaacgttttctcgttacgctaacgtcttaactttacgtaactttacggtccgacctttaccgtaaggtccgggttaaccgttcgggacccggttaacggggaccttaaggaccggtaaactaaccggaacgtacggtaggtcgttacgactaccnctacgttactgtacc

SEQ ID NO: 220604 - DNA, 621 bp, Homo sapiens
  misc_feature: GYAE6OF02H73UM.38.22.B11.1.454.CMB.1.raw
  modified_base (283)..(283): a, c, t, g, unknown or other
  misc_feature (283)..(283): n is a, c, g, or t
  modified_base (549)..(549): a, c, t, g, unknown or other
  misc_feature (549)..(549): n is a, c, g, or t
tcagtcgatcacgtcacgaccggtgctcgatttagacgacagctcagggggacccaaaaaaccacacccctccttgggagaatcccctagatcacagctcctcaccatggactggacctggagcattcctttttcttggtggcagcagcaacaggtgcccactcccaggttcagctggtgcagtctggagctgaggtgaagaagccgtgggcctcagtgaagtctctgcagcttcgtggttactaccgtttacaactatggtatacgaacgtggtagccgacncggcccctggaactagggtcttagagtggagtgggtagtggatacgagtcctcgttaaacaaataagtaacacacgactatgacacagacttcgaggactagacgtacgaccgtgaacccgagtaaccacgacgtaccacggagtccaacgtacgcctaagtaacgtacgggtaagtaggtaacggagtccgagtacacgttacgagtaccgacggcggtacgttgtaagttacgtggtacgacgtagtatacgtaataaaggttntttaagttacggtaagtacgttaccgggacggggacctaacgggtacccgtacggttaccgaccttacccgg

SEQ ID NO: 220605 - DNA, 822 bp, Homo sapiens
  misc_feature: GYAE6OF02G6C1N.38.22.B11.1.454.CMB.1.raw
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatgtgatgacgcagtctccagccaccctgtctgtgtctccaggggaagagccgaccctctcctgcgagggccagtacaggagtgttagcgtagacctaacgttagccctggttaacccagacaacgaaacccgtgggacccgaggccctccccgaagggtccctccctcacttcttacgtggtacgccaactccccaaccggtacggtacccaacgttcggtaccttccccgacggaccgtacgggtcgtaggtcggacgtagggttcgggtcgtggggtaacaacggttcggttaccctaacgttccctaaccgtacccgtaagtcccgaacggtcccgaaccggtccctaggtacccgttaacgggttcccgttaaggtaaaccgttttgttttacgtaccgtttttaaacggtttttaccgtttttactcgggtttaacaaccggtttacctttaacggttaaacctttaaacgttttaccgggttacccgtacccggttttacccggttacgggttacggggttaccccggtttaaccggggacccggggttaaccgggggtaacccttaagggggttaaccgtaaaccgttaaaccggtaaacccggttcggtaaccggggtggtaccgtaccggtacccgtaacggttacgtttacgtccctttaacccg

SEQ ID NO: 220606 - DNA, 848 bp, Homo sapiens
  misc_feature: GYAE6OF02F5YPB.38.22.B11.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgacagctcagggggaggaactgctcagttaggacccagacggaaccatggaacgccccagcgcagcttctcttcctcctgctactctggcctcccagactaccactggagaaatagtgatgacgcagtctcagccacctgtctgtcgtctcgaggggaaancgccaccctctcctgcgagggccagtcaggtagtcgttagcagctaaacttgcccttggtaaccagacctaacggaaaccctgggacccaacggggtcccttacccccgaagggtccccttacccctacgtaacttccgttaaggttcggtccgacctacttccccgaaccggtacggggcccaacggttcggtaccttccccgaaggtcccgtagggtccaaggtcggacgtagggttcggggtacctcggggaactacgggtaacgtttcccaacgttacccgtaccgaaccgtaagtccgaacggtaccgacggtccctcggtacgtacggttaccgtaaggttaacggttacgtttttacggaccgttttaacggtttttacttttaccggttacgttaccgttaaggttacccgtttaaacgtttaaaccgttaaaccggttttcccggttacggttaccccgtttaaccgggttaacccgggttacgggttaacccgggtttaacccgggaccggggttaaaccggggtacggttaaacgggttaacggggtaaaccttaaaccggtaaaaaccgggtccgttaacgggtacggtacccgttacgggtaccctaccgtaaccggtttccgttaccggttaaccc

SEQ ID NO: 220607 - DNA, 777 bp, Homo sapiens
  misc_feature: GYAE6OF02JVHXD.38.22.B11.1.454.CMB.1.raw
  modified_base (147)..(147): a, c, t, g, unknown or other
  misc_feature (147)..(147): n is a, c, g, or t
  modified_base (174)..(174): a, c, t, g, unknown or other
  misc_feature (174)..(174): n is a, c, g, or t
  modified_base (207)..(207): a, c, t, g, unknown or other
  misc_feature (207)..(207): n is a, c, g, or t
  modified_base (278)..(278): a, c, t, g, unknown or other
  misc_feature (278)..(278): n is a, c, g, or t
tcagtcgatcacgtcacgaccggtgctcgatttagacgacagctcagggggaggaactgctcagttaggacccagacggaaccatggaagccccagcgcagcttctcttcctcctgcttactctggctcccagactaccactggaanaaatagtgatgacgactagtcctaccncgcctacctgtctgtcgtcctcggaaggggaancgccaccctctccgtgcgacgggcacggtcgaagtagttcgtagcagtactaactcggtcctacggtaccngacaacggaaccgtcggccacggtccccgtaccgacggtctacccgtacgacttaccggtgtcggtcaccgtaccttacccgaccgacggtcctacgttaccgtacctaccgaccgaccggttacgacgtacggacggtccgtagggtcggtggtcggtacgagtacgttcctaacgtccgttaccaccgtactaaccgtacgacgtcccgtcgacgttcggtacttacggtaacgttacggttaaggttaccgtttaacgtacggtttttacgttactttaccggttactaaccgttacttaaacgttaacttaccgttaccggtttaccgttaccggttaccggttaaccggttccggtaaacccgggttacggtacccgggttaaccgggggacgttaacggggttaaacgtaaaccggttaaccgtaaacgttaaccgggttaacggaccgtaacggttaccggtccaacggtttccgttcgttaccgttacccg

SEQ ID NO: 220608 - DNA, 766 bp, Homo sapiens
  misc_feature: GYAE6OF02F8PER.38.22.B11.1.454.CMB.1.raw
  modified_base (200)..(200): a, c, t, g, unknown or other
  misc_feature (200)..(200): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgagtgacgcagtctccagccaccctgtctgtgtctacgaaggggaaanacgcccaaccctctcctgcgacgggccagtcagagtcgtagcacgactaaacgttacgccgtacggtaaccaggaccaacggaaaacccgtgggaccccaacgggtccctaccccgaaggtcccttaccctactaattaccgtagttcggtacaccctaagttaccccaacggaacgggtacccctacggtacggttaacctccccgtaaggacccggtaacgggttcaacgggtcgggaccgtacgggtttggggtacctacggggaactacggttaacgttcctaacttcccgtaactaaccagtacacgaccgtacgccgttaacggctaacgtacgtaaggtaacgtttatttacggtctttaacgttttagttttacgtacgtacgtactaacgttaagttaaaccgttaacgtttaacgtcgttacccgttacgtaacggttcggttacgttaccggacgggtaaccgggtaacgttaacggtaacgggtaaacgttaaacaaaccggtaaggttcggtacgtacgttacgaccgtaactacgttcgttaacgttacccg

SEQ ID NO: 220609 - DNA, 938 bp, Homo sapiens
  misc_feature: GYAE6OF02ITC0T.38.22.B11.1.454.CMB.1.raw
tcagtcgatcacgtcacgaccggtgctcgatttagacgacagctcaggggtcttcgtggctcacgtccacaccacgcatgtgacctcaggggtccgggagatcatgagggtgtccgttggggttttggggggaagaggaagacgtaggaccggtccccccaggccagcaacaggtcgcccactcccaggttccagcgtggtagcagtctggagctggacggtaggaagtaacggccgtcggggacctacgacggttacggaacggttccttaccgtaggaccgtaacggtccttacgttacgggttaaccctaccctttaaccaacgttagtacgggttactaccgtaaaccggttggggttacaccgtaaccggaccgggtacccccgtagggtaaccgtaacggggtccgttttaagggaacgggttaggggaccggttaggggggtaacgttacggggaaccgttccgaacgggttaccccggttaacttaaaaccgtaaaggtaaaaccttaaacccgaccgtaaaccgtaaacgtacgttacgaaccgtaaacggtaacggttaaaccggttacccggaaggggtaccaaacgggtacctaacccggtacccggtaggaaaccccggtaacggtaaccctaaccgaaccgtacccggaaaccgtacggaaccgtaacggtaacccgtaacccgtaacggtaaacggttacggggttaaacgttaaccggggtacgggtaaccgtaccggtaaggtaccgtaagtacccgggtacggaaacccggaaccgggtaacccggttccgttaagttacccgttaacggtacgggttaccggaggttaaacgtacggtaaacctaggtaacttaacggtacgttaaggtcggtaacgttacggtaccggggtaccgttaaccgggtaccgttacccggg

SEQ ID NO: 220610 - DNA, 782 bp, Homo sapiens
  misc_feature: GYAE6OF02H8FEU.38.22.B11.1.454.CMB.1.raw
  modified_base (222)..(222): a, c, t, g, unknown or other
  misc_feature (222)..(222): n is a, c, g, or t
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
tcagtcgatcacgtcacgaccggtgctcgattttagacgacagctcaggggacccaaaaaccacacccctcttgggagaatcccctagatcacagctcctcaccatggactggacctggagcattccttttcttggtggcagcagcaacgaggtcgcccactcccgtaggttcagcgttggtgctgtctggagtctggaggtagaagacggccgtgggcctnagtcggaagtctctgacgacggtcttcgtcgttactaaccgtttaacaacttagttacgtatactaacggtgggtagacggtaccgaccggtcccgtaggaacggtacggtcgttaacgggnggttaggaggttgggagtacggaatcgacgtcgaactttaanaaactaacgtaacctaacactactagtacgactaagtaagtacgtacgaaggcaacggcgtaccaaccggtcaaccggaccgaacacgacctacgaccgtaagaccacgtacacctacgtaggtgggtaggttacgaggtacgttacggagtaacgtcgtaacgccgtaaaccgaaccgggtccgttacggtaacggtttacgtttacggttacggtacggacgtttaacgggtaacggtaacgtttaacgtttaaaggttcggttttaaccggttaacggtaaccgggtttaaccggtaaccgggggtttccggggaaaacccgggggtttaacccccgggggtttaaccgggtttccccggttttaaaaccccgggccccgttttaaccccggg

SEQ ID NO: 220611 - DNA, 789 bp, Homo sapiens
  misc_feature: GYAE6OF02JUBZY.38.22.B11.1.454.CMB.1.raw
  modified_base (146)..(146): a, c, t, g, unknown or other
  misc_feature (146)..(146): n is a, c, g, or t
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (509)..(509): a, c, t, g, unknown or other
  misc_feature (509)..(509): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggcctcccagataccactggaanaaatagtgatgacgcagtctccagcctaccctgtctgtgtcaccgaaggggaanacgcccctacctctctcgacgacgggtcacgtagagngttagtagcgagtaccgtaagttccgcgttacggaccaggacgaaaccgtaacggtcggccgacgtcccgcccgtcggccctctactaccgtattaggtcggcgtattaccccgggggaaaccgaccgggtaccctagggttaccggtaaccccaccggaccggtaaccgggtccgtaggttcggccgtaacggggtttcgggttccgggttacgggaacggacgttaccggttacttaacccgtcttaccggacccttaacgcgtaaccgngaacccggtccgttacccggtcggtacttaacggttactaaaggtaaccgttttaggtttacgttaaccgttttaaggtttttccttacgtcgtaacccggtatacgtttaaaccgttacttaaacgttccgtccgtaccggtttaaccgtgggtacgttacgggacccgtaacggggggttaccgaacggttacggtaaaccgtaaggaacccccggttaaaggtcgtttaccgggaacgtttccggagtaacccttaggttcttccgtacgtttaccc

SEQ ID NO: 220612 - DNA, 605 bp, Homo sapiens
  misc_feature: GYAE6OF02GRB63.38.22.B11.1.454.CMB.1.raw
  modified_base (226)..(226): a, c, t, g, unknown or other
  misc_feature (226)..(226): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagagccgtggggcctnagtgaaggtctcctgcaaggcttctggttacacctttaccaactatggtatcaacgtgggtcgcgacgacggcccccgtggaaccaagggcttaggaggtggagtgggatggactcgagcgacttaacaagttaactaacgacactactatagaccaatagtaacgttccgaagggcaaggacgtccgaccgtgaaccgacggaccacgtacgtaccaacggacgacaaccgacgccctaacgagttggagttaggaggcgcgtaggagtactgtacgacggacgaccggtcgtagtactcgtgtgagtaggagtacgagtaattagttacgtagtacggtaccttacgggtacgggaccgtaacgggtaccgtaccgg

SEQ ID NO: 220613 - DNA, 710 bp, Homo sapiens
  misc_feature: GYAE6OF02FXC2C.38.22.B11.1.454.CMB.1.raw
  modified_base (187)..(187): a, c, t, g, unknown or other
  misc_feature (187)..(187): n is a, c, g, or t
tcagtcgatcacgtcacgaccggtgctcgatttagacgacagctcagggggacccaaaaaaccacacccctccttgggagaatcccctagatcacagctcctcaccatggactggacctggagcatccttttcttggtggcagcagcaacaggtgcccactcccaggttcagctggtgcagtctggngctggaggtgaagagccgtgggcctgagtgaaggtctccgtgacgaggtcttcgtggttacctaccgtttaaccaacttagtggttatcaacgtgggtcgacgacgacggcccctaggacgaagggtccttaggaggtgggagtgggtagtggactcggagcgtacttaagaataaagtacacactatagtacgacgtaacgaacgtaacgttaccggagggacacggtacgtaccgaacccggtacggaaccgaaccgggactaacgtaccgtaaccgaccgacgtcaaaccgaccgtacctaacgtaggtaggtacggttaaggaacggtacggtccgaaggtacgtaacgttcggaacgggtaccgaaccgggttaccggtaccggtttaggttaacttcggtcgttaacggacgtaacggtacgtacgtaagtaagtttaggtttaagtacggtaacgttacgttacggggttacggaaccgggtaaccggtaccggttcggtaccgtaccgttcccgg

SEQ ID NO: 220614 - DNA, 729 bp, Homo sapiens
  misc_feature: GYAE6OF02JEK3Z.38.22.B11.1.454.CMB.1.raw
  modified_base (200)..(200): a, c, t, g, unknown or other
  misc_feature (200)..(200): n is a, c, g, or t
  modified_base (316)..(316): a, c, t, g, unknown or other
  misc_feature (316)..(316): n is a, c, g, or t
  modified_base (366)..(366): a, c, t, g, unknown or other
  misc_feature (366)..(366): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgcagtctgganctgaggtgaagaagcctggggcctactaggtgaacggttcctccgtagcgaaggtcctttcgtacggttacctaaccccttttaccaacttagtcggtaatccgaaacgtggggtnacgacgacggcccctaggacgaagggtcttggagtcgggagtgggatggntaccgaggtcgtactaaaccaattaactaaacgactaacacgtaagtacgactaagtaacggtaacgttaccgagggactacggaacggtcccgtaaccgggtacgaacccgtaaccggaacctaacccgtaacgtacccgaaacggacgacccgaaccgaccgtaacccgtaacgtacggttaacgggtaggtttacgggacggaccgtaccggtaggtaagtacgtacgttacggaccggtaaccggtaccggtaccgttaggtactttaccggtagtacgtaggtaacgacgtaagtaacgtaacgttattacgttaaggtcgtactacgggacgggtaccggtaccggtacccgtacgg

SEQ ID NO: 220615 - DNA, 788 bp, Homo sapiens
  misc_feature: GYAE6OF02GITFE.38.22.B11.1.454.CMB.1.raw
  modified_base (206)..(206): a, c, t, g, unknown or other
  misc_feature (206)..(206): n is a, c, g, or t
  modified_base (397)..(397): a, c, t, g, unknown or other
  misc_feature (397)..(397): n is a, c, g, or t
tcagtcgatcacgtcacgaccggtgctcgatttagacgacagctcagggggaggaactgctcagttaggacccagacggaaccatggaagccccagcgcagcttctcttcctcctgcctactctggcctcccagatacccactggagaaactagtgatcgacgcacgtctccagccaccctgtctagtgtcctccgagggtaaacncgccctaccctctccctgccgtacgggcctaggtccagtacgttcggttaacgctaacggctaaacgttacgcccgttagggtacccagtcaacggtaaacctcgggaccacggcctaccccgaggcccttaccgtcgtaacttcgtatgggtccacgactcccgaaccgacggtcctaacgttggtaccnccgtacgacccgtaggtcacgtcggaccgttaaggtcgggtcctagggaacctagggtcgtccctaccgttacacctaaccgacgttccaaggtaccgactccccggtagcgttaacggtacttacggtaacgttcttttaacggtactttacgttttaacttttccgggccttaaccgaccgtactttaaccgttaaacgttaaccgtttacccggttcggtaaccccctttaacgggtacccggtttacggtaccccggtttaaaccggggaccgttaacccggggaacggttaagggtaaccggtaaacttaacccggaaaggttaacccgttacggggcgtaaccgttccgtaaccccttaaccgtctttaccggtctttaacccgg

SEQ ID NO: 220616 - DNA, 640 bp, Homo sapiens
  misc_feature: GYAE6OF02IIABH.38.22.B11.1.454.CMB.1.raw
  modified_base (310)..(310): a, c, t, g, unknown or other
  misc_feature (310)..(310): n is a, c, g, or t
  modified_base (502)..(502): a, c, t, g, unknown or other
  misc_feature (502)..(502): n is a, c, g, or t
tcagtcgatcacgtcacgaccggtgctcgatttagacgacagctcagggggacccaaaaaaccacacccctccttgggacgaatcccctagatcacagctcctcaccatggactggacctgggagcaatcctttttcttggtggcagcagcaacaggtgcccgactcccaggttcacgctggtgcagtcgtaggagctgaggtgaagaacgcctggggcctcgagtggaaggttccttccgtcgacgaacgggtcttcgttacggttactaaccctttacaactagtggttatcaacgtgggtgcgtacncggcccgtaggacgaagggccttgacggtggtaggtgggagtcggactcgaaggtcgtacttaacgaaactaacgtaacacaacgtatatcgacagaacgtagtccgagacgagcgtacacgtcaccgtacgacgtcactcgaacgacgcacacgacactaggtcgtagttacgaacggcgtcgttagacgntacgtacgaacgtacgacggcgtagttatttgacgtacgagtagtagtaccgtaaggtaacttcggttagttacgttacgtaacggtaccggtacgggaaccgttaaccgggtccctacgggttacccaccgttaccg

SEQ ID NO: 220617 - DNA, 745 bp, Homo sapiens
  misc_feature: GYAE6OF02HVPK2.38.22.B11.1.454.CMB.1.raw
  modified_base (155)..(155): a, c, t, g, unknown or other
  misc_feature (155)..(155): n is a, c, g, or t
  modified_base (518)..(518): a, c, t, g, unknown or other
  misc_feature (518)..(518): n is a, c, g, or t
  modified_base (639)..(639): a, c, t, g, unknown or other
  misc_feature (639)..(639): n is a, c, g, or t
  modified_base (659)..(659): a, c, t, g, unknown or other
  misc_feature (659)..(659): n is a, c, g, or t
tcagtcgatcacgtcacgaccggtgctcgatttagacgacagctcaggggacccaaaaaccacacccctccttgggagaatcccctagatcacagctcctcaccatggactggacctggagcattccttttctggtggcagcagcaacgaggtcncccactcccaggttcagcgtgtgctagtctggatctaggtaggtagaagaagccgtagggcctgagtgaacgtctccgagacgaggtcttacgtacggttactacttaaccgatagtagtactactaacggtggtacgacgtaaccgacgacccgtaggacgtaggtcttaggtacggtaggaagtcggtagtacggatccgacgtaccgtaacgttaactaaataaaccgtaaccgaactaaccgtagttaaccgacgtacccgtaaagtaacgggtaaacgttccgaaacgggttacgaacggttactaccggtaccgacgtaacccgaacggtacctaaaccaccgtaccgacggtaacnccgtaacgcgtaaccagtaacgttagggtagacgggtacgaacgtcgagtaataccgtctaacgggaaccgtaccgtaccgggtagttacgttaacttcggtaagacggtaacgaagtaanaaccggttaattaacggttnttaacgggttaacggacggttaaccggtacgggtaccggggtaaccgtaacccgggttaccgttacggtaccccgtacgttacccg

SEQ ID NO: 220618 - DNA, 728 bp, Homo sapiens
  misc_feature: GYAE6OF02JFKR5.38.22.B11.1.454.CMB.1.raw
  modified_base (209)..(209): a, c, t, g, unknown or other
  misc_feature (209)..(209): n is a, c, g, or t
  modified_base (416)..(416): a, c, t, g, unknown or other
  misc_feature (416)..(416): n is a, c, g, or t
tcagtcgatcacgtcacgaccggtgctcgatttagacgacagctcagggggaggaactgctcagttaggacccagacggaaccatggaacgccccagcgacagcttctcttcctctgctactctgctccagactaccactggagaaactaggtgatgacgctacgtcctccgaacgccaccttgtctggtcgtctaccgaaggggaaancgccacccttctccgtgcgacgggcctaggtcaaggtgttacgttacgactacgctaaccgttacggtcctaggtacctaaggacaacggtaaccgtcggaccgacggtacctaccccgacggtccttactctacgttcgttagtggtacgcactccgaccgaccgggtctaacggtacgtacctccgtaacggccgtagggtacgnggtcgggacgtttacggggtacggtacgggttaggaacgtacgttaaccggttaccctaccgttacgacccggttaacacggttccgacgtcgaaccggtcgcgttacgacggtctaaggttaactcgtttagcctttacgtttactttcgtacgtacgtacattaaaccgttatacgttacgtaccgttccgtaacggttacgtacgggtacggtcggtaccggtaccgggtaagacggttaacggtaactaaccggtaaccggtcgttagggacacgtccgtaccaacgttacgttacgtcgtttaaccg

SEQ ID NO: 220619 - DNA, 779 bp, Homo sapiens
  misc_feature: GYAE6OF02GMF3L.38.22.B11.1.454.CMB.1.raw
  modified_base (197)..(197): a, c, t, g, unknown or other
  misc_feature (197)..(197): n is a, c, g, or t
  modified_base (512)..(512): a, c, t, g, unknown or other
  misc_feature (512)..(512): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagactaccactggagaaatagtgatgacgcagtctccagccaccctgtctgtgtctcgaaggggaanacgccaccctctcctgcgagggccagtcagtagtgttagcagcctaacttgaccgtggtaaccagacgaacgtaaaccctgggcccaggtccctacccgaggtccttacccgctacttccgtaggtcgggtacgtctaacgtccccgaaccggaccggtaccctaccggttaacggtaccctacccccgaacggggtccccgtaagggggtaccacgggttacgggacggtacgggttcgggggttaccgtacgggggaaactaagggtaccggtttaccaccgttctaccgacctacgtcaacggcacgtccgngtcgtagtacgtaaggtaacgtttacttttgacctttaagttttactttcgtacgttactagttaccttaattaaaccgtaacgtttaccgtcccggttacccttacggttaccggttaccggtacccggtttaccgggaaccggttaaccggggtaccgttaaaacggggtaccgtaaaaccggttaaccgtaaaaccgggttaaccgttagggtaaccggtacgtaccggtaacctaaaccggtcttaccggttcgttaacccgg

SEQ ID NO: 220620 - DNA, 886 bp, Homo sapiens
  misc_feature: GYAE6OF02H25FR.38.22.B11.1.454.CMB.1.raw
  modified_base (225)..(225): a, c, t, g, unknown or other
  misc_feature (225)..(225): n is a, c, g, or t
tcagtcgatcacgtcacgaccggtgctcgatttagacgacagctcagggggaggaactgctcagttacggacccagacggaaccatcggaacgccccagccgcacgcttctcttcctcctgctactctcggctcccagactacccgactgggacgaaactacggtcgaactcggaccgcgagtcctccagcccaccctgtcctgtcgtcctaccgaggggaaacncgccaccttcgcctggccaggggcctagtaccgaggtacggttggttaacgccgaagtacccgtaaagtttaccggccgttaacgggtaacccacggtaccgaaaacggtaaacccgtcggggacccctaacggggtccccttacccggaagggtcccttacccggtacctacgttacccggttaagttcgggtacctaccaccgttccccggaacggtaccgggaccccttaggtaccgggtaacctccccggaaggtcccggtaagggttccaggtccgggtacgtacgggttcggggtccgtaacggggaactacgggttccttaaccgaccgttccgtaccgaacctacggtaccgtacggtcctaccggtccgttacgaccgtacgttaccgtaaggtaacgtttcgttttcggaacgttttacggttttactttacggtacgttacgtacgtaacctttaacgttaaccgttaacgtttcccggtaccggtacccgtttaccggttacgggtaccgggttaccggtaccgggtaaccggtaacgggggtaacccgttaaggggttaaccggaaacgttacccggtaaaacggtccgggtttaacggcggttaccgtacggtacccgtaccgttacggtccccgtttaggtacccc

SEQ ID NO: 220621 - DNA, 757 bp, Homo sapiens
  misc_feature: GYAE6OF02G5PXH.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcgacgggccagtcagagtgttagcagacaacttagcctggtaccagcaagaacctggccaggcctacccgaggcctccctcattctagtggtcgctactcccgaccgacgggcctacgtggtacctcccgagcccgaggtcaggtcggctaggtcgggtctggggaactaggtacgtttccaccgttcctaccaaccctatccgacggacccgtacgtcccgttagacgtaacggttacctaagggtaaacgtttagtttttaccggacgttttaacggttttttactttaccgttacggttacctacggtaacctttaacgtttaaaccgttaaacgttttcccgttaccggttacccccgtttacccggttaacggggttccggggttaaacccggttacccggggacccgggttaaaccgggggggtacccgttaaagggggttaaccggtaaaaaccgttacccggaaaaacgggttaccggttagggtaccggtaccgtacggtacctaccccggttaagtttccgttaccggtttacc

SEQ ID NO: 220622 - DNA, 752 bp, Homo sapiens
  misc_feature: GYAE6OF02FPH9H.38.22.B11.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatgtgatgacgcagtctccagccaccctgtctgtgtctccgaggggaaancgccaccctctcctgcgacgggccagtcagagtgttagcagctaacgttagccttaggtaccagcaaggaaaccctgggaccctaggccctacccgaggtcctcccgtacacgttacctaggtcggtcgccaaccgtcccgaaccggtacgggtaccctacggttcggtaaccncccggacggacccgtagggttccgtaggtacggcgtacgggttcggtcggtagggaacgtacgtacgttaccaccgtcctaaccgacctagttccacgtcgacggtccgtacgtacgacgttaccgtaaggtaacgtttagtttcgtagttttaacgtttacgttttcgtaccgttgtacgttaacttaagtttaaccttaacgtttacgtcccggttacccttaccggttacgggttacggttacccggttaaccgggaccgggtaaccggggtaccggttaaagggttaaccggtaaacggtaaaccgtaaaccgggtaggttaaccgggtacggtaccgtacggtaccccttaaggtcccttacgtttaccggttaccg

SEQ ID NO: 220623 - DNA, 617 bp, Homo sapiens
  misc_feature: GYAE6OF02JYLHW.38.22.B11.1.454.CMB.1.raw
  modified_base (227)..(227): a, c, t, g, unknown or other
  misc_feature (227)..(227): n is a, c, g, or t
  modified_base (334)..(334): a, c, t, g, unknown or other
  misc_feature (334)..(334): n is a, c, g, or t
  modified_base (569)..(569): a, c, t, g, unknown or other
  misc_feature (569)..(569): n is a, c, g, or t
tcagtcgatcacgtcacgaccggtgctcgatttagacgacagctcagggtcttcgtggctcacgtccaccaccacgcatgtgacctcaggggtccgggagatcatgagggtgtccttgggttttggggggaagaggaagactgacggtccccccagcagcaacaggtcgcccactcccgaggttcagctggtgcagtctggagctgaggtgaagagccgtgggcctnaggtgacggtctccgtgacgaaggtccttcgtaggttacctacctttaaccaactagtggtatacgaacgtgggtgccgacgaccggcccgtggaacgtaacgggtnttggaggtggagtgggatggatcgagtcgtactaacaataaactaacacacactagcgtacaacgagtaacggtcgaagggtacacggtacgtaccgacgtacgaaccgaccggacaaccgtacgtacccgacgaacgaccaacgtacgtaccacgtggtacggtagtacggacggacgtcgagtacagtcgagacgccgtacgggtactagttatcgtagtcgacgagagtaanagttatagttatagacggtacgtggtaggaccggtacggccgttacgg

SEQ ID NO: 220624 - DNA, 767 bp, Homo sapiens
  misc_feature: GYAE6OF02I5UI7.38.22.B11.1.454.CMB.1.raw
  modified_base (701)..(701): a, c, t, g, unknown or other
  misc_feature (701)..(701): n is a, c, g, or t
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtcgatgacgctagtctcagcctacctgtctgtgtcctaccgaaggggaaatcgccaacccgtctaccgtagacgacgggaccagtacgagtagtgttacgactaggactaaacgttagaccgttaggtaccgaagaccaacggaaaccgttcggaccgtaaacgggcctacccgtaacgggccttaccctacgtaacttcgtaagtcggtagacctaacggttacccaacggtacgggaccctaacgttacgggttacacccccggtaaggacccggtaaacggggttaccaaacggtttcgggaacgtaacgggttacggggtacttaggggaactaggttacgtactacctacgtacaaccgaattcgacgtacgacgtactacgtacgacgtagtacgtaacgttattacgacgttagtttacgttacgttacgtacgtacgtactaacgttaacgtaactttaacgtaccgtaaccgttaccgttaaccggtacggttaaccggtaccggtaacggtaccggtaacggtaacgggttaaacggaancgtaaacggtaaaccgtaacggtacggtacggtacggtaaccgtaccgtaaccgtacgtacgtacg

SEQ ID NO: 220625 - DNA, 672 bp, Homo sapiens
  misc_feature: GYAE6OF02H21ZD.38.22.B11.1.454.CMB.1.raw
  modified_base (361)..(361): a, c, t, g, unknown or other
  misc_feature (361)..(361): n is a, c, g, or t
tcagtcgatcacgtcacgaccggtgctcgatttagacgacagctcaggggacccaaaaaccacacccctccttgggagaatcccctagatcacagctcctcaccatggactggacctggagcattcctttttcttggtggcagcagcaacaggtgcccactcccaggttcagctggtgcagtcgtggagctgaggtgaagaaggccgtggggcctcgaggtggaaggtctccgtgacgaaggtcttcgtggttaacctacctttaacaacttagtggtactcgaacgtgggtgcgacgacggcccctaggaaccgtaagggcgttagaggtggagtgggagtggatcgaggcgtacttaanaacgtaaataacgacaacaactacgtacgctaacgaaggtaacgttccggaacggactaagacgtacgacgtacgaacccgaggaaccacacgtccaacggacgacaacgtacgaccgtaacaggtcggagttacggaggtaccacgtaggatacgtacgtaggaaccgtacgaccgggtacgttggtaactttcgtggtacgacgaaggttaccgaacgtagttaagtggtttacggttaacgtacggtaccgttacgggacggggtaccgtaaccgggttacccgtggttaccccgtcccgtttaccgg

SEQ ID NO: 220626 - DNA, 826 bp, Homo sapiens
  misc_feature: GYAE6OF02GUHC3.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatgagggtgtccttgggttttgggggaagaggaagactgacggtccccccagcagcaacaggtgcccactcccaggttcagctggtgctagtctggagctggaggtgaagaagccgtggggcctcgagtgaacggtctccgtgacgaaggtcttcgtcggttacctacccgtttaaccaacttagttaggtataccgtaaacgttggggtacgaccggaacgtacgggttacccccgtgggaaccgtaaggggtcctttagggaggttggtaacggttgggggtaagtagggtacgtacgaacgggcgttaaccgtttaacgtaaattaaaacgtaaccgtaacctaacctaacttaacgtacggtactaacgaacggtaaacggttaccggaacggggtacaaacgggtaccgtaccgtaacccggtaccggaccggtaacccgggtaaccacccgaaccgttaacccgaaccggtacgaaccgtaaccgacgtaaccccttaacgaacggttacgggttaaccggttagggtaacgggtacggtaccgttacgggaacgttacgtacgtaacgggacccgtaacgggacccgggtacgggttacgttacgtttacgtacggtacgtaccggaagtaaccggtactaaaggttacttacgttaggttaacgttacggtacgttacgggtcggggtacccggtaccgggtacccgttcccggg

SEQ ID NO: 220627 - DNA, 610 bp, Homo sapiens
  misc_feature: GYAE6OF02FUKS0.38.22.B11.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (332)..(332): a, c, t, g, unknown or other
  misc_feature (332)..(332): n is a, c, g, or t
  modified_base (375)..(375): a, c, t, g, unknown or other
  misc_feature (375)..(375): n is a, c, g, or t
  modified_base (447)..(447): a, c, t, g, unknown or other
  misc_feature (447)..(447): n is a, c, g, or t
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgtagcagcaattagcctggtaccagcaagaacctggccaggcctccgaggctccncatctatggtgctatccacgngggcctacgtcgtactcccgagccgnggtcaggtcggcgtaggtcgggtcgtgggaactagtacgttcncttccgtacctaaccataccagcgaccgtcctaggctacgtcgtagtaagttgttttcgactttaggttttntttcgttgtactgtacgttaacttaacttaaactttcgtccggtacccttaccggttagttccggtaccggttcggacccgtagggaaccgtaggtaacggtaaactaccggtaacgtaacgtggtacggtacgtcgtaaccgacgtcttacgtagtttaccg

SEQ ID NO: 220628 - DNA, 731 bp, Homo sapiens
  misc_feature: GYAE6OF02J14DB.38.22.B11.1.454.CMB.1.raw
  modified_base (587)..(587): a, c, t, g, unknown or other
  misc_feature (587)..(587): n is a, c, g, or t
  modified_base (679)..(679): a, c, t, g, unknown or other
  misc_feature (679)..(679): n is a, c, g, or t
tcagtcgatcacgtcacgaccggtgctcgatttagacgacagctcagggggaggaactgctcagttaggacccagacggaaccatggaacgccccagcgcagcttctcttcctcctgctactctggcctcccagataccacgtggagaaatgtgatgacgcagtctccagcctacctgtctgtcgtcgtaccgaggggtaaacgcgcccaccctctccgtgcgaggccagtcgagtagttgtagctagtactaacgttcgccgtggtaaccaggtccaaagtaacccgtggaaccacggccctcccgacggttcctaccgttacacgtttacgtgtcggttcgacctaccggtacccgaccggtaccgggtacctacgggttaaccggtaccttaccccgggaaacggtccgggtaccggggtttaccgaagggttccggggtaccgtttagggggttccccggggttagaacggggaaccttacggtaaccttccggtacccttaccgtaaccgaccgtacgtccgtaacgacccgtcgtaccgtgtacgtgtacgtaacgttagttacttgtactttgtttacgntacgtgaacgtattactaattcgtaccgttccgttcgtacgttcggacgttccgacggtaccggtacgtagacggttagaaccttaaccgtntaaccggttacgtactccgtacggttacctcggtactttaggtaccttaccg

SEQ ID NO: 220629 - DNA, 881 bp, Homo sapiens
  misc_feature: GYAE6OF02G6IFV.38.22.B11.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctccagataccactggaagaaatagtgatgacgcagtctccagcccacctgtctgtgtctacgaaggggaancgccaccctctccgtcgccgacggaccaggtccgagtagttcgttacgacgaacgtccaaacgttacgtccgttacggaaccgtagaccgtaaacggtaaaccgttccgggacccgaccgggtaccctaccccggtacgggtcccttccccgtaacgttacgttaaccggttacggttacgggtaccgtaaccaacccggttaccccgaaaacccgggtacccgggtacccgttaaccggttaccgggttaaccccgttaccccggaaaccgggtaaccccggtaacgggggtttaccggaaacggggttaccgggtaccggttaacgggggttcgggggtaaccgggttaacggggtaacggtaacgggttaccggttttacccgaaaccgttttcccaaccggaaacccctttacggtaccgaacggtaccctaccggtaccgtgtaccggtacgtagttacggttaaacgttttcgtttaggttacttttaacggttttgttaaccgttcgtttaacgaccgttacctaaagtttaccttaacgttcgttaccggtaccttacggttacgggttaccggtacggttcccgggaagtacgggtaaccggaggtaaccggaacgtaaccaaggttacgtggacgtaccgttcggaaccgttacgtacggttacttcgtaaccc

SEQ ID NO: 220630 - DNA, 946 bp, Homo sapiens
  misc_feature: GYAE6OF02GGQQL.38.22.B11.1.454.CMB.1.raw
  modified_base (131)..(131): a, c, t, g, unknown or other
  misc_feature (131)..(131): n is a, c, g, or t
tcagtcgatcacgtcacgaccggtgctcgatttagacgacagctcaggggacccaaaaaccacacccctccttgggagaatcccctagatcacagctcctcaccatggactggacctggagcatccttttnttggtggcagcagcaacaggtgcccactcccaggttcagctggtgcagtctggacgctaggaggtgaagaagccgtggggcctcgagtagaaggtctcctgaccaaggtccttcgttacggttaccaccttttaaccgaaactttacgtaggttacttacgaacgttcggggtacgccggtacgacgggtaccccccgttagggtaaaccgtaacgggggtaccgtttaggtaagggttacggggtaacggttagggggttacggttacggggtaagttacccggtaaggacccgggtaccgtttaaaaccgtaaaacgtttaaaacgttaaaaccgaaccgtaaacccgtaaccttaagttacgacccgtaaacgtaacgggtaaaccggtttaccggaacggggaacgtaaggtaaccgtaccgtacccggttacggaacccgaaccgggtaacctaaccgtaactaacccgaacggtaacgtaccgaaaccgacgtaacccgtaacgtaacggttgggtaacggtttagggaacgggtaacgtcccggtaacggtacgtaacggttcgttaaccgtaaccggtaacccggtacccgggtacccgggtttaagggtttaacccgtttaacccgggttacggtaacgggtacccgggaagggtttaacccgttaacgaaacggttaaacgtttaacggttttaaggtttaaaccggtaacggttaaccgggtttaacccgggtacgggggtaaccccggtaaacccgggggttaacccgggttccgggttaacccggtaccccggttaccccgg

SEQ ID NO: 220631 - DNA, 710 bp, Homo sapiens
  misc_feature: GYAE6OF02GYIIT.38.22.B11.1.454.CMB.1.raw
  modified_base (152)..(152): a, c, t, g, unknown or other
  misc_feature (152)..(152): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (564)..(564): a, c, t, g, unknown or other
  misc_feature (564)..(564): n is a, c, g, or t
  modified_base (677)..(677): a, c, t, g, unknown or other
  misc_feature (677)..(677): n is a, c, g, or t
  modified_base (686)..(686): a, c, t, g, unknown or other
  misc_feature (686)..(686): n is a, c, g, or t
tcagtcgatcacgtcacgaccggtgctcgatttagacgacagctcagggggaggaactgctcagttaggacccagacggaaccatggaagccccagcgcagcttctcttcctctgtcctactctggctcccagactaccactggagaatagngatgacgcagtctccacgcccacctgtccgtggtctcgaccgaggggaacacgtcccaacccgtcgccttcgacgaccgggcacgtcaagcgtagtacngacgtctaaccgttancgtgtaaccngacaacgaaccgtcggccgttacggccgaccgtaggtcctccgtactctcctaggtcggtagcctaacgcccgtaccgacggtcccgtacgacgttacccgcctaaccggcgttacggacgtcggtaacgggccgtggggtaccgttagggtaaccgcggtaaacgtcgtttacgacccttccggtacctaccgaacgtcgaacccgtgaacgtcccgtacgtacccgtcttaacgggaagttaacccggttagtttacgggtaactttcggttttaacggtttccnccggttaagtcccgttaaagttaaccgtttacggaaactttcgtacgtcccttacgttcgggtaccgtcgtaccgtacggcgtaacgtggttaaccgaggtaacctaagtcgngtacggacnccgaacgtcaagtttccgatccgg

SEQ ID NO: 220632 - DNA, 982 bp, Homo sapiens
  misc_feature: GYAE6OF02FMB0J.38.22.B11.1.454.CMB.1.raw
  modified_base (204)..(204): a, c, t, g, unknown or other
  misc_feature (204)..(204): n is a, c, g, or t
tcagtcgatcacgtcacgaccggtgctcgattttagacgacagctcaggggggaggaactgctcagttaggacccagacggaaccatggaagccccagcgcagcttctcttcctcctgctactctggctcccagataccactggaagaaattagtgatgacgcagtctccgacgcccacctgtctgtgtcctacgaaggggaanacgccctaccctcgtccgtcgcgacggtaccagtcacggtgttaggttagactacgacctaaacgtttagccgttacggtaccgaagacccgtaaaggtaaaaccccgtcggggaaccccgtacgggccccttaccccggtacgggtacccccttccggtaccttaccgtttacttaacggtccgggtttaccgtaccgttaaacccgtacccccggtaacgggaaccggggtacccttaccgggttaccgggtttaacccgttaacccccggacgggtaccccgggtagggtccggtaacggttccggggaccggtttcgggggtttacggggttaccggggtaacggggttaccggtaacggttacgtttaccgtacccgttaccttaaccccggacgttaacgtcccggaacgttacccggtaaccgggcccttacggtaccgttcggttaacggttaccgtaaagggttttcttttacgggtaaccgttttaaggttttttaccttttacggttacggttaccaacgggttttacttaaaccgttttaacgtttaaacccgtttaccgggttttaccgttaccccgtttaccgggttttaccgggtttaacccgggttaacgggttacccggggtaaccggggtaaccggggttacccgggtaaaggtaaaccgggtaaaacggtaacccggtaaaacgggttaccggtaacggtttaaccgggccctaggttaaccctaacggttaccgttttaccgtacccggttttaaccg

SEQ ID NO: 220633 - DNA, 833 bp, Homo sapiens
  misc_feature: GYAE6OF02IF0BK.38.22.B11.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (808)..(808): a, c, t, g, unknown or other
  misc_feature (808)..(808): n is a, c, g, or t
  modified_base (817)..(817): a, c, t, g, unknown or other
  misc_feature (817)..(817): n is a, c, g, or t
tcagtcgatcacgtcacgaccggtgctcgatttagacgacagctcagggggaggaactgctcagttaggacccagacggaaccatggaacgcccagcgcagcttctcttcctcctgctactctcgctccagataccacgtggagaaattagtagactgacgcagtcnccacgccctacctgtctgtgtccgacgagggaancgccacctctcgngacgacgggacctaggtacagtaggtttagtacgacaacgacgtaacgtcgtaccgttacggtaccgaacgtacgtaaccggtaaaccgtcggaaccgaaccggtcccgtaccccggacggttcccttacccgtacttaacgttctttaacggttccggtacgtacctaccgtaccccggaaccgggtaccggtaccccgtaaccgttacggtaaccgttacccccgaggtcccgggtaacggggttacaacggggttccggacggtttacgggggtacggtaacccggtacgggtaaacctaccggggttaccgttacccggtaaaccttccgttaacccccgtaaaacggtcgtacccggtaaacgccgttaaacccggtcccgttaacggaccgtttaccggtacggttaaacggttaaggtttaccgttttaggtactttttacggttttactttacgtacgtacgtacgtaccttaaactttacgtacgttacgttaccgtccgttaccggttacgtacggtaccggtccgtaacgggtacggtagtaaccggtaagacctaaccggtaacgtacgtcggtacgtaccncgtacccgntacgttcgtcccttcg

SEQ ID NO: 220634 - DNA, 738 bp, Homo sapiens
  misc_feature: GYAE6OF02GI2KX.38.22.B11.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (528)..(528): a, c, t, g, unknown or other
  misc_feature (528)..(528): n is a, c, g, or t
tcagtcgatcacgtcacgaccggtgctcgatttagacgacagctcagggggaggaactgctcagttaggacccagacggaaccatggaagccccagcgcagcttctcttcctcctgctactctggctcccagataccacgtggaagaaatgtgatgacgcagttcnccagcccaccctgtcctgtcgtcctacgagggaaacncgcccacctctccngcgacggccagtcgagtgtcgtagccagtactaacgttgccgtaggtacccagccaaagtaaacccgtggacccgnggtaccccctaccggagcccttcccgtanaacgttcgtaaggttcggttacgaccctaccgtacccgaaccggtcggggtacccctaggttacggtaccctaccccgaggtacccggtaacgggtctacggtcggtcctaaggggttccgggtacgtaacggggactaacgggttaccttccgaccgtacctacgaccctggaccctaggccgtacgtccaggtcgtaacggttnaacgggttaattacgttcgtaacgttttaccgttttagttcgtaactacgttaactacgttaaccttaacgacgtttccggacccgttcctacggttcgggtacccttacgggtacccgacgggttaacgggacccttaaggggttaaccaaactacgggaacgttcgtcgtaccgtcgtacggtacccactttgttaccgtcttaaccg

SEQ ID NO: 220635 - DNA, 792 bp, Homo sapiens
  misc_feature: GYAE6OF02F7DK7.38.22.B11.1.454.CMB.1.raw
tcagtcgatcacgtcacgaccggtgctcgatttagacgacagctcagggtcttcgtggctcacgtccaccaccacgcatgtgacctcaggggtccgggagatcatggagggtgtccgtttggggttttggggggaagaggaagactgaccggtccccccagcagcaacaggtcgcccactcccaggttcagtcgtgggtgcgagttccgtgggatcgtggaggtagaaacggaacgccggtggggcctcgaggtacggaacggttcctccgtggactaacggtcctttacgttacggttaacctacccgttttaaccaaacgttagtacggtactaccgtaagttcgggtcggaccgtaaccgaccggtccccgtaggaacggaacgggtccttaggaggtcggtaggtacgggagtggacgtacgcgtacgtacttaaacgtaagtaaacctaacgactaactacgtagtaccgaccgaaacgtaaggtacgttaccggaaggtcgtaacgggaccgttaccgaccgttaccgaaccgaaccggaaccacgtaaccgaacctaccgaacgaccgaaccgtacgtacccgttaacgtaggttacggtacgttacgggaacggtcgtaccgtacggacgtagtacccgtaggaaccggtacccggaccgggttaccgttagtacgttcgtacgtacgggtacgtaacggtaacgttaacgagtttaagtttaggttagttaacggtacgtaacggtaccgggaccgggtaccggtacccggtacgttacccgg

SEQ ID NO: 220636 - DNA, 928 bp, Homo sapiens
  misc_feature: GYAE6OF02GL4OG.38.22.B11.1.454.CMB.1.raw
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (157)..(157): a, c, t, g, unknown or other
  misc_feature (157)..(157): n is a, c, g, or t
  modified_base (551)..(551): a, c, t, g, unknown or other
  misc_feature (551)..(551): n is a, c, g, or t
tcagtcgatcacgtcacgaccggtgctcgatttagacgacagctcagggggaggaactgctcagttaggacccagacggaaccatggaagccccagcgcagcttctcttcctcctgctactctgcctcccagataccactggaanaatgtnatgacncagtcctccacgcccaccgtgtctgtcgtcctccggaaggggaaactccgaccccgtaccttctcccgtaggaccggtacggggtacccacggttcgaaacgggttacgttacggttaacgcaacggtaccttaaaacgttacgggacccgttaggggtaaccctacgtaccgtaaacgaaacccggttcgggaacctaaccggtaccctaacccggtggtaccctcccgtaagacttaccgtaacggttggtacctaccgtaaccgtcccgaaccggaccggtacccaggttaaccgggtacccaccccgtgtaacccgggtggttacacgggtacggtacggttaaggtcgggtacctagggaactacgggttacttacgaccgttaacccncgaaaccttcgtacggacaaccggtacctcggtcgtactaccggttaagacgttaaacggttccgtttacgtacggttttaccgttttaaacgttcggtaacgttaccggtaaaccgtacgtttaaacgttaaaccgtccgttaaccggtttacccggttaccgtttaacccgggttacgggtaacccggggtttaaccggtttaacccgggggaaccccgggttaaaggggttaacccgggtaaaccgggtttaaacggtaacccggttaaaaccggaaccgggttacgggttttaacccgggaccgttaacccggtaccgttaaaacccccggtagttaacccggttttacccgggttaaccctttaccccgggg

SEQ ID NO: 220637 - DNA, 529 bp, Homo sapiens
  misc_feature: GYAE6OF01EBAND.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaagtctagtcaaagcctcgtgaacggtgatggaaacacctacttgaattggtttcagcagaggccaggccaatctccaaggcgcctaattataaggtttctaaccgggactctgggtcccagacaggttcagcgcagtgggtcaggcactgatttcacactagaaaatcagcgagggtggaggctgaggatggttggggtttattactgcatgacaaacttcacactcgtcctccgtactacttttcggccacggggaccaaggcgtaggagatacgaaacgtaacgtgtcggcgtgcaccatctgtctcgtacc

SEQ ID NO: 220638 - DNA, 732 bp, Homo sapiens
  misc_feature: GYAE6OF01CPGYK.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctccgtggggctgctaatgctcgtcgggtcccaggatccgaggtggggatgttgtgatgactcagtcctccactcctccctcgcccgtcctacccgttggacacggcccggcctccactcctcctgactaagtctaagtacaaacgccgtacggtaggaacggtgaagtacggaaaacctaaccttaacgttagtaagttacggtttacgtagacgaggacggtttttttttaccgacggaccaactaccgtaccgaacggaccgtaccttaatttaacgttaacggtttaccgtaaccggtacgtacggtacgggtaccgtacgtacgtacggtacgacggacggacgtaggtacgggtacgaggacgtacgtagtacttactactaacgtaagtaaatacgacgacggagggtagggaggtacggtaggtaggtaggttagggtttagggtttagttacgtagtacgtagtacgtaactaactactacgtacgtaccgtaccgttaccgtaccgttaccgtttacggtaccggtaacgggaccgaacgacgtacggaacgtaacgtaacgaaacggtaacgtacggtcggacgtacgaccgtacctacttacttcgttcgttctacc

SEQ ID NO: 220639 - DNA, 516 bp, Homo sapiens
  misc_feature: GYAE6OF01AVLYC.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaagtctagtcaaagcctcgtgaacggtgatggaaacacctacttgaattggtttcagcagaggccaggccaatctccaaggcgcctaatttataaggtttctaaccgggactctggggtcccagacaggttcagcggcagtggtcaggcactgatttcacactgaaaatcagcagggtggaggctgaggattggttggggtttattactgcatgctaaacttcacactggcctccgtactacttttggccagggaccaagctaggagatacgaaacgatggtgctgcacatctgtcttctac

SEQ ID NO: 220640 - DNA, 603 bp, Homo sapiens
  misc_feature: GYAE6OF01BUTZQ.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaagtctagtcaaagcctcgtgaacggtgatggaaacactacttgaattggttcagcagaggcaggccaatctacaaggcgacctaatttataacggtttctaacggactcgtgggtcccagacagtcagcgcagtggtcaggcactgatttcactaactagaaaatcaagcgagggtaggaggcgtaggaggtagttggtttaggggtttaattacgtgactagtacgactaaacttcaacacgtcggtccttaccgtactacgttttacggaccgtacggggtaccaaggtcgtacggaacgtaacgttaccgaaaacgtacgttacggtacgggtaccgttacggacctaacccgtaacttcgttacgttccgttaccgttaacccg

SEQ ID NO: 220641 - DNA, 601 bp, Homo sapiens
  misc_feature: GYAE6OF01EMGKC.42.45.E01.1.454.CMB.1.raw
  modified_base (208)..(208): a, c, t, g, unknown or other
  misc_feature (208)..(208): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggctccatcncctgcaagtctagtcaaagcctcgtgaacggtgatggaaaacacctacttgaattggtttcagcagngcagccaanactcagncaattatagttctaacggactctgggtccagacaggttcagcggcgagtgggtcgaggacgactagtattcacaactagaaaagtacacgcgacggggtggagggacgtggaggtaagttggtttggggtttaacgtactgtgtaacgtacgtacaaacttacctacgaacgtcggtacccgtcccgtaaccgtacgttttacggtaccgaacgggtaccgaacgtctacggggaagaaacgtcctaaaaccggaaactggtcgggccgtagccctaaaccgtacttaccgttcgttaccgttcctaacg

SEQ ID NO: 220642 - DNA, 614 bp, Homo sapiens
  misc_feature: GYAE6OF01D3LZH.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactctccctgcccgtcacccttggacacgccggcctccatctcctgcaagtctagtacaaagcctcgtagaacggtgataggaaacactacttgaattggttcagacagaggccaggccaatctaccaaggccgtactaactttagtaacggtttctaaccgggacttcgtcggggtaccctagactaggttcagcggcaggtggtcaggcactgattacacactagaaaatcagcgagggtggagcgtaggagtaagtggtttagggtttattaacgtgactattacggactaaacgttacaactacgtcggtaccctaccgttacgtaccgtttcggaccggtaacgggaccgtaacgcgtagggtaagtaacgtacgaaaaccgtaacgttaggtcggaccgtagacccgtactacgttacttacggttccttacgtaccccg

SEQ ID NO: 220643 - DNA, 666 bp, Homo sapiens
  misc_feature: GYAE6OF01D6S6P.42.45.E01.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
tcagtgacgtatgtcacgaccggtgctcgatttagtgagtcagtaagggaagggggatcgaggactcctcagttcaccttctcacaatgaggctccctgctcagctcctggggcctgctaatgctctgggtcccaggatccagtgggattgttgtgatgactcagtctccactctccctgcccgtcacccttggacagccgcctcatctcngcagtctatacaacgcctgngacgtgatagaactacttattgagtttcggttcagacaggacgaccacggccaacttccaaccgaaggccgtaacctttaaagtttacgttaacgggtttccgtaaccgggtcttcggtaccggggtaccctaagaccgttacgggttacgacgggtccggtagttacggggtgggtaaccgacgggtacctaacgttggtaacttttacccgaaacgttaacgtaaagtaaaacctcgaacggtccggaaggggtcggaacggtcgtaagggaaggtcgtttagggtttagggtttaactcgtgacttaagtcgtaactaacgttcacgtacgtcggtcctacgtacgttcgttcggacgaacggctagcgtaggacaacgtacgaaacgtagtcggtacgcctgacctaccgattcggttctcgtgttacccg

SEQ ID NO: 220644 - DNA, 603 bp, Homo sapiens
  misc_feature: GYAE6OF02IDA73.42.45.E01.1.454.CMB.1.raw
  modified_base (244)..(244): a, c, t, g, unknown or other
  misc_feature (244)..(244): n is a, c, g, or t
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccactctcctgcaagtctagtcaaacgcctcgtgaacggtnatcggaaacacctacttagtaattggtttcagcagaggccaggccgaatccttcccaaggccgacctaatttacttaaggtttactaaccgggtacttacgtcggggtacccgagactaggttcagcggcagtggtcgaggctacgtgagtttcactaactagaaatcagacgtaggaggaggcgtacggagagtgggttagggtttattacgtggtcagtacgtacaaacttcactacgtcggtacctcccgtactacgttttcggccgtaacggggaccctaaggcgtacggagacgtacgaaacggtaactaggtcgtacgtcgtaccgacctagtcctacggttacttactaccg

SEQ ID NO: 220645 - DNA, 631 bp, Homo sapiens
  misc_feature: GYAE6OF02FS4EP.42.45.E01.1.454.CMB.1.raw
  modified_base (301)..(301): a, c, t, g, unknown or other
  misc_feature (301)..(301): n is a, c, g, or t
  modified_base (479)..(479): a, c, t, g, unknown or other
  misc_feature (479)..(479): n is a, c, g, or t
tcagtgacgtatgtcacgaccggtgctcgatttagtgagtcagtaagggaagggggatcaggactcctcagttcaccttctcacaatgaggctccctgctcagctcctgggggctgctaatgctctgggtcccagggatccagtggggatgttgtgatgactcagtctccactctccctgcccgtcacccttggacagccggcctccatctcctgcaagtctagtcaaacgcctcgtgaacggtgatggaaacacctacttgaattggtttcagtcagaggccaggccaatctccaaggcnctaatttataaggtttcgtaaccgggactctcggggtccagacgaggttcgaggtcggacaggtcgggtcgaggcacgtgatttcaacactgaaaatcagtcgagggtggaggcgtaggacggagtttgggttaaggggtttattacgtaggtctagtgtaacgtaaacttctaaccncgttcggacccgttaccgttaaccctagttttaccgggtaccggaaggggtaacccgtaagggtcctaggggtagaacttaccggaaaaaccgtacgttagggacgttaccgtgacccacgttaacgtccgttcgttaccgttcctaacccg

SEQ ID NO: 220646 - DNA, 884 bp, Homo sapiens
  misc_feature: GYAE6OF02JXTKL.42.45.E01.1.454.CMB.1.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
  modified_base (518)..(518): a, c, t, g, unknown or other
  misc_feature (518)..(518): n is a, c, g, or t
tcagtgacgtatgtcacgaccggtgctcgatttagtgagtcagtaagggaagggggatcaggactcctcagttcaccttctcacaatgaggctccctgctcagctccgtgggctgctaatgctcgtcgggtacccaggactccgaggtggggattgttgtgatgtactcgtagtctcctactcctccctcgtcccgtcctaccgtggacncgtccgcctcgtactccgtctgacacttctacgtaccaacgtcctcggtacggacggtagagtaacgaaacctcgttacgttcggtaattcggttacngtacggacggaccggactacggactattaccgaccgtaaggtcctaacgttaagtttaacggttaaccgtttaccggaaccggttaccgttcggtacggggtacccgtaaggttacgtacggtacggaacggtccgtcgggtaagggttccgggtacgaacggtcgttaacgtagttacctttaaccgacgtaacgtaaacggttaaacncggtaacgggtacgggtaagggaccggttaagggtccgtaaacggggtagggtttaaccgggtttgggggttttaaacgtttacgtaccggtacgggttctttaaccgtaccgggttaaaaccgttaccgttacgtaaaacccggtttcgggaccccggttttaaccccgtttaaccgggttaacccgttttacgggttaacccgggggtaccgttaaaacccgggggtcttaaaaccggggtccgtaaaccgggttagtaaccgttaaaacccggtacggtaacggtttggtaaccccggtcgttaaaccgttacccggggtaaccttaggtccccggttttaacacccgttttaccccggtacc

SEQ ID NO: 220647 - DNA, 720 bp, Homo sapiens
  misc_feature: GYAE6OF02JJH1S.42.45.E01.1.454.CMB.1.raw
  modified_base (161)..(161): a, c, t, g, unknown or other
  misc_feature (161)..(161): n is a, c, g, or t
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactnagtctccactctccctgacccgtcacccttggacagccggcctccatctcctgacctaagtctagtacaaacgcctcgtagaacggtgagtacggaaaccaccttacgttagtaagtttcggttacaaggactaaggacggcccagggtaccctaaagtccgtaccgaaaggcctaccttaaaagtttagtaacggtttacgtaaccgggtaccttacggtccggggtacccaaggtactacggttacgacggcgggtacgtaggttggggaccacggtacacgtgttacttacacgtaagtagtaaactcgtaggaccgaggggtacgaggtccgaggtaggtgttagggtttacgggtttaatactaggtactaagttacggaaccttaattaccgactaccgtacggtccctaacgtttctaaccggtttcggaacccggttagggaaacccttaaggcggttacgggaactacgtaacccgtaaaggaccgttagggtccggtacgtaccgtaccgtaacctcgtttaccgtacgtttaccggtcttaaccccgg

SEQ ID NO: 220648 - DNA, 733 bp, Homo sapiens
  misc_feature: GYAE6OF02GYGRR.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctcctggggctgctaatgctctgggtcccaggatccagtggggatgttgtgatgactcagtctccactcctccctcgcccgtcacccttggacagcccggcctccactcctcctgacaagtctagtacaaacgcctcgtagaacggtgagtacggaaacctaccttacttagtaagtttggtttacacgcaggacggaccaggccaaatccgtaccgaacggccgtaccttaatttagtaacggtttaccgtaaccgggtactcggtcgggtcccagaccgtaggttccacggtcggacgtaggtcgggtacgacggactacgtagtactttacaacgtactaaggtaaaactacgaacggacggtagggggtacgggtaacgggtccgtaaggggtagggttagtttggggtttaaggggttttaacttaccggttaggtacgtagtacggtactaaaccgttacaaccgttaaccgtccgtacccttaccggttaaccttccgggttttacggaccgggtaacggggtaacctaacggtacgttaagggacgtaacgtaaccgtaaacggtaacgttaggtacggtcgtacgtaccgtactacgttcgttacgttaccgttctacccg

SEQ ID NO: 220649 - DNA, 1057 bp, Homo sapiens
  misc_feature: GYAE6OF02II497.42.45.E01.1.454.CMB.1.raw
tcagtgacgtatgtcacgaccggtgctcgatttagtgagtcagtaagggaagggggatcaggactcctcagttcaccttctcacaatgaggctccctgctcagctccgtgggctgactaatgctcgtgggtcccaggatccaggtggggtatgttgtgatgactcagtctaccactctccctgcccgtcaccttggacacgccggtcctccatcctcctgactaacgttcctaagtaccaaacggtcccttacggtaggtaaccgggtgtacgtaacggtaaacctacccttacgttaggttaacgttttcgggtttacacggtacgacggtacggtcccgtaacggtacctaacgtttcccgaccggtaaacggtaccgttaaccgttttaaaacgttttaaacggtttaaaccgggttttaacccgtaaacccgggggttaccgttaccgggttaccggggttaaccccgtaaggttaacccggtacgggtttaccgtacgggtaccgggtacggtaacgggttccggggttacggtacgggtaccgttaacgttacgggttacttttacccgaaacgttaaccggttaaacggtaaaaaccgttcggtaaacggggtaccggggttaacggggtaacggggtacgggttaaccggttaacgggttaaacgggtttaacgggttttacgggggttttaacggggtttttaacgtttaccggttacggttaaccgttaacggtttaccgttaaacccgttaaacccgttccgtaaaccggttacccgggttacccggttaacccgttttacccccggtttaaacggttttacccgggttttacccggggtaaaccgggttaaccccggggggtaaaccgttaaccgggttaaccgggtttaaccgggggtaaccgtttaacccggtttaaaaccgggtaaaccggtttaaacccggggtttcgggttaaccgggttacccgtaacggtttacccccaaaccgggttttcccgttacggtttacccggtttacccgttttaaccggtttaaccccgg

SEQ ID NO: 220650 - DNA, 513 bp, Homo sapiens
  misc_feature: GYAE6OF01EANYH.39.85.H08.1.454.CMB.1.raw
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttcttagcttggtaccagcagaaaccacgacagcctcctaagctgctcgtttacngggcctctacccgggaatccgggtccggtnaacgatcagtggcggcgggtctgggacagtatttcactctcaccatcagcagcctgcgggctgaagatgtggtcgtttattactgtcagctagtattatgttactcctctactagtttcgccgtagggaccaagcgtaggagctcgcacgtaactgtggctgcacc

SEQ ID NO: 220651 - DNA, 502 bp, Homo sapiens
  misc_feature: GYAE6OF01DY0J8.39.85.H08.1.454.CMB.1.raw
  modified_base (242)..(242): a, c, t, g, unknown or other
  misc_feature (242)..(242): n is a, c, g, or t
  modified_base (481)..(481): a, c, t, g, unknown or other
  misc_feature (481)..(481): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttactgggcctctaccgggatccgggtcctgaacgattcagtggcggcggtctgggacagattcactctcaccatcagcagcctgcggctgaagatgtggcggtttattactgtcagctagtattatgttactctctactagtttgccagggaccaagcgtaggagacncgcacgtactgtggctgctac

SEQ ID NO: 220652 - DNA, 973 bp, Homo sapiens
  misc_feature: GYAE6OF01DV2GF.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctcgtggtatctcttgttactacgtaggtcgtaccggtacgggactacgttcggtagtagtaccgaacccgtacgttccctaccgaacgtacccttcccggtggtcgttggttcgttccgtcggtcggggacgagggaccgggaccaacgtactaacctaacgtcgaacgtaacgtaccgacggtaccggtagttttagtttttaaacaaacctaaaccgtaaccgaaaagtaaaacgtaaaggttacggttttacgtttaacggtcgtttaacgggtaaccaggtaccgaaaaccggaaaacccgaacggaaccgaccggtccccttaaccgtaacggtccgtacgtacccgttttaccggttttaaccgggtccgggttaccccttaccccgggtaaaccccggggtaaccggtttccccgggggttacccctaaagggtaaaccgttacgtttaccggacggggtcggggtcccggggtaccggggtttcggtaacgggggaacctacgggttttaaccttttccgaccgtttccctaacccgaaccgtacttaaccgaccggaccgtaacccggtccgtacggggccgggtacgtaaggaaacggtcgttcgggttacgggtttacggttttaacttacgttcggtaacgtacgtacgttaagtttaactttacggtttacgtttacccttaccgttacgttaacggttttacgggttttacccgggaccgggtaaaccggggtaaacccgtaacgggttccgggtaagggtaacggttaccgtacccgggtaaacccgtaacgggttaaccggttacggggtcggtaccgttcggacccttaaacccgg

SEQ ID NO: 220653 - DNA, 580 bp, Homo sapiens
  misc_feature: GYAE6OF01DCGS4.39.85.H08.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttactttagcttggtaccagcaagaaaccacgacagcctcctaagctagctcgtttacncgggcctcgtacccgggaatcccggggtccctagaacgattcgaggtgggccggcggggtccgggactagatttcactctcaccatcagcagcctggcggcgtcgaagtatggtaggtggtttaacttagtcgttcgagactagtaattagtacgttacctaccttctaacttaggttttcggaccgtacggggaaccgtaaagccggttaggacgtatccggaccgaacgaacgtcggtacggcgtcgccgtaactacg

SEQ ID NO: 220654 - DNA, 582 bp, Homo sapiens
  misc_feature: GYAE6OF01DL8DA.39.85.H08.1.454.CMB.1.raw
  modified_base (243)..(243): a, c, t, g, unknown or other
  misc_feature (243)..(243): n is a, c, g, or t
  modified_base (321)..(321): a, c, t, g, unknown or other
  misc_feature (321)..(321): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacactcaagaataagagttctttagcttggtaccagacaagaaaccacgacagccctactaagctgcctacgtttacnggcctcgtaccgggactccgggtccagaacgtattcaggtggcgggcggtcgtgggacctagtactttccgacttctaccacctatacagcacgtccgtggcggcgtagaagtagtggtaggtcgtttattacgtgtacgagtctaagttattacgttcgttacctccgtactacgttacggtttcggaccgtacggggtaacctacggtcgtagggagtcgacgtaccgtaacgtacgttcggtaggtcgtgccgtaccg

SEQ ID NO: 220655 - DNA, 536 bp, Homo sapiens
  misc_feature: GYAE6OF01ERLJY.39.85.H08.1.454.CMB.1.raw
  modified_base (242)..(242): a, c, t, g, unknown or other
  misc_feature (242)..(242): n is a, c, g, or t
  modified_base (417)..(417): a, c, t, g, unknown or other
  misc_feature (417)..(417): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttactgggcctcgtacccgggaatcccggggtccctgaacgattcgagtggcggcgggtctgggacagatttcactctcaccatcagcagcctgctgcctagaagntgctgactaacttattactgtacaaagtatagactagtcgtccgtggaccgttccggacccgagggaccgtaaggtaggaaactcgaaacgtacgtaggtacggactagcacctgtccg

SEQ ID NO: 220656 - DNA, 759 bp, Homo sapiens
  misc_feature: GYAE6OF01CKGY6.39.85.H08.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
tcagtcgcactagtcacgaccggtgctcgatttagtatcactcagtcgcggggtctgagagaggagcccagccctgggattttcaggtgttttcatttggtgatcaggactgaacagagagaactcaccatggagtttgggctgagcggtgtgtttctaggtggctaattttaaaggtgtcagtgtgaggtgcagctgctggagtgtggggaggnttggtacgaggccggggggtcctggagactctcctgagaagcctntggattcacctttgacaagtgtgccatcgacctggggtcccaccgaggtcctaccgaggggaacgggtcgtgggagtgggtcctgtaagttattaggtggtagtggttagacgcagagattacgcaagtctccggtaggaacgggtcccggttacaaccgtacgttcctacccgaagggtaccgtaaaccaaactttacccccgaaaaaacgtaccggaccgtaacgtccgtttaggtttaacgtttacgtacgtaaccgtaacgtaacgtaaccgtaacggtaaccgtacggaacggaaccgggacccggaaccgggaacccggtaacccggaaccgtaaacgttaacgtttaacgtttaacggtttaacggttaacggttaaccgtttaaaccgtttttaaccggtttttaccggtttaccggtttaacggttttaacgtttaacccgtttacccgttaaccggttaaccggttaacccggtaaccgggtaccgggg

SEQ ID NO: 220657 - DNA, 567 bp, Homo sapiens
  misc_feature: GYAE6OF01BI8VU.39.85.H08.1.454.CMB.1.raw
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactccaagaataagagttcttagcttggtaccagcaagaaaccacgacagcctactaagctgctcgttacncggcctcgtaccggatcccgggtcctaggaacgtattcgagtggcggcggtcgtgggacagtactttcacgtctacacctatcacgcacgcctggcggctaggaagtagtggtggtacgtttatacgtgtacagtcgtagttattacgtcgtttacctcctactacgttaggtttcggaccggtaacgggaacctaaggccgttaggacgtacgtccgacaacggtacgtcggtaggtcctgcctaaccg

SEQ ID NO: 220658 - DNA, 547 bp, Homo sapiens
  misc_feature: GYAE6OF01AM4OG.39.85.H08.1.454.CMB.1.raw
  modified_base (243)..(243): a, c, t, g, unknown or other
  misc_feature (243)..(243): n is a, c, g, or t
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctctaagctgctcgttacnggcctctaccggatccgggtccngaacgtntcagtggcggcggtctgggaccagtactttcgacttcctacacctatccagcacgtccgtcggcgggtcgtaggaagtagtggtcggtacggtttacgttacgtgtcagtctagttattagttcgttacctctactacgtaggtttcgaccgacgggtaccgagtcgtaggagctcgacacgtactggtagcgtgcgtaccg

SEQ ID NO: 220659 - DNA, 689 bp, Homo sapiens
  misc_feature: GYAE6OF01BC0HO.39.85.H08.1.454.CMB.1.raw
  modified_base (247)..(247): a, c, t, g, unknown or other
  misc_feature (247)..(247): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgaccaagtccagccggagttgtttanacaactaccaagaataagagttcttagcttggtaccagacaagaaaccacgacacgcctacctaagctcgcttacgtttacgtcgggtccctaccggtaaccccgggtaacgtcccggggtccctaggaacgtacgttcgaggttcgggccgggtcgggtcgtacgggggactacggtactttacccgacgttccctaccgaacctacgttaccaacggtccgaccggtaccccgttggggacccgggtacgtagggaaacgtaggttgggttacgggttacgggttttaacttacgttggtaccgagtacctaaggttacttacgttacgtttactcccgttacgtaccgtttagtttaccgggaccgtaacggggtaacctaacggtccgttaggaacgtacgtaccgacgtaaccggtactggtcggctcgacctaccg

SEQ ID NO: 220660 - DNA, 554 bp, Homo sapiens
  misc_feature: GYAE6OF01DM1YE.39.85.H08.1.454.CMB.1.raw
  modified_base (245)..(245): a, c, t, g, unknown or other
  misc_feature (245)..(245): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaagtccagccggagtgttttanacaactccaagaataagtagttctttagcttggtaccagcagaaaccacgaacagcctactaagctgctcgtttacgtcggcctcgtacccgggaatccgggtcctgaacgattcgaggtcggcggcgggtcgtgggacagtatttcactctcaccatcgagcacgctggcggtctagaagtagtgtggtacgtttattacgtgtcagactagttatttagtcgttacttcctactacgttaggtttccggaccgacggggtaccaaggtcgtaggagtatccgacgaacgtacgtgtaggctgctacc

SEQ ID NO: 220661 - DNA, 664 bp, Homo sapiens
  misc_feature: GYAE6OF01B46Y5.39.85.H08.1.454.CMB.1.raw
  modified_base (255)..(255): a, c, t, g, unknown or other
  misc_feature (255)..(255): n is a, c, g, or t
  modified_base (385)..(385): a, c, t, g, unknown or other
  misc_feature (385)..(385): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacggggacatcgtgatgacccagtctccagacctccctggctgtcgtctcgtgggcgaggacgggccacgatcaactgacaagtccaggccggtagttagttttaanacaactacaaagaataagtattcttagcttacggtacagacaagaaaccacgacacgcctaccgtaagcctgtccttacgtttacgcgggtccctacggtacccgggaagttcccgggtcctagaacgtnttacgaggtcgggccggtcgggtcgtacgggactagtacgtttccacctcgtaccaccctatacgacgccgtacgcccgtggaccgggtactagggacgtaggttggtcggttacggtttattacgtagtacgagtacgttaagtttagttacgtacgttacctccgttacgtaacgttacgggtttcggaacccgggtacgggaaccgtaacggtcggtaacgggtacggtacgtaccgacgtaaccgtacggtacgtcggacttccggacctaaccg

SEQ ID NO: 220662 - DNA, 612 bp, Homo sapiens
  misc_feature: GYAE6OF01BZ7UP.39.85.H08.1.454.CMB.1.raw
  modified_base (243)..(243): a, c, t, g, unknown or other
  misc_feature (243)..(243): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactaccaaagaataagtagttctttagctttaggtaccagacaacgaaaccacgaccagccctacctaagctgcttcgtttactgggtaccctcgtacccggaacgttcccgggtaccctaggaaccgtacttcgaggtgggcggcgggtcgtgggacagtactttcactccgtacaccatcacgcacgcctggcgggactagaagtgttggtcgtacggtttacttacgtgtactacgcgtaagttatttaagttcgttaccttccgtactaccgttaggtttacggaccgtaacggggtaccctaaggtccgtagggacgtacgtccgagtaaccgtaacgtggtaccgctcgtaccgtacccg

SEQ ID NO: 220663 - DNA, 735 bp, Homo sapiens
  misc_feature: GYAE6OF01CRXBQ.39.85.H08.1.454.CMB.1.raw
  modified_base (254)..(254): a, c, t, g, unknown or other
  misc_feature (254)..(254): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtcgccgtacggggacatcgtgatcgacccagtcctccagacctccctggctgtgtctcgtgggcgaggacgggccagatcaactgacaagtccaggccggtagttgtttaanacaacctacaagaataagtagttcttagcttaggtaccagacaacgaaaccacgaacacgccctactaacgctagtcttacgttacgcggaccctaccggtaaccgggtacgtcccgggtaccaaggtaacgtacgttcgagggtcgggccgggtcggtacggtacgggtaactacggttaccttaccaccgttaccacactactcgacgtcgtacgcccgtagggccgggtactaaggtaacgtaggttcgggttacggttaccgttttaacgtacgtcgtaaccgaggttacgttaagtttaacgtttacgttaccgtttaacctcccgttaacgtacgggttttaccgggttaccggaccggggtaaaaccggggtaccctaacggggttccggtagggtaacgtacccggtaccgggtaaacccgtaaaccgggttacggttcgggtaacccgggtccctaccggtacccctaaccg

SEQ ID NO: 220664 - DNA, 632 bp, Homo sapiens
  misc_feature: GYAE6OF01EUCEW.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacgggacatcgtgatcgacccagtctccagacctccgtggctgtgtctcgtgggcgaggacgggccacgatcaacgtgacaacgtccaggccggtagtttgttttaacaaccaacctaccgaaagtaaataagtagtttctttagcgtttaggtaccagcaaacgaaacccacgacacgtccctaccgtaagcctgccttacggtttacgcgggtccctaccgtaacccggggaacgttccccggggtcctaggaacgtacttcgaggtcgggcggtcgggtcgtagggacagttacttccgacttcctaccactatccgaagccgacgtcccgtgggcgggtctaggaagtgtggttacggttcgtttatacgtgtacagtctaagttattagttcgttacctcctactacgttggttcggaccggtacgggaacctaggtcgtaggacgtcgtccgacgacgtacgtggtagctgcctaccg

SEQ ID NO: 220665 - DNA, 636 bp, Homo sapiens
  misc_feature: GYAE6OF01A30JX.39.85.H08.1.454.CMB.1.raw
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (379)..(379): a, c, t, g, unknown or other
  misc_feature (379)..(379): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggattgttttanacactcaagaataagagttcttagcttggtaccagcagaaaccngacagcctcaagctgcttcgttactgggcctcgtacccgggatcccgggtcctagaacgtattcgaggtcggcggtcgggtctggggaacnggtattcactctcaccatacacgcgacgcccgtggccgggtctacggaagtacgttgggtacgggttacggttttaacgtttacgttcggtacgtaacgtccgtaagtttaactttaacgtttcgtttaaccttcccgttacgttaaccgttacgggttttacgggacccggtaacgggggtaaccctaaggtcggttacgggtaagtcgttacgaccgtaaccgtaaacgttggtacggtcgtcggaccctaaccg

SEQ ID NO: 220666 - DNA, 610 bp, Homo sapiens
  misc_feature: GYAE6OF01DDURJ.39.85.H08.1.454.CMB.1.raw
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacgggggacatcgtgatgacccagtctccagactccctggctgtgtctcgtgggcgaggagggccacgatcaactgacaagtccgagccggtagttgtttanaacaactccaaagaataagtagtttctttagctttaggtaccagcaagaaaccacgacagcctctaagctgtctcgttacncggcctcgtacccgggacgtccgggtcctgaacgtattcgaggtgggcgggtcgggtcgtacggggactagtctttcactctcaccatcagcacgccgtggcggtctaggaagtgtggtacggtcgtttattacgtgtacgagtacgtagttatttagtgtttaccttcctacgtacgttacggtttcgggaccggtaacggggtaacctaaggtccgtagggacgtacgtcccggtaccgaaccggtaacgttcggtcggtcctacggtcctaacccg

SEQ ID NO: 220667 - DNA, 613 bp, Homo sapiens
  misc_feature: GYAE6OF01CSLAL.39.85.H08.1.454.CMB.1.raw
  modified_base (249)..(249): a, c, t, g, unknown or other
  misc_feature (249)..(249): n is a, c, g, or t
tcagtcgcactagtcacgaccggtgctcgatttagtatcactcagtcgcgggggagctacaacaggcaggcaggggcagcaacccgatggtgttgcagacccaggtcttcatttctctgttgctctggatctctgttactacaggtgccgtacggggacatcgtgatgacccagtctccagacctccctggctgtgtctcgtgggcgagacgggccacgatcaactgcaagtccagccggattgtttanacaactccaaagaataagtagttcttagcttggaccagcaacgaaccacgacacgcctaccaagctgcttcgttacgcggcctcgtaccgggactccgggtcctaggaacgtacttcgaggtcgggcgggtcgggtcgtacggggactaggtactttcactcctcaccgtatcacgcacgtccgtcggcggctaggaagtacgtggttagggtacggttttattacgtgtcgagtctaagttatttacgtcgtttactccttacgtacgttaggtttcgggaccgtaacggggtaccgtaacggtcggtaggagtacgtaccggacgtaaccggtaacgttggtacggtaccgtgaccgtaccg

SEQ ID NO: 220668 - DNA, 611 bp, Homo sapiens
  misc_feature: GYAE6OF01EKYEF.39.85.H08.1.454.CMB.1.raw
  modified_base (251)..(251): a, c, t, g, unknown or other
  misc_feature (251)..(251): n is a, c, g, or t
  modified_base (339)..(339): a, c, t, g, unknown or other
  misc_feature (339)..(339): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacggggacatcgtgatgacccagtctccagctcctggctgtgtctcgtgggcgaggacgggccacgatacaactgacaacgtccaggccggtagttgttttanaccaactaccaaagaataagtagtttactttagctttggaaccagacaacgaaaccagacacgcctacctaagctgccttcgtttacncgggtcctaccgtacccgggtactcccggggtcctagacgtattcgaggtcgggcggtcgggtctaggggacagtacttcactctcaccatcacgtcacgcgtcggcgggacgtaggaagtcgtggttacggttacgttttattacgttcgtacgtacgtacgtaagttatttacgttcgtttaccttaccgttctacgttggtttcggaccggtagggaacctaggtcgtaggacgtacgtacgcgaacggtacttggtgcctcgctaccg

SEQ ID NO: 220669 - DNA, 626 bp, Homo sapiens
  misc_feature: GYAE6OF01CA23B.39.85.H08.1.454.CMB.1.raw
  modified_base (248)..(248): a, c, t, g, unknown or other
  misc_feature (248)..(248): n is a, c, g, or t
  modified_base (425)..(425): a, c, t, g, unknown or other
  misc_feature (425)..(425): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgacaagtccaggccggagttgttttanacaactccaagaataagagttctttagcttggtaccagacaagaaaccacgacacgccctacctaagctgtctcgtttacgtcgggacctccgtacccgggaacttcccggggtccctaggaacgtacttcgaggtcggcggtcgggtcgtgggactagtacttcactcctacaccncgtacacgcacgcccgtggccgggtacgtaggaacgtaggttcggttacgggttacggttttacgttacggttgtacctaggtctaagtttacgttagtttcgttaccttccttacgtacttaacggtttcggaccggtacgggacctaggcgtaggtacgacgtccgacgaacgtacgtaggttacgcgtcgcctaaccg

SEQ ID NO: 220670 - DNA, 525 bp, Homo sapiens
  misc_feature: GYAE6OF01E41KR.39.85.H08.1.454.CMB.1.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (438)..(438): a, c, t, g, unknown or other
  misc_feature (438)..(438): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaacccacgacagcctcctaagctgctcgtttacngggcctctaccgggaatccggggtcctgaacgattcagtcggcggcgggtctgggacagntttcactcncaccatcagcagcctgcgggctagaagatgtggtcggtttattactgtcngctagttattattgttacttcctctactagttttcggccgagggaccaaggtcgtaggagcgtcgacacgaactgtgctgctacccg

SEQ ID NO: 220671 - DNA, 714 bp, Homo sapiens
  misc_feature: GYAE6OF01DFIGM.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacgaggtgcctacggggacatcgtgatgacccagtctccagacctccctggctgtgtctcgtgggcgaggacgggccaacgataccaaacgtcgacaacgtccaaggtccggtaagttgttttaacactaacctaccaaaagtaataagtacgtttctttagcgttacggaccagacaacgaaaccacgaacacgccctacctaagctgtccttacgtttacgtcgggtaccctccggtaacccggggtaacgtcccgggtacctaggaacgtacgttacgacggtcgggcggtccgggtcgtagggactagtactttaccaccgttcctaccaacctacgtccgaacgcgtaacggtcccgtcggacgggtactaggaagtgtcgggttacggttcggttttacgttacgttcggtacgtacggtacgttagttaacgtttaacgttcgttaccttaccttacgtaccgtttaggtttaccgggaccggtaacggggtaccgtaacggtccgtagggtaacgtacgtacccggtaacgaaccggtaacgttgggtacggacgtcgaaccgtaaccg

SEQ ID NO: 220672 - DNA, 718 bp, Homo sapiens
  misc_feature: GYAE6OF01ATM7I.39.85.H08.1.454.CMB.1.raw
  modified_base (240)..(240): a, c, t, g, unknown or other
  misc_feature (240)..(240): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaactgcaagtccagcggagtgtttanacaactccaagaataagagttctttagcttggtaccagcagaaaccacgacagcctacctaagctgcttcgtttacgtgggcctcgtaaccccgggtaacgtcccggggtccctaggtaaccgacgttccgacggttacgggcgggtaccggggttcgtaggggtacgtaaggtactttaccgacttaccgtaccaaccgtagttaccgaaggtccgtaacgcccgttacgggccggggtactaggtaagtacgttgggttacgggttacgggttttaatttaccgttacgtaccgtacggtactaaggtttaacgtttacgtttacggtttaacccttccgttaccgtaaccggtttacggttttaccgggaccggtaaaccgggggaaaccgtaaacggtcccggttaggggaacgtacgttcccggaaccgtaaccggtaacgttacgggtacggtcgtacggtaccgtaacccg

SEQ ID NO: 220673 - DNA, 677 bp, Homo sapiens
  misc_feature: GYAE6OF01C7VZ5.39.85.H08.1.454.CMB.1.raw
  modified_base (246)..(246): a, c, t, g, unknown or other
  misc_feature (246)..(246): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagttgttttanactaactccaaagaataagtagttctttagcttggtaccagacagaaaccacgacacgcctacaagctgcttcgtttacgtggtcctacgtacccgggtacgtccggggtcctaggaacgtattcgaggttcgggcgggtcgggtcgtagggacgtagtactttccactctccaacctagtcgacgcgacgtcccgttgggccgggtactacgtaaggtagttacgggttcggttacggtttttaatttacgtcggtacgtacgtaccgttaagttacgtttacgttacgtttaccttccggttaccttacggtttacggttttaccgggacccggtaaacgggggtaccctaaagggtccggtagggaacgttccgtacgggaacccgtaaccggtaacgttcggtacgggtcgtccggacccgtaaccg

SEQ ID NO: 220674 - DNA, 655 bp, Homo sapiens
  misc_feature: GYAE6OF01DRMIQ.39.85.H08.1.454.CMB.1.raw
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacgaggtgcctacggggacatcgtgatgacccagtctccagacctcccgtggctgtgtctcgtgggcgagagggccacgatcaactgcagtccagcggtagtgtttanacaactccgaaagaataagtagttctttagcttggtaccagtacagaaacccacgacaggcctacgaagctgtccttcgtttacncgggacctccgtaaccggggacgtcccgggtcctagaacggtacttcggaggtcgggcgggtcgggtcgtaggggactagttctttacgacctcgtaccacagtcgagcgagtcccgtggccggtntaggaagtagttcggtggtcggttttacttacgtgtacaggtacagtttaacgtttcttacgtttaaccctccgttacgtacggtttacggttttccgggacccggtaacgggggtaacctaacgggtacggtagggaacggtaccgttaccgtacgaacggttaaccgttgggtaccggtacgttccggacctaaccg

SEQ ID NO: 220675 - DNA, 710 bp, Homo sapiens
  misc_feature: GYAE6OF01DYCZ6.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtcgccgtacggggacagtcgtgatcgaccctagtcctaccagacctcccgtggtctgtcgtctcgtcgggacgaggacgggaccacgtactaccaacgtcgacgaacgtccgacggtacggtagttgtttaacaacgaacctaccgaaagtaattaacgtagtttcttagcgttaggtaccagcaacgaacacgactcgacctacgtacgctcgtcgttcgttacgtcggccttaccgtaaccggggtacgtcccgggtacctagaacgttatcgacggtcggcggtcgggtacgcgggtactacgttacttccacttcgtaaccacgtacgtcgacgtcgtacggcgtacggcggtacgtaggtaacgtacggttacgggttacggttacgttttacgttacgtgtaaccgtaaggtacgtttaaagttatttacgtttaccgtttaccttacccgtacgttacgttaccggtttccgggtaaccggtaccgggaaccgtaacggtacggtagaacggtccgaccgtaccggtaacgtaacggtgtacgggcctacggtacctaccg

SEQ ID NO: 220676 - DNA, 777 bp, Homo sapiens
  misc_feature: GYAE6OF01AYYK6.39.85.H08.1.454.CMB.1.raw
  modified_base (455)..(455): a, c, t, g, unknown or other
  misc_feature (455)..(455): n is a, c, g, or t
tcagtcgcactagtcacgaccggtgctcgatttagtatcactcagtcgcgggggagctacaacaggcaggcgaggggcagcaagatggtgttgcagacccaggtcttcattttctctgttgctctggatctcttggttactacagggtcgaccgtacggggaccagttcggtgatcgacccgaggttcctccgacggaccttcccgtggccttcggttcgtccgttcgcggggacgaggacgggcccaacagtaccaacgtgacaacggttccacgaccgaggttacgttacgttttaaccaccggtaacggttaccaaaacgtaaacgtaaacgtaacttttaacgttccgttaacggttttcggaaaccctgaaccgaaacggaaaaccgtacgggaaccgtacgacccgttaacgttaacgtttactacccgttacttagttttacccgggngggacctaacgttcccggtaaccggggtaccgggtcccgggtaccttcggacttacgtccgacgggtacggtcacggtcgggttacaggtacgactagttcttacacttcctacgtacctactacgacgtaccgacgtccacgtccgacggtcgtagaaggtatacgtcgtacggttaacgtttcgtaactgtacgtacgtacgttagttacttaaggttacgtacgtaccgttacgtaccgggttcggttttaccgggaccgggtacgtaccggtagtacggtaacgtaaccgtaacgtaacggtaccgttgggtaaccgg

SEQ ID NO: 220677 - DNA, 762 bp, Homo sapiens
  misc_feature: GYAE6OF01BTDAC.39.85.H08.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagtcgcactagtcacgaccggtgctcgatttagtatcactcagtcgcgggggagctacaacaggcaggcaggggcagcaagatggtgtgcagacccaggtcttcatttctctgttgctctggatctctgttactacaggtgccgtacggggacatcgtgatcgaccctagtcctcagacctccctggctgtgtctcgtgggcgagnggccagatcactgacaagtccagcggtagttntttanaactacgtaccaagtaactaagtacgtttactttacgtacgttacgggtaacccaggtacaaaccggaaaacccgtaccggaactaccggtaccccttaccggtaaacgtcgtaccggttaccgtttacggttaaccggtccgggtaccttaccccgggtaaccgggtaacggtttccccggggtaacctaggtaaccgttacgttcccggtaagggttcggggcccgggtacgggtaccggtagggaacctaacggttactttacccgacggttccctaacgtacgtaccgtcgaacgtccgtaacggtcgtaccgggacgggtcgtaacggaagtacggttcgggtacggtttaacggtttacttacggttcgtacgtaacggttcgttaaagttctttaacgttcggtttaccttcgttacgttactcgggtttaccgacggttaccgggaacgttagcgggtaaggacggtagtcccggaacacgtaacggtgtacggtcgcgtcctaaccgg

SEQ ID NO: 220678 - DNA, 740 bp, Homo sapiens
  misc_feature: GYAE6OF01E0RFL.39.85.H08.1.454.CMB.1.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaacgtccagccggagtgttttanacaactccaanaataagngttcttagcttggtaccagacaagaacccacgacacncctacctaagtctgtcttacgtttactcgggccctcgtaccccggggaagtcccggggtaccctaggaaccgtnttccgaggtcgggccgggcggggttccgtagggggacctaaggtactttaccaccttccgtaccaaccctagtacccgacggccgaacggtccccgttcgggaccggggtaccgttaagggaacgttagtcggggtttacggggttaccggtttttaattacccggttggtaccgtaacggtaccgttaaaggtttagttttaaacgttccggttttaaaccccttcccgttaacgttaaccggtttacgggttttccggggacccggtaaccggggggaaacccctaaggggtccgttaaggggtaacgtacgttccggaaccgtaaccggtaacgtgggttacggcgttcggaccctaacccg

SEQ ID NO: 220679 - DNA, 1100 bp, Homo sapiens
  misc_feature: GYAE6OF01DGJSQ.39.85.H08.1.454.CMB.1.raw
tcagtcgcactagtcacgaccggtgctcgatttagtatcactcagtcgcggggtctgagagaggagcccagccctgggattttcaggttgttttcatttggtgatcaggactgaacagagagaactcaccatggaggtttgggctgagcgtggtcgttttctaggtcggtcttaattttaaaggtgtcagtgtggaggtgcagctgcgtggaggtcggtgggggagtcgttggtacgacggggtccccgggggggtcctggacgtaccttccttccgtggtacgaacgtcccgtacgttacgggtactttaccgtacccgttttaggaaccgttaaaggttcggtacggtacctaacgttaccgggaccccggtcgggggttaccccggccccggaacgggtcccggttaacccggggaacgggggggtaacgggggaccgggttcggggtaagggttccgggggttaaccttaccggtttaaagggttttaacgttttaaggggtttaggggtttaagggttacggggtttaaggttaaccgggaacctaaaccggttaaacggtttaacgtttaaacccgggaccgtaacggttaaccccgggttaccgggttaacggggaaacccgggggtttccccggtttaacccaacccgttaacgtttaccccgtaacccggaaaggtaaaccggtaaccccgttaaaacccttaaaccccggaaacgtaacccggtaactaacccggttagtttaaccgggtttaatttaccggaccttaaaccgtaacgttaaccggaaaccgttccgggtaaacccgtaggtaaaacccgggaccgggtaacccggggaaaccggttaacccggaacccgttaacccggtttaaagttttaaccttttaaaggtttaaccgggttttaccgggtaaaacccggttttaaaacccgggtttaaaacccgttttttttacccccggtttttaagggttaaaaccccgttttttacggggttttaaacccttttaaccccccgggtttaaacccgttccgggtttaaaacccgggtacccccggttaacccggggggtttaaccccggggggg

SEQ ID NO: 220680 - DNA, 654 bp, Homo sapiens
  misc_feature: GYAE6OF01ECRFT.39.85.H08.1.454.CMB.1.raw
  modified_base (456)..(456): a, c, t, g, unknown or other
  misc_feature (456)..(456): n is a, c, g, or t
  modified_base (643)..(643): a, c, t, g, unknown or other
  misc_feature (643)..(643): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacagtcgtgatcgaccctagtcctccagacctcccgtggcctgtcgtctcgtgggcgagacgggaccacgatcaactcgacaacgtccaggccggtattcgtttacaccaactacaagaatagtacgttacttagcgttagaccagacaacgtaaaccacgacgacgtcctacctagctcgtaccttacgtttaccgcggtaccttaccgtacccgggtaacttcccgggtaccaggtaccgtcgttacgacggtcggcgggtacgggtcgtaggactagttacttccaccgttcacctaccntaccgagaccgacgtcccgtcggcggacgtacggtaagtacgttaggttacggttacgtttactacttagacgacgtacgttagttacttagttaccgttaccttactacgtacgttacggttaccggaccggtaacggtaaccgaggtcgtaggacgtcgaccgtacgacgtacgtcgtacggtcnccggtctaccg

SEQ ID NO: 220681 - DNA, 684 bp, Homo sapiens
  misc_feature: GYAE6OF01C448J.39.85.H08.1.454.CMB.1.raw
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (432)..(432): a, c, t, g, unknown or other
  misc_feature (432)..(432): n is a, c, g, or t
  modified_base (468)..(468): a, c, t, g, unknown or other
  misc_feature (468)..(468): n is a, c, g, or t
  modified_base (474)..(475): a, c, t, g, unknown or other
  misc_feature (474)..(475): n is a, c, g, or t
tcagtcgcactagtcacgaccggtgctcgatttagtatcactcagtcgcgggggagctacaacaggcaggcaggggcagcaagatggtgttgcagacccaggtcttcattctctgtgctctggatctctgttactacgaggtgccgtacggggacagtcgtgatcgacccngtcctccagacctccctggctgtgtctcggngggcgaggacggccacgactcaacgtgacaacgtccgacggtccgggtaagtttcgttttaanaacctaacctaccgaaaagtaaataagtacgttttactttacgtcttacggtaccaagaccaacgaaaccgacgaccacgaccctacgtaagcctacgtcgttacggttacgtccgggcctaccggtaacccgggtaccggtcccgggtcctagaacgtcgtacggnggtcgggcggtcgggtcgtaggactgtacttctacnctcacnncgagcacgcgtcggcgtcgtacgagtcgtggtcgttacgtttatcgtgtcgactagttagttacttagttccgtaccttcccgttaagtacggttcggtttacccgggaaccggaaccgggtaacgtaccgggacgtaacgggtaacggtcgttaccccgggacttaaacgggtacgttaccggtagggccgtccgtacccgtaaccgg

SEQ ID NO: 220682 - DNA, 733 bp, Homo sapiens
  misc_feature: GYAE6OF01A2RWQ.39.85.H08.1.454.CMB.1.raw
  modified_base (174)..(174): a, c, t, g, unknown or other
  misc_feature (174)..(174): n is a, c, g, or t
  modified_base (243)..(243): a, c, t, g, unknown or other
  misc_feature (243)..(243): n is a, c, g, or t
  modified_base (366)..(366): a, c, t, g, unknown or other
  misc_feature (366)..(366): n is a, c, g, or t
  modified_base (486)..(486): a, c, t, g, unknown or other
  misc_feature (486)..(486): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (723)..(723): a, c, t, g, unknown or other
  misc_feature (723)..(723): n is a, c, g, or t
tcagtcgcactagtcacgaccggtgctcgatttagtatcactcagtcgcgggggagctacaacaggcaggcagggcagcaagatggtgttgcagacccaggtcttcatttctctgttgctctggatctctgttactacaggtgcctaggggacatcgtgatcgacccagtctcngtactcctggctgtgtctctgggcagcggccagatcaactcgacaagtccagccggtagtcgttttaanactaactaccgaaagtaagtaagtagtttaccgtttaagcgtttacggtaccagacgtacggaaaccaccggaactaggtcccctaccgttaaacgtccttcggccgttacggtttttaccgngggttaccccgtccgttaaccgggaacgttacccggggttccctaacggtacgtaacgttcgaacggtcgggtccgggtacgggtccgtgggaaccttcggtaacgtttccacgttaccncgttaacctacggtaacccnggtacnccgttcccgtggtcggtacgtacgggtaacgaggttcgtacgggttacgtttacgtttaacgtcgttcgaggttaccaaggtttacttattccgttaccgttctcgtaacttcgggttttacggccgtaaaacgggggtccaaacgggttctacgggtacgttaacgccggtaaacgtaccgttaaagttcccggtaggtcgttacccggnggttaacccc

SEQ ID NO: 220683 - DNA, 503 bp, Homo sapiens
  misc_feature: GYAE6OF02I696B.39.85.H08.1.454.CMB.1.raw
  modified_base (243)..(243): a, c, t, g, unknown or other
  misc_feature (243)..(243): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccggggtcctgaacgattcagtggcggcgggtctgggacagatttcactctcaccatcagcagcctgcgggctgaagatgtggtcgtttattactgtcagcagtattatgttactctcactagtttggccagggaccaggctggagatcgcacgactgtgctgctac

SEQ ID NO: 220684 - DNA, 532 bp, Homo sapiens
  misc_feature: GYAE6OF02H9VA1.39.85.H08.1.454.CMB.1.raw
  modified_base (298)..(298): a, c, t, g, unknown or other
  misc_feature (298)..(298): n is a, c, g, or t
tcagtcgcactagtcacgaccggtgctcgatttagtatcactcagtcgcggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacagccgggggggtccctgagactctcctgtgaagcctctggattcacctttgacaagtgtgccatgacctgggtccnccaggctccgagggaggggctggagtgggtctcagttattagtggtagtggtagtagcacagattacgcagactccgtgaagggccggttcaccatctccagagacaattaccaacagcacgctgtatttgcacatgaacagcctgagagccgagacacgccatatattattgtgcgtaactttctttagtactaggttacttactaccccttagtacgtacccacgtacgggg

SEQ ID NO: 220685 - DNA, 515 bp, Homo sapiens
  misc_feature: GYAE6OF02IS5KB.39.85.H08.1.454.CMB.1.raw
  modified_base (243)..(243): a, c, t, g, unknown or other
  misc_feature (243)..(243): n is a, c, g, or t
  modified_base (413)..(413): a, c, t, g, unknown or other
  misc_feature (413)..(413): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactgggcctcgtacccgggaatccggggtcctgaacgattcagtggcggcgggtctgggacagatttcactctcaccatcagcagcctgcggctgaagntgtggtcgtttattactgtcagctagttattattgttactcctctactagtttcggccgagggacaaggtctggagntcgacacgacgtgnggctgctaccg

SEQ ID NO: 220686 - DNA, 516 bp, Homo sapiens
  misc_feature: GYAE6OF02GYY9N.39.85.H08.1.454.CMB.1.raw
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaacacgacagcctcctaagctgctcgtttactgggcctctacccgggaatccggggtccctgaccgattcagcggcagcgggtctgagacagatttcactctcaccatcagcagcctgcaggctgaagatgngctagtttatactgtcagctagtattactagtagtcctnagtcgttttcggccggggtaccaagcgttggagactacgaaacgacgtgtcggtctacgg

SEQ ID NO: 220687 - DNA, 507 bp, Homo sapiens
  misc_feature: GYAE6OF02FVGNH.39.85.H08.1.454.CMB.1.raw
  modified_base (241)..(241): a, c, t, g, unknown or other
  misc_feature (241)..(241): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagccagccggagtgtttanacaactccaagaataagagttctttagcttggtaccagcagaaccacgacagcctcctaagctgctcgtttactgggcctctacccgggaatccggggtccctgaacgattcagtggcggcgggtctggggacagatttcactctcaccatcagcagcctgcgggctgagatgtggtcggtttattactgtcagcagtattatgttactcctcactagtttgccagggaccaaggctaggagatcgcgacgactgtggctgctacc

SEQ ID NO: 220688 - DNA, 520 bp, Homo sapiens
  misc_feature: GYAE6OF02F9ZWW.39.85.H08.1.454.CMB.1.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttacngggcctcgtacccgggaatccgggtcctgaacgattcagtggcggcggtctgggacagatttcactctcaccatcagcagcctgcggctgaagatgtggtcgtttattacgtgtcagcagttattattgttactcctctactagtttggccgagggaccaaggtcgtaggagatcgacacggtactggtggcgtcgctaaccg

SEQ ID NO: 220689 - DNA, 520 bp, Homo sapiens
  misc_feature: GYAE6OF02H7ARW.39.85.H08.1.454.CMB.1.raw
  modified_base (243)..(243): a, c, t, g, unknown or other
  misc_feature (243)..(243): n is a, c, g, or t
  modified_base (492)..(492): a, c, t, g, unknown or other
  misc_feature (492)..(492): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcaagaaaccacgacagcctcctaagctgctcgtttactgggcctcgtacccgggatccggggtcctcgaacgattcagtggcggcgggtcgtggggacagatttcactctcaccatcagcagcctgcgggctgaagatgtggcggtttattactgtcagctagtattatgttactcctcactagtttcgccaggggacctaaggctagganagtcgcgacgaacgtgtcggctgctacc

SEQ ID NO: 220690 - DNA, 541 bp, Homo sapiens
  misc_feature: GYAE6OF02I5P3R.39.85.H08.1.454.CMB.1.raw
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaaagaataagagttcttagcttggtaccagcaagaaaccacgacacgcctaccaagctgctcgttacnggcctcgtaccggatccgggtccctgaacgattcagtggcggcggtcgtggacagtactttcacttcgtcaccatcagcagcctgcggctgaagntggtggtacgtttatacgtgtcgagtctagttattattgttactcctctacgttagtttcggaccgtaggggacctaggtcgtaggagtacgtcgacgacgtaacgtggtcggtcgtgtaccgtaccg

SEQ ID NO: 220691 - DNA, 508 bp, Homo sapiens
  misc_feature: GYAE6OF02GDTAI.39.85.H08.1.454.CMB.1.raw
  modified_base (241)..(241): a, c, t, g, unknown or other
  misc_feature (241)..(241): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccgagtgtttanacaactccaagaataagagtctttagcttggtaccagcagaaaccacgacagcctcctaagctgctcgttactggcctctaccgggaatccgggtccctgaacgattcagtggcggcggtctgggacagatttcactctcacatcagcagcctgcggctgaagatgtggcggtttattactgtcagtcagtattatagtagtcctctagtactttggccggggtaccaaggcgtggagatacgaaacgacgtgtggctgcaccatcg

SEQ ID NO: 220692 - DNA, 521 bp, Homo sapiens
  misc_feature: GYAE6OF02FO84D.39.85.H08.1.454.CMB.1.raw
  modified_base (243)..(243): a, c, t, g, unknown or other
  misc_feature (243)..(243): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgttactgggcctctacccgggaatccgggtcctgaacgnttcagtggcgcggtcngggacagnttcactctcaccatcagcagctgcgggctgaagntgtggtcgtttatacgtgtcagctagtattattcgttactccttcacttagttttcggccgtagggaccaaggtcgtggagtacgtcgacgacgacgttggtggctgctaccg

SEQ ID NO: 220693 - DNA, 554 bp, Homo sapiens
  misc_feature: GYAE6OF02HNKGW.39.85.H08.1.454.CMB.1.raw
  modified_base (244)..(244): a, c, t, g, unknown or other
  misc_feature (244)..(244): n is a, c, g, or t
  modified_base (322)..(322): a, c, t, g, unknown or other
  misc_feature (322)..(322): n is a, c, g, or t
tcagtcgcactagtcacgaccggtgctcgatttagtatcactcagtcgcgggggagctacaacaggcaggcagggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactccaagaataagagttctttagcttggtaccagcaagaaaccacgacagcctacctaagcctgctcgtttacngggcctcgtacccgggaatccggggtccctgaacgattcaggtggcggcgggtctggggactaggatttcgactctacaccatcagcagcctggcggctagaagagtggtggtcggttttatacgtgtcgagcgtagtatttagtgttacctcctctacgtaggtttcggaccgggacggacgtacggtcgtaggacgtcgtcgacgtacgacgtggtcggctcgactaccg

SEQ ID NO: 220694 - DNA, 781 bp, Homo sapiens
  misc_feature: GYAE6OF02IK7UE.39.85.H08.1.454.CMB.1.raw
  modified_base (331)..(331): a, c, t, g, unknown or other
  misc_feature (331)..(331): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacggggacatcgtgatgacccagtcctccagacctccctggctgtgtctcgtgggcgaggacgggccacgatcgaactgacaacgtccaggccggtagttgttttacacaacctaccaaagtaataagtacgtttcttagcttaggtaccagacaacgaaaccacgacacgaccctacgtaanctcgcctttacgttacgtcgggacccttacggtaacccgggtacgtcccgggtacctaggaaccgtacttcgacgggtcgggaccgggtcgggttcgtacggggtaacacggttactttaccgaacctttcccgtaaccgaacccgtacgtacgacggtaccgtacggtcccggtacgggccggggtacgtaacggtaaggtacggttacgggttcgggtttaaccggtttttacgttaaccggttcggtaccgtaacggttaccgtaaggttttaacgtttacgtttaccggtttacccgtttaccttaccgtaaacggtttacggttttccgggaacccggtaaccggggtaaccgtaacggtcggtaacggggtaacgtaccggtaaccgtaacccgtaaccggtaacggtttccggtaacgggtccgttaccggaccttaacccgg

SEQ ID NO: 220695 - DNA, 828 bp, Homo sapiens
  misc_feature: GYAE6OF02IX3IK.39.85.H08.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctctgggcgagngggccacgatcaactgcaagtccagccggagtgttttanacaacctaccaagaataagtagttctttagccttaggtacagcaagaaaccacgacacgcctacctaacgctgccttcgtttacgtcggggtcccttacgtaccccggggtaacgttccccggggtccctacggtaaaccgtacgtttacggaacggttcggggaccggggtccgggggtttaccgttagggggggaaccctaacgggttaactttttaccgaacctttccccgttaccgaaccctaacgttaccgaacgaccgtaaccggtcccgttacgggcccggggtaccgttacgggaaaacggtacggtttagggttacggggttaccgggttttttaacgtttaaccggtttaccggttaccgtaacgggttaaccgttaaggtttaaacgtttttaacgtttcggtttaacctttccccgtttaacgttaaccggtttaacgggtttttacgggaacccgggtacggggggttaaaccctaagggttaccggttaaggggtacgtaaggttacccggtaccggttaaaccggtaacggttcggttacgggtcccggttaccggtacccgtaacccg

SEQ ID NO: 220696 - DNA, 707 bp, Homo sapiens
  misc_feature: GYAE6OF02FZRY9.39.85.H08.1.454.CMB.1.raw
  modified_base (243)..(243): a, c, t, g, unknown or other
  misc_feature (243)..(243): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaacctccaagaataagtagttctttagcttggtaccagcaagaaaccacgacagcctacctaagctgcttcgtttacgtcgggtcctccgtacccggggtaacgtcccggggtccctaggaaccgtattacgaggtcgggccgggtcggggttcgtggggactaggtacttttccaccttcctaccacctactaccgagccacggtcccgtacgggccgggtacgtacggaaggtagttggttacgggttacgggttttaatttaaccgttcggtaccgtaaggtcctaaggtttagtttacgttcggtttaaccttccttaacgtacgtttacggtttttccgggacccggtaacgggggtaacccgtaacgggtccggttaggggtaaccggttaacggtaccggtaccgtaaccggttaacggttcgggttacgggtcccttacggacccttaacccgg

SEQ ID NO: 220697 - DNA, 666 bp, Homo sapiens
  misc_feature: GYAE6OF02IU4YT.39.85.H08.1.454.CMB.1.raw
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagaggccagatacaactgacaagtccagccggagttgtttanaccaactccaaagaataagtagttcttagcttaggaccagcaacgaaaccacganacgcctactaagctacgtcttacgtttacgcgggaccctacggtaccccgggaacgtcccgggtccagaaccgtatccgaaggtcgacggtcggtancgggactaggtactttccacttccactacctatacgaacgcgaacgccgtacgggccggtagtacgaacgtagttcgggttacgggttaccgttttaacgtacgttcgtaccgtaagacctaagttacgtttacgttacgtttaaccctaccgttacgtacgttacggttttacgggacccggtaacggggtaacccgtaggaaccggttaggaacggtactaccggacgtaaccgtaacggtgttacgggcttacggacccgtaaccg

SEQ ID NO: 220698 - DNA, 577 bp, Homo sapiens
  misc_feature: GYAE6OF02IOIZA.39.85.H08.1.454.CMB.1.raw
  modified_base (241)..(241): a, c, t, g, unknown or other
  misc_feature (241)..(241): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactcctggctgtgtctcgtgggcgagagggccacgatcaactgcaagtccagccggatgtttanacaactccaagaataagagttcttagcttaggtaccagcaagaaaccacgacacgcctacctaagctgtctcgtttactgggcctcgtaccgggactccgggcctagacgattcgaggtggcggtcggtcgtagggacaggtatttccacgttctacaccatcacgcgagtccgtcggcgggcgagaagagtggtacgggtcggtttaagttacgtgtacgagtgtagttattaattcgttactcctacgtacttaggttttcgccggtacgggaccgtaacgcgtaggacggtacgtacgacgtaacgtaacgttcggtggtacgtgaccgtacc

SEQ ID NO: 220699 - DNA, 626 bp, Homo sapiens
  misc_feature: GYAE6OF02HG16X.39.85.H08.1.454.CMB.1.raw
  modified_base (262)..(262): a, c, t, g, unknown or other
  misc_feature (262)..(262): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagtcgcactagtcacgaccggtgctcgatttagtatcactcagtcgcggggtctgagagaggagcccagccctgggattttcaggtgttttcatttggtgatcaggactgaacagagagaactcaccatggagtttgggctgagcgtggtcgttttcttaggtggctaattttaaaaggtgtccagtgtgaggtgcagctgcgtggagtcgtgggggaggcttggtacaggccgggggggtcctgagactctcctgtgancctctggattcacctttgaaccaagtgtgaccatcgacctcgggtccgccaggcctaccgaggggaaggggcctagggaggtgggtctcgagtttagttaggtgggtagttacgggtagtagcctaacagtaactttacgcaggtaacctccggtagaacggggtccggttcaccctatcctacgacgagaactaacgttaccaaanacgacacgntacgttntttgactacgatacgaacctgacctagacgagccggtacggaactacggcaacttatattagttagtacgacgttaacctttacgtttgtacgtttaggtttaacttacctaccgttacgtacgtacccgtacgtaccggg

SEQ ID NO: 220700 - DNA, 624 bp, Homo sapiens
  misc_feature: GYAE6OF02FHNMO.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgaggagggccacgatcaactgcaagtccaggccggtagttgttttaacacaactccaaagaactaagtagttctttagcttggtaaccagcaagaaaccacgacagcctacctaagctcgctcgttactggccctacgtaccccggggaatcccggggtcctagaacgtagttcgaggttcggacgggtcgggttcgtaggggactaaggttacttttccgaccttctaccacccgtatccgacggccaacggcctgggccgggctaggaacgtgtacggtgggttacgtttagttacgtcggtacacgtcagttattacttcgttacctcctactacgttagtttccggaccggtacgggacctaaggtcgtagggaacacgtcgaccgaacgacgttcggtggtccgtacaccgtaaccg

SEQ ID NO: 220701 - DNA, 807 bp, Homo sapiens
  misc_feature: GYAE6OF02IM9MH.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcattttctctgttgctctggatctctgttactacaggtgcctacggggacatcgtgatgacccagtctccagactccctggctgtgtctcgtgggcgaggacgggccagatcaactgacaacgtccgaggccggtagttgttttactaaccaacttacccaaaagtaaacttaaagtacgttttctttaagctttggtaacccagccaaagaaaacccacgaacacgtacccttaccgtaaagcctgccgttccgttttacgacgggtcccttaccgtaaccccgggggaacgttccccgggggtaccctcggtaaaccgtagtttaccgagggttcggggcccgggtcgggggttacgtcgggggtaacctagggttactttacccgactttcccgtacaaccctattaccgaacgtaccacggtccgttaccgggaccggggtactacgggaaacgttacggttagggttacggggttacgtttttaacgttacgttacggtaccgacgttaccgttaagttttacgtttacgttttacggtttacccttacccgtttaacgtaaccggttttaacgtttttccggggaaccggtaaccgggggtaaccgtaacggccggttaagggtaacgtacggtacccgtaacgttaaccggtaacggttcgggttacgggtacccgttcgacccgttaacccgg

SEQ ID NO: 220702 - DNA, 608 bp, Homo sapiens
  misc_feature: GYAE6OF02HQXZK.39.85.H08.1.454.CMB.1.raw
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatcgacccagtcctccagacctccctggctgtgtctcgtgggcgagacgggccagatcaactgacaacgtccaggccggagttgtttacactaactaccaagaactaagagtttacttagtcttaggtaccagtcaaacgtaaacccacgaacacgtccctactaacgtcctcgctttacgttacgcggtcctaccggtacccggggtaagttccccggggtcctacggtaacgtacttcgaggtcgggccggtcgggtacgttgggactagttacttcgactctacacactcgacgcacgtcgtggccggntagagngtggttgcgtttatacgtgtacgagtctaacgttatacgttgttaccttcgtaccgtagttcgttacgacggtacggacaggtcggtagacgtcgtacgacgacgtacgtcgtaggtccgtgcctaccg

SEQ ID NO: 220703 - DNA, 597 bp, Homo sapiens
  misc_feature: GYAE6OF02F98UB.39.85.H08.1.454.CMB.1.raw
  modified_base (185)..(185): a, c, t, g, unknown or other
  misc_feature (185)..(185): n is a, c, g, or t
  modified_base (247)..(247): a, c, t, g, unknown or other
  misc_feature (247)..(247): n is a, c, g, or t
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacgggacatcgtgatgacccagtctccagacctcccgnggctgtgtctcgtgggcgaggacgggccacgatcaactgcaagtccagccggagtgttttanacaactccaagaataagagttctttagcttgtacctagcagaaaccacgacagcctctaagctgctcgttactcggcctcgtacccgggatcccgggtcctgaacatcgagtcggcggcggtntcgggacagtacttcacctctcgaccatacacgcacgcctggccgggtntaggaaagtagttggtacgggttacggttttaacttacgttgtaccgtaagcgtaagttagtttaagttcgtttaccttccttaacgtacgtttacgtttccgggacgtaccggggtaacctaaggtccggttaggagtaacgtcgacgacgtacgtaggtcggtctacggctaaccg

SEQ ID NO: 220704 - DNA, 617 bp, Homo sapiens
  misc_feature: GYAE6OF02I1KE2.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctcagactccctggctgtgtctcgtgggcgagacgggccacgatcaactgacaacgtccagccggtagtgttttacacaactccaaagtaataagtagttacttagcttaggtaccagacaacgaaaccacgacagcctacctaagctgctacgttacgtcggtcctcgtacccgggacgtccgggtcctagaacgtattcgaggtcgggcgggtcgggtcgtcggggacctagtactttacacttctaccaccgtactccagtccgacgtccgtggcggtactacggaaagtagttcggtgggttaccggtttattacgtgtacgtagacgtagttatttagttcgttacctccgttactacgttaggtttcggaccggtacgggtaccaaggtcgtagggacgtacgtacgacgtacgtaccgttggcgtcgtacgccgtaacg

SEQ ID NO: 220705 - DNA, 630 bp, Homo sapiens
  misc_feature: GYAE6OF02FGS0O.39.85.H08.1.454.CMB.1.raw
  modified_base (441)..(441): a, c, t, g, unknown or other
  misc_feature (441)..(441): n is a, c, g, or t
  modified_base (487)..(487): a, c, t, g, unknown or other
  misc_feature (487)..(487): n is a, c, g, or t
tcagtcgcactagtcacgaccggtgctcgatttagtatcactcagtcgcggggtctgagagaggagcccagccctgggattttcaggtgttttcatttggtgatcaggactgaacagagagaactcaccatggagtttgggctgagctggcttttcttgtggctatttaaaaggtgtccagtgtgaggtgcagctgctggagtcgtggggggaggcttgggtacgaggccggggggggttcccctggacgacctcctcctggtcgaacgtccctcgtgggacttccaccttttgacaaggtcgtgcccatcggacccttgggtcccgccaggcctccgaggggaagggctggaggtgggtctcgaggttataggtggtagtggtagtagcacagtacttacgcagacctccggtgaacgggcccggttacaccatctcagngaacaacttccaacacgccacgcttagtatttgctacatagaaccngccgtaggacgacgtccggaaggaccgaaccgaccattactatttagtacgtcgtaaccgttaaacctttccgttttacgtacgtttacgggtttacttacccgttaccccgttagtacccggaccgtacggttacccggggg

SEQ ID NO: 220706 - DNA, 937 bp, Homo sapiens
  misc_feature: GYAE6OF02IWG6Y.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacggggacatcgtgatcgacccagtctccagacctccgtggctgtcgtctcgtgggcgaggacggccagactacaacgtgacgaacgtccgaggccggtagttacgtttaactactaactaccaaagtaataagtagtttactttagtacttaggtaccaagacaacgtaaaaccgacgaaccacgtccctaccgtaagccgttcgtaccgttaccggtttaccgtcgggtacccgttacccggtaaccccgggggtaacgttaccccgggggttaccctacggtaacccgtaacgtttaccggacggttacggggtcccgggtccgggggttacgtacgggggtaacgtaacgggttacgttttacccgtaacccgtttcccttaaccgaacccgtaacgtaccggtaacggtaaccgtaaccggtcccgtacggggtcccgggtaaccgttaaggggtaaacggtacggtttacggggtttaccggggttttaaccggtttttaacggttttaccggttaccggttaccggtaaaccggttacggtttaaacggttttaacgtttttaaacggtttaccggtttaacccctttacccgttaacccgtttaaccgggttttaaacccggggtttttacccgggtaaccccggggtaaccgggggtaaacccgttaacggggtacccggttaacggggtaaccgggttaaccgttacccgggtaacccgttaaaccgggttaacccggttacgggtaaccggttcccgtacggtaaccccggttaaccc

SEQ ID NO: 220707 - DNA, 724 bp, Homo sapiens
  misc_feature: GYAE6OF02IVS4A.39.85.H08.1.454.CMB.1.raw
  modified_base (593)..(593): a, c, t, g, unknown or other
  misc_feature (593)..(593): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacggggacatcgtgatcgacccagtctccagacctcccgtggctgttgtcctcgtgggacgaggacgggccacgactaccaactgacaacgtccgacggccggtagttagttttactaaccgaaccttaccgaaagtaaataaggtacgttttacctttaaggtccgttacggtacccaagtacgaaacggaaacccacggaccacgtccctaccgtaagctacgtccttacgttaccggtcggtacccttccggtaacccggggtacggtccccgggtccctagtaaccgtgttaccgagggtcgggccgggtcggtacggtagggaactacgttacttcctaccgttcctaccaacctacgtagaccgacgtacgtcccggtggaccgggtagtaaggtaagcgttagggttcgggttaccggttttaattccggtcgtacgngtacgttagtttatttacgttacgttaccgtccttaacgtcgtttaacgggttcgaacggtacgggacctacggtcgacgggagtaccgtacgtaccgtaacgtacggttggtacggccgttacgacctcg

SEQ ID NO: 220708 - DNA, 621 bp, Homo sapiens
  misc_feature: GYAE6OF02IU97I.39.85.H08.1.454.CMB.1.raw
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
tcagtcgcactagtcacgaccggtgctcgatttagtatcactcagtcgcgggggagctacaacaggcaggcaggggcagcaagatggtgttgcagacccaggtcttcattttctctgttgctctggatctctgttactacaggtgcctacggggacatcgtgatgacccagtctccagactcctggctgtgtctctgggcagagggccacgatcaactgcaagtccagccggagtgttttacacaactccaaagaanaagagttcttaagcttggtaccagcagaaacacgacagccnctaagctgctcgttactgggcctctacccgggtaatccgggtcctagaacgtattcagtcggcggcggtcgtgggacaggtactttcgacgttcctactaactactcaagcacggctacggcggtcgtgaagacgtgttacggtaggtttaattacgttacgtcgagcgtaagtaattttacgtcggtttaacctacctttaccgttaaccttaggttttaccgggtcccgacgggggttaacccgaaggtacgttaagggtacgtaacgtccggtaccgaacggttaacctaggttacgggtaccttcggaaccgtaacccg

SEQ ID NO: 220709 - DNA, 785 bp, Homo sapiens
  misc_feature: GYAE6OF02JNC33.39.85.H08.1.454.CMB.1.raw
  modified_base (266)..(266): a, c, t, g, unknown or other
  misc_feature (266)..(266): n is a, c, g, or t
tcagtcgcactagtcacgaccggtgctcgatttagtatcactcagtcgcgggggagctacaacaggcaggcagggcagcaagatggtgttgcagacccaggtcttcatttctctgttgctctggatctcttgttactacaggtcgcctacggggacatcgtagatcgacccagttcctccacgacctccgtggctgtgtcctcgtgggcgaggacgggccacgtatcaacttgcctaacgtccacggccggtagtttcgttttaanaccaaccgtacccaaaagtaataagttacgtttcgttttacggacgtttacggtacccaggtaccaaacggtaaaacccaaccggtaccgtaaccgtccctacccggttaaacgtccgtacgtacccgttttacggtttacggtaccgggtccccttacccgggttaaacccccgggggtaccgtaccccgggggtttcccctaaggtaaccgtacgtttacggacgggttggggcccgggtcgggggtaccttaggggacgtaacgttactttcccgaacctttcccgtactaccgtactccgtacggacgtaccgtccggtacggcgggtacgtacggaagtttacggtgggttacgggttcgtttaaactcggttacgtcgacgtatacgtttagttagttcgttaacctcgtacctaaggttcgttccgtaccgggtacggaaccgtacggtaggtacggtacgtaacggtccggtaacggtacgtaccgttcggacgtaccggtctacctaccg

SEQ ID NO: 220710 - DNA, 736 bp, Homo sapiens
  misc_feature: GYAE6OF02GDK3Y.39.85.H08.1.454.CMB.1.raw
  modified_base (322)..(322): a, c, t, g, unknown or other
  misc_feature (322)..(322): n is a, c, g, or t
tcagtcgcactagtcacgaccggtgctcgatttagtatcactcagtcgcgggggagctacaacaggcaggcagggggcagcaagatggtgttgcagacccaggtcttcatttctctgttgctctggatctctgttactacaggtgcctacggggacatcgtgatgacccagtcctccagactccctggctgtgtctcgtgggcgaggacgggccacgatacaactgacaagtccaggccggtagttgttttaacacaactccaaagaataagagttctttagcttggtaccagcaacgaaaccacgacacgcctactaagcngtcttacgttacgtcgggcctacgtacccggggaactccggggtccctaggaaccgtacttcgacggtcgggcgggccggggttcgtagggggaccgtaaggtaacttttaccgacctttctacctaacctactacgtaacgaccgtaacgcccgtgggaccgggtacgttaggtaaagtaggttacgggtcgggtttacggttttaagttacgttcgtacgaacgtacggtagttaaatttacgttacgtttaaccgttaccccgttaccgtaacgtttacgggtttttaccggggacccgggttaaccgggggaacccgtaacggtaccgggttaagggtaacgtaccggttaccggaaccggtaccggtaaacggttcgggttacgggtccgttagggccccttaaaccgg

SEQ ID NO: 220711 - DNA, 574 bp, Homo sapiens
  misc_feature: GYAE6OF02FLXYO.39.85.H08.1.454.CMB.1.raw
  modified_base (246)..(246): a, c, t, g, unknown or other
  misc_feature (246)..(246): n is a, c, g, or t
  modified_base (320)..(320): a, c, t, g, unknown or other
  misc_feature (320)..(320): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggcccaacgatcaactgacaagtccagccggagtgtttanacaactccaaagaataagagttctttagcttggtaccagcaagaaaccagacagcctctaagctgctcgtttancgggcctcgtacccgggaatcccggggtcctgaaccgtattcgagtcggcggtcgggtctgggacaggtctttcactctcaccatcagcagcctgcggctagactgtgtggtacgtttatcgtgtcagctagtattatcgttactcctacgtacgttcgtttacggaccgtacggggtaacctaaggtccgtagggtaacggacgttccggaacgtaacggtaaccgttggtacggtctacggtacctaacccg

SEQ ID NO: 220712 - DNA, 751 bp, Homo sapiens
  misc_feature: GYAE6OF02HZOEP.39.85.H08.1.454.CMB.1.raw
  modified_base (698)..(698): a, c, t, g, unknown or other
  misc_feature (698)..(698): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgaggacggccacgactacaactgacaacgtccagccggtagttgtttaacaacaacttccaaagtaaactaagtagtttacttaggacttacggtaaccagctaaacgaaacctacgaacctacgtacctaccgtaagccttacgcctttacgtttaccgtcggggtacccttaccggtaaccccggggtaacgtccccgggggttacccctaaggtaaccgttacgtttacggtaacggtcgggtccggggtacggggttaccggttacgggggaacttaaggtaaccggttttacccaaccgtttacccgtaccgaacccgtaacttacccgaaacggtcccaacggtccgtaccgggtccgggacgtacggaagttagttcggttcgggttacgttttaacgttaccgtggtacaggtaccgtaagttaacttttagttaccgttaacctccgttacgtacgttaggtttccgaccggtacggactaacggnttacggagtacgtaccgacgtaacggtaagttcggtaggactacgacctaacg

SEQ ID NO: 220713 - DNA, 776 bp, Homo sapiens
  misc_feature: GYAE6OF02I5LIX.39.85.H08.1.454.CMB.1.raw
  modified_base (100)..(100): a, c, t, g, unknown or other
  misc_feature (100)..(100): n is a, c, g, or t
  modified_base (206)..(206): a, c, t, g, unknown or other
  misc_feature (206)..(206): n is a, c, g, or t
  modified_base (534)..(534): a, c, t, g, unknown or other
  misc_feature (534)..(534): n is a, c, g, or t
tcagtcgcactagtcacgaccggtgctcgatttagtatcactcagtcgcgggggagctacaacaggcaggcaggggcagcaagatggtgttgcagacccnggtcttcatttctctgttgctctggatctcgtgttactacgtaggtgccgtacggggactagttcgtagattcgaaccctagttcctaccgaacggtccttcccgnggtcgttgtttcggtccttacggtcgggggcgaacggggaccggtccgaacggtaacttaccgaaccgtcgaccgtaaacggtcccgaacggtacgggtagttttacgttttaacaacctaaacctacgaaaagtaaagttaacggtacgttttacctttaggtccgtttaaggtaccaaggtacaaaacggtaacccacggtaaccacggttccccttaacggtaacgtctacggttaccttttaccggtttacggcccgggtaccttaaccccgggtaacccggggtaccgttcccggggtaccttaaagggactacgtttacggngggtccggggacccggtcgggttagtacgggaactcgttttaccttcgtaacctccgtaacaccgtactacgtacgcgacgtccgtcgacggacgtagtacgttgtggttcggttacgttacttgtcgtcgtacgtacgtattattacgttcctacttactcgttacgtcgttcgggtacacgtacgtaggtcgtacgcgtacgtacgtacgtacgtacgtgtacggtctaccggtataccg

SEQ ID NO: 220714 - DNA, 738 bp, Homo sapiens
  misc_feature: GYAE6OF02GAANH.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcattttctcttgttgctctggatctctgttactacgaggtgcctacggggacatcgtgatcgacccagtcctccagactccctggctgtgtctcgtgggcgaggacgggccacgataccaactcgacaagtccacggccggtagtttagttttaacaaccgtaactaccgaaagtaaacttaaaggtacgttttactttaagaccgtttacggtaaccagtaccaaacggaaaacccgacgaaccgtacggtaccccttaccgtaaagccttcggtacctttaccggttttaccgtcggggtaccccttacccggtaaccccggggtaacgttccccggggttaccctacggtaacgtacgtttcgagggtcgggtcgggtccggggtcgtaggggacctaggttactttccgaccttcgtaccaccgtacgtccgagcgacgtcgtcggcgggcgtaggacgtagttcggtcggttacgtttacttacgttcgtacgtagtacgttagttacgtttacgttccgttacttccgttacgtacgtttcggtttcggaccggtacgggacctacggtcggtaggacgtacgtcgtaccgtaacgtaccggtggtacggtccgtacgacctaccg

SEQ ID NO: 220715 - DNA, 721 bp, Homo sapiens
  misc_feature: GYAE6OF02FN2B5.39.85.H08.1.454.CMB.1.raw
  modified_base (160)..(160): a, c, t, g, unknown or other
  misc_feature (160)..(160): n is a, c, g, or t
tcagtcgcactagtcacgaccggtgctcgatttagtatcactcagtcgcgggggagctacaacaggcaggcaggggcagcaagatggtgttgcagacccaggtcttcatttctctgttgctctggatctctgttactacaggtgccgtacgggacatcgngatgaccagtccacacgactcctggctgtgtctcgtggggcgaggacgggccaacgatacaacgtgacaacgtccagggccggtagttagttttaacaactaacctaccgaaagtaagtaaacggtaacgtttactttagtcgttacgaccgagtaccaaacgaacccacgaaccacgtccctaccgtaagactcgtacgttcgttaccgcggtccctacggtaaccggggtacttccggggacctacggaacgtattcggaggtcggggtccggtgggtacgtacgggaacttagtccttccgtacgtcctacacctatacgagaccgacgcgcgggtacgacgtacgagtagttcggttacggttacgttttactaccgttgcgtaacgtacgtaacgtttacgttagttccgttaacgttacccttaacgttaccggtttagggtttaaccggaccgggttaaccgggtacgtacggtaacggtaacgggtacggtaacggtaccgtaaccggtaacggtacggttcggtacgggtaccttaccggacccttaaccgg

SEQ ID NO: 220716 - DNA, 550 bp, Homo sapiens
  misc_feature: GYAE6OF02FGBHL.39.85.H08.1.454.CMB.1.raw
  modified_base (245)..(245): a, c, t, g, unknown or other
  misc_feature (245)..(245): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagtcgcactagtcacgaccggtgctcgatttagtatcactcagtcgcgggggagctacaacaggcaggcaggggcagcaagatggtgttgcagacccaggtcttcattttctctgtgctctggatctctgttactacaggtgcctacgggggacatcgtgatgacccagtctccagactcccctggctgtgtctctgggcgagagggcccacgatcaactgcagtccagccggagtgttttanacaactccaagataagagttctttagcttggtaccagcagaaccacgacagcctcctaagctgctcgttactggcctctaccccgggatccgggtcccngacgntcagtcggcggtcggtcngggacagtntttcactcncaccntcagccagccctgccgggctggaagtgttgtcggtcggttttactacttggtcagtcagttatttatagttacctccgtactactagtttcggcctaggggacctaaggcttagggacgtagtccgaccgtaacgaacgttggtagcctaggctaacccg

SEQ ID NO: 220717 - DNA, 795 bp, Homo sapiens
  misc_feature: GYAE6OF02GOM1K.39.85.H08.1.454.CMB.1.raw
  modified_base (138)..(138): a, c, t, g, unknown or other
  misc_feature (138)..(138): n is a, c, g, or t
tcagtcgcactagtcacgaccggtgctcgatttagtatcactcagtcgcgggggagctacaacaggcaggcaggggcagcaagatggtgttgcagacccaggtcttcattttctcttgttgctctgatctctgttacncaggtgccgtacggggacagtcgtgactcgaccctagtctccagaccctccgtggcttgtcgtcgtcgtcgggcgaggacgggccacgactccgaaaccgtgacgtaaccgtccgacggtaccggtagtttacgtttaactaaccgtaaccgtaccgaaaggtaaacttaacgttacgttttaccgttttacgtaccgttacggtaaccaacgtacgaaacggtaaacccaacgaaccgaccgtaccccgtaccgtaaaggtcctacggttccttttaccggttacgttcccggggtacccttccgggtaaccccgggggttacctcccggggtacccttacggaacgttccgtttacggacggttcggggcccggtcggtttacgacgggtaactaaggttaccctttccgaccttacgtacccgactactacgacgacgtaaccggtccggtcgggcgtacgtaggtacgaggttcggttacggttcgtttagtaccgtcgtactcggtaccttaaggttactttagttaccgtttacctccttaacgttaccggtttacggttacggaccgtacgggtaacccaggttcggtacgtaacggtccgtaagaacccgaaccgttaggtccggtacgtacggtaccgacgttacccg

SEQ ID NO: 220718 - DNA, 1082 bp, Homo sapiens
  misc_feature: GYAE6OF02FYKM0.39.85.H08.1.454.CMB.1.raw
tcagtcgcactagtcacgaccggtgctcgatttagtatcactcagtcgcgggggagctacaacaggcaggcaggggcagcaagatggtgttgcagacccaggtcttcatttctctgttgctctggtactctcgtgtttaacctaccgtagggttcgtcccctaacggggggtaccaagttccgggttaggaacttcgggaacccccctaacggttcccttaccccgtaaacggtacccctttacccccgttggggtcccttggttccggttcctttcccgggagggggtacccgggaaagggtaccggggtacccccgaaacccggtacttacccgtaaaacccggtttcggaaccccgaaaaccggtttcccccgaaacggggtaccccggggtttaacgttttaacggttttttaaaccctaaaaccccgttaaaaccctaaccccggtaaaaacggtaaaccgtttaaaaacggttacgtttttacccgtttttaaacggtacccgttttaccggggtaaccccgtaaccgacccgtaaaccgttaaaaccccgaaaccggtaacctaccggtaaccccgtttacccgtaaaacggtccttaccggtttacccgttttaacccggttttaaccgtacgggggttacccccgttaacccgggttaaacccccgggggttaaaccggttccccgggggtttaccccctaacgggtaaacccgttacgtttacccgtaaacgggggcccggggttacccgggtaaccgggggtttccgtaaccgggggtaacgtaacccgggttaaccttttacccggtaacctttacccttaacccggaacccttaccgtacccgtaacggaccctaacggtcccgttaccgggcggttaccggtaccgtaacgtcgtttacggtcggtttacgttagttaactcggtacctacgacttagttacgttacgttacgttaccgttacctacgtaacgttcggtttaccgaccggtacggaccgtacggtacggtaccggacgtacgtaccgtaccgaacggtacttaccggcgttaccaccgtaccgtaccg

SEQ ID NO: 220719 - DNA, 538 bp, Homo sapiens
  misc_feature: GYAE6OF01CIQ3L.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagtggttattatacctttgacttcttggggccagggaccctggtcaccgtctcctcacgcctccaccagggcccatccggtcttcccctggccaccctcctccaagcgccacctcgtgggggccacgacggccggccctggggcctcggcccttggtccaaggacctacttccgctacggtacg

SEQ ID NO: 220720 - DNA, 531 bp, Homo sapiens
  misc_feature: GYAE6OF01EY9JG.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgactcttgggccagggaaccctggtcaccgtctcctcagcctccaccaagggcccatccggtcttccccctggccacccctcctccaagacgccacctctgggggccacgacgccggccctgggcctgccctggtcaaggacctacttccgctacgtacg

SEQ ID NO: 220721 - DNA, 795 bp, Homo sapiens
  misc_feature: GYAE6OF01D25WC.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggtattcgttctttagcagcttatcgccatgagcgtgggctcgccaggcctcgaggggaggggctgggaggtgggtctcgtgtcttattccgtggctaggttggtagaattagtacggtaaattaccgtaccggcaacggtaccgttccggtagggaaccggggtcccggtttacacgtttcgttaccaagaacgtaactaacttaccaaagaacactactagtactctgacaaggtactacgaccacgtccgtaggacggacggaccggaaggaaccgaccgggtcttaaattacgttacgtggtacgaaccgaaacgtaccgttaaaggtttcgttttagggagtttagtttaactttacgtttaccgtttgaccgtttcgggtacgggaccgtaaccgggttaccgttcggtacccgttaccgtccttacccgtaccgacccgtacccgtaccccgtaaaccggacccggtcccttacggttcccggtttcccccttccccggcggtaccccctaccccgttacccgtaaccgaacgtcgacccgtaccgttccgggaccggggtaccaccggtacccgggtcccgggtccccggtgggtccccttcgggaccccttaggggaacccgtacggttaaccccttcccgttaccggtaccttaacgggtaaccgg

SEQ ID NO: 220722 - DNA, 570 bp, Homo sapiens
  misc_feature: GYAE6OF01EXG7V.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccaggggaaggggctggagtgggtctctgctattcctggcaggtggtgatatcgaatactacgcagacctccggtgaacgggtccggttcacttgtttccagagacaattccaagaacacactgtatctgcagatgaccagcctgagagccgaggacgacggacctatattacgtgtgacgaacgctaagtattttggagtgttattattactttgacttcgtgggcacggtacctcggtacaccgtctcctcacgccctaccaccgacgccctagtccgtccttccccgcgacctaccctcctaccgaacgacgaccacgtcgtcggggccaccgacgcccggccgtgggccgtcggccgttacggacgtaacggtaccttaccgttccgtccgtacggtaacgg

SEQ ID NO: 220723 - DNA, 574 bp, Homo sapiens
  misc_feature: GYAE6OF01CWOEC.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaaggggctggagtgggtctctgctattcctggcagtggtgatatcgaatactacgcagactccgtgaagggccgttcactgttccagagacaatccaagaacacactgtatctgcagatgaccagcctgagagccgagacacggcgtatattactgtagcgaaacgccaagtattttggatggttattatactttgactcgtgggcagggacctggtcaccgtctcctcacgcctccaccgaacgggtccccagtcggtccctttacccccgtcggacccaccccgttccctacccgaacgacgaccacccgtccgtcgggggaccaccgacggtcccggcccgtggggccctggcccgtgggtaccgaacggtacccttactcccggtcgtaccggtaacgg

SEQ ID NO: 220724 - DNA, 736 bp, Homo sapiens
  misc_feature: GYAE6OF01AT650.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaagggctggagtgggtctctgctattcctggcagtggtgatatcgaatacacgcagactccgtagaagggtccgttcactgtttccagagactaattccaaagaacacactgtatcgtgacagatacgaccagccgtagacgacggaccggaaggaccgaccggtaccgttaataacgtttaacgtggtacggacgaaaaccgaccgtaaggttagtttttagggagttaggttttaacttacgttaccgttttagtaaccgtttcggttacggggtacccgtaccggggtaaccccgttagggtacccgtacccggttccttaccgtccgaccgtcccctaccgaacccgaaaccggtacccctacgttcccggtaccccttcccccggtcgaccccctacccctacccgttacccgaacgtaccgaccgtacccgtccgggtccggggacctaaccggacgggtccccggtaccccgggttgggacccgttccggtcccgtacgggttaaccggtaaccggtacccgtttacccggttcccgtaccgttaaccggtaaccggg

SEQ ID NO: 220725 - DNA, 607 bp, Homo sapiens
  misc_feature: GYAE6OF01A0U4G.15.73.G07.1.454.CMB.1.raw
  modified_base (336)..(336): a, c, t, g, unknown or other
  misc_feature (336)..(336): n is a, c, g, or t
  modified_base (436)..(436): a, c, t, g, unknown or other
  misc_feature (436)..(436): n is a, c, g, or t
  modified_base (457)..(457): a, c, t, g, unknown or other
  misc_feature (457)..(457): n is a, c, g, or t
  modified_base (548)..(548): a, c, t, g, unknown or other
  misc_feature (548)..(548): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaaggggctggagtgggtctctgctattcctggcagtggtgatatcgaatactacgcagctccggtgaacgggccgttcactgtttccagagacaattccaagaacacactagtactctgacagatcgaccagcctgagagccgaggactacggcctatacttacngtcgacgaaacgcctaaagttagttttggaagttggtttattattacctttagacgttcgtagggccgtaagggacccgtggtctaccgtctccgtcacnccctccgaccgtacggacccngttccggtcccttccccgtcggacccacccctccgtacccgaagaccgaccgaccgtcggtacggggacctaccggacggcccggtcccgngggtaccgtcggaccgtcggtaccgaacggtaccgttacctcccgtactcggttaacgg

SEQ ID NO: 220726 - DNA, 687 bp, Homo sapiens
  misc_feature: GYAE6OF01EF1KF.15.73.G07.1.454.CMB.1.raw
  modified_base (313)..(313): a, c, t, g, unknown or other
  misc_feature (313)..(313): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaggggctggagtgggtctctgctattcctggcagtggtgatatcgaatactacgcagactcggtaggacgggtccggttcacttcgtttccgagagacctaattaccaaagaaccactacgtgttatctgacgagatgaccncgacgtgagacgacgaggacgaccggtcgtatacttacgtggacgacgaaacgaccgtaaaggttagttttagggaagtttaggtttaacttaacttacgtttacgtacgttcggttacgggcccggtaacgggtacccgttacggtacctacccgtacgttccctaccgacgtacccgtacccgaacccggaccggtccctaacgttccccggttaccctttcccccgtaccgggtacccctacccccgttacccgtaccgaaaccgtaccgaccctacccgggtcgggtaccggggccacggaccgggcccggtccggtgggctccggccgttggtaacgtacgttaccttacgtcccgtacgtggtaccgg

SEQ ID NO: 220727 - DNA, 1025 bp, Homo sapiens
  misc_feature: GYAE6OF01BJZ03.15.73.G07.1.454.CMB.1.raw
  modified_base (214)..(214): a, c, t, g, unknown or other
  misc_feature (214)..(214): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgcaggctcgagggagggctgggagtggtctcgtgcttacttccgtggctaggtcggtnattagtacgtaataccgtacgcacgtaccgtccggtaggaaccgggtccggttacacgttcgtttccgaagacgaacgtaacttaccgaaacgaaccgaacctacgttgttaactccgttacgaccgtagagttacggaacccgtacgggtaccctaggaacggacggacccgggaacggaaccgaccgggtacccgttaattaacgtttaccgtaggtacggtaaccggaaaccgtaccggtaaaggtttacggtttttaggggtaacgggttttacgggtttttaaatttaaccgtttaacccgtttttacggtaaccggttttccgggttaccggggggtacccggtaaccgggggtaacccccgtttcggggttaaccccgtaccccggtttacccttaccccgtaccgtaacccggtaccccgttacccccggtaaaccggtaaccccggggtcccccggttaaccggttttcccccggggtttacccccgtttaccccccccgggtttaccgggtaacccccccgttaccccccgttacccccgttaacccccggtaaacggtaccccggttaacccccggtacccccggttacccggggttacccgggggggtaacccctaccccggggttaacccggggtcccccccggggggttaacccgtttcccggggggacccgttaccccgggttcccccggggttaaccggggttaacccgggttaaaccccgggtttaccccggtttaacccccggttttaccccccggggtaacccggtttaaacccggggttaaaccccggggg

SEQ ID NO: 220728 - DNA, 719 bp, Homo sapiens
  misc_feature: GYAE6OF01DDV5W.15.73.G07.1.454.CMB.1.raw
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcactttcagtaatggctggatgagttgggtccgccaggctccgaggggagggctggagtgggttggacgtttacaaaagtaaaatgagtggtagaagaaaatagactacggtgaccaaccgtagaaaggagacttaccacatcacaagatataattacgaaaaacgtcggttattacttagacaaagtcgaacagacctaaggaaaaccgngaaccacagtccgtactattaccgtntaaccagtagtacgttcggaagttgacctaagtaccggaaagtaaagggcgtactagtcgttactttagactacgtccgggacgggtacccgaagggtactaaggtcggtacgttcgtccttcgtaccgacgtccctaccgaaccgacggtccctacgttcccgttccctaccccgtgacccctacccgtacctaaccgacgtaccgccgttaccgtcggtacgggaccctacggacccgggtcccgggtacccggtacgggtcgtccgggtacccgttacgggtaccgtaaaccgggttccctttaccccggtccggttaacccgtaccggttacggacgggttcgggacccggggg

SEQ ID NO: 220729 - DNA, 758 bp, Homo sapiens
  misc_feature: GYAE6OF01CPB9J.15.73.G07.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagcgtgggctaccgccaggctccgaggggagggctggagtgggtctcgtgcttattccgnggctagtggtanatactacgtaatacctacgcagtaccgtccggtaggtaacgggccgttctacgttcgtttacgagtaacgtactaattaccaagaaccactactntactctacgtanagactcgaccacggcctaggacgacggaccggacggaccgtacgggtaccttaacttacgtttacgtacggtacgaaccgtaaaccgtaccgttaaggttacgtttttagggaacgtttagtttaacgtttacgtttaccgtttacgtacggtttccggttacggggtccgtaaccggggtacccgttacggggttccctacccgttccgttccgtaccgaccgtcccgtaaccgtacccgggtaaccggtcccgtaccggtttcccgtacccttccccggtaccgacccctaccccgtccgtaccgtaacggtccctaaccgtaccgtcgggaccggtcctaacccggaccgggtcccggcccggttgggtacccgtcggtccgtacgtacccgtaaccggttacttacccgttacggccgttacgtaacgg

SEQ ID NO: 220730 - DNA, 734 bp, Homo sapiens
  misc_feature: GYAE6OF01A1OVD.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaaggggctggagtggtctctgctattcctggcagtggtgatagttcgaattacacgcagtctaccggtgaaggggtccgttcacgttgtttaccagagacaacttccgaaataacgactacgtgtactctagacagtaatcgaccagaccgtgaggacgccggaaggacctaacggcccgttaagtacttacgtggacgacgaaaccgtacgtaaagttaagtttttggaagtttaggtttacttaacgtttccgtttaacgtccgttacgggttacgggtacccggtaacggggtaaccccgttcggtacccgttaaccgttccgtacccgtaaccgtaccgttccctaaccccgaaccgaaccgggtcccctaacgttcccggttccctttcccccgacggtacccttaccccctcccgtaaccaaaccgggtactaccccgaccgtttaccgggaccggggaccttaaacccggcccggtccgggtccccggtaggtcccggtaccggtccggtaggtaacccgtacggtacctttacccggccgtaacgtcggtaaccg

SEQ ID NO: 220731 - DNA, 514 bp, Homo sapiens
  misc_feature: GYAE6OF02F3T8R.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaaagattttggagtggttattatacctttgactcttgggccagggaaccctggtcaccgtctcctcagcctcaccaaggcccatcggtctcccctgcaccctcctccaagacgcacctctcggggcacgagcggccctgggctgcctggtcaggactacttccgctacgtacg

SEQ ID NO: 220732 - DNA, 628 bp, Homo sapiens
  misc_feature: GYAE6OF02G3LZQ.15.73.G07.1.454.CMB.1.raw
  modified_base (261)..(261): a, c, t, g, unknown or other
  misc_feature (261)..(261): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaagggctggagtgggtctctgctattcctggcagtggtgatatcgaatactacgcagactccgtgaagggccggttcactgtttccaganacaattccaagaacacactgtatctgcagatgaccagcctgagacgccgaggacgacggccgtatacttactgtgacgaaacgcaagtattttggagttggttattattacctttgtacttcgttggggaccgtacgggaacccttgggtacctaccgtctcccgtcacgtcctacccaccgaacggccctagttccggttccccttccccgtcggccctaccccctacccttacccgaaacggacccgtccgtaccccgttccgggtacgggggaccaccgacgggcccggtaccccgttggggcctcggtacccgttggtacccgtaacgggtaccttacccgttcccgaccgttacgtaaccgg

SEQ ID NO: 220733 - DNA, 565 bp, Homo sapiens
  misc_feature: GYAE6OF02GJ55T.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgacgaaacgcaagtattttggagttggttattatacctttgactcgttgggccagggaaccctggtcaccgtctcctcacgcctccaccacgggcccagtccggtccttcccccgtggccacccctcctaccaacgacgccaccgtccgtcgggggcacgacggccggtcccgtgggcctcggcccttgggtccgaacgggtacccttaccgttcccggtacgtacgtaacgg

SEQ ID NO: 220734 - DNA, 578 bp, Homo sapiens
  misc_feature: GYAE6OF02HHUP8.15.73.G07.1.454.CMB.1.raw
  modified_base (210)..(210): a, c, t, g, unknown or other
  misc_feature (210)..(210): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtnatatcgaatactacgcagactcgtgagggccgttcactgttccagagacaattccaagaacacactgtatctgcagatgaccagcctgagagccgaggacacggccgtatattactgtgacgaaacgccaagtattttaggagttggttattatacttttgacttcgttgggccacgggtaaccctggtccgtaccgtcctcctcacgccctaccaaccgaacggcccagtccggtccttccccgtggccacccctcctacccgaacgacgccacccgtcgtcggggcctacgacggtccgggcccgtggggcctcggacccgttgggtaccgaacggtacccttaccgttaccgtcgtacggtaacg

SEQ ID NO: 220735 - DNA, 592 bp, Homo sapiens
  misc_feature: GYAE6OF02HM9UN.15.73.G07.1.454.CMB.1.raw
  modified_base (493)..(493): a, c, t, g, unknown or other
  misc_feature (493)..(493): n is a, c, g, or t
  modified_base (516)..(516): a, c, t, g, unknown or other
  misc_feature (516)..(516): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgttctttagcagctatgccatgagctgggctcgccaggctccgagggagggctggagtgggtctctgctattcctggcagtggtgatatcgaatactacgcagactccgtggaacgggccgttcacgttgtttacccagtaacgaactaacttaccaaagtaaccacactgtatctagcagatcgaccagcctagacgacgccgaggacgacgggtacctatacttacgtgtagaccgaaacgaccaagttagttttggagttaggtttaattattaccgtttgacttcgttcggggctaacgggtaccctggtaccaccgttcctcctcacgccctaccaccgaacgacccagtccgtcccttcccngacccaccctcctaccacgtacnccgtacctcggcgggccacgacgccggccgtggcctcggcctggaccgacggtccttaccgtccgactacgtacgg

SEQ ID NO: 220736 - DNA, 619 bp, Homo sapiens
  misc_feature: GYAE6OF02G371C.15.73.G07.1.454.CMB.1.raw
  modified_base (237)..(237): a, c, t, g, unknown or other
  misc_feature (237)..(237): n is a, c, g, or t
  modified_base (453)..(453): a, c, t, g, unknown or other
  misc_feature (453)..(453): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccaggggaagggctggagtgggtctctgctattcctggcagtggtgatatacgaatactacgcagacctccgnggaacgggtccgttcactgtttccagagacaattccaagaacacactgtatctgcagactgaccagcctggagacgccgaggaccgacggtcgtattattactggtgaccgaaacgaccaagttagtttttagggagtttaggtttaatttacttaccttttgacttcggttcggggacctaagggtaaccccttgggtcccaccgttcctcctcncgtcccttccaaccgaacgacccacgtccgttcccttccccgtggacccaccctccctaccgaacgtaccgcctcccgtcggtcggggccacgacggcccggtcccggtagggccttcgccggttcggtaccgaaggtacccttaccgtccgtaccgtacggtacg

SEQ ID NO: 220737 - DNA, 616 bp, Homo sapiens
  misc_feature: GYAE6OF02HJNQC.15.73.G07.1.454.CMB.1.raw
  modified_base (344)..(344): a, c, t, g, unknown or other
  misc_feature (344)..(344): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaagggctggagtgggtctctgctattcctggcagtggtgatatcgaatactacgcagactcgtgaaggccgttcactgttccagagacaattccaaagaacacactgtatctgcagatgaccagcctgagagccgaggacacggccgtatattactgtgacgaaacgcaagtnttttggagttggttattatactttgacttcgttgggaccagggtaccctggtcctaccgtctcctcacgcccttaccgaccaacgggcccagttccggtcccttcccccgtggccctaccccgttccctacccgaacgccgccctacccgttccgggtccgggggaccaaccgacgggccccggtacccgtcggggtccctcgggtcccgttacgggtacccgtaaacgggtaccctttacccggttacccggtaccttaaccggtaaccgg

SEQ ID NO: 220738 - DNA, 558 bp, Homo sapiens
  misc_feature: GYAE6OF02G2OC0.15.73.G07.1.454.CMB.1.raw
tcagtctacgtagccacgaccggtgctcgatttagctctacgctcagggtcttcttggctcacgtccaccaccacgcatgtgacctcaggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaacgggccggttcactgtttccagagacaattccaagaacacactgtatctgcagatgaccagcctgagagccgaggacacggccgtatattactgtgacgaaacgccaaagtatttttaggagttaggttattattacctttgtacttcgttcggggccaacgggaaccctggtccacgtctcctcacgtcctccaccgacggcccatccggtccttccccgtggccctaccctcccaccaagacgtccacccgtcgcggggccacgacgccggcccgtggcctcggccgtggtcgaggccttaccgtccgactacggtacg

SEQ ID NO: 220739 - DNA, 571 bp, Homo sapiens
  misc_feature: GYAE6OF02FVAH7.15.73.G07.1.454.CMB.1.raw
  modified_base (211)..(211): a, c, t, g, unknown or other
  misc_feature (211)..(211): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccaggggaaggggctggagtgggtctctgctattcctggcagtggtnatatcgaatactacgcagactccgtgaagggccggttcactgtttccagagacaattccaagaacacactgtatctgcagatgaccagcctgagacgccgaggacacggccgtatacttactgtgcgaacgcaagtattttggagttgttattatactttgtactcgttgggccagggacccgtggtcaccgtctcctcncncctaccaccacgggcccactccggtcccttccccgtcggccaccccgtcctacccgaacgacgcctaccgtccgtcgggggccacgacggccggtccccgtgggccctcggtcctgggtaccgaacgggtaccttaccgttcccgtcctagtaaccgg

SEQ ID NO: 220740 - DNA, 609 bp, Homo sapiens
  misc_feature: GYAE6OF02F8DYS.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcaggctccggtgaagggccgcttcaccatctccagagacaattccaaacaacactaacttttatccttacaaaatgaaactagcctgcgagccgaggacacggctatactacgtgtcgcgagagactacgaacacgggcccggtaggggacgtcccgttggaccgtacggtcggggacccgaacggggaacccgttgggtccctacccgtccgtccctaccgtaacccctccaacccgaacgggccccaacgttcccggttcccttcccccgtggccctacccctcccgtaccaacgacgcctaccgtcgcgggacacgcgccgcccgtggcgtcgccgtggaccgaagtcctaccgttcccgtacgtacggtacgacgtcggg

SEQ ID NO: 220741 - DNA, 723 bp, Homo sapiens
  misc_feature: GYAE6OF02I480C.15.73.G07.1.454.CMB.1.raw
  modified_base (332)..(332): a, c, t, g, unknown or other
  misc_feature (332)..(332): n is a, c, g, or t
tcagtctacgtagccacgaccggtgctcgatttagctctacgctcagggtcttcttggctcacgtccaccaccacgcatgtgacctcaggggtccctgagactctcctgtgcagcctctggattcgtctttagcagctatgccatgagctgggctcgccaggctccgagggaaggggctggagtgggtctctgctattcctggcagtggtgatatacgaatactacgcagactccggtagaacgggtccggttcacttcgttccagtagactaagttaccaagtaaccactacgtgtactctgccagatgaccagccgtgagcgcgagaccncggactatatactggcgacgaacgccaagttagtttaggtacgttggttaatttacttaccgtttcgtacgttcggttacggggtaccgtaaccgggtaacccttcgggtcccaaaccggttcccttcccgttaaccgtaccgtacccgttcccgaaccggacgggtacccctacgttccccggttacccgtttcccccgtacgggtcccttaccccgttaccctaccgaacggtaccgtaccctacccgttcgggtaccggggaccaccgggttacgggaccccgggtcccggttccggggcccttacccgggtaccgttcccgggttaacggaacccggttacccgttaacccggtttccccggttaacccgtaccgggttaaacccgg

SEQ ID NO: 220742 - DNA, 793 bp, Homo sapiens
  misc_feature: GYAE6OF02JVGXQ.15.73.G07.1.454.CMB.1.raw
  modified_base (128)..(128): a, c, t, g, unknown or other
  misc_feature (128)..(128): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtntttagcagctatgccatgagctgggctcgccaggctccgagggacgggctggagtgggtctctgcttattcctgggcaggtggtgatatcgaatactcgctagactccggtgaacggggtccgttcacttcgtttccagagactaattaccaaagtaacacactgtactcgtcgctagatcgaccacgacctaggacgacggtacccggacgggaacgacccgggtaccggttaaattacgtttacgtcggttacgacggaaaaccggtccctaaaagggtttcgtttttagggaagtttcgggttttaaacttttaacggttaaccgtttttcgaaccgtttacggtttaccggggggacccgttaacgggggtaaacccccgttacgggttaccccgtaccgggtttaccctacccggttaccgaccggttacccgtaaccccgttacccggaaaccggggtaccccgtaaccgttcccgggttcccctttacccccggtacggtcccctacccccgttcccgttaacccgaacgtaccgaccctacccgttccggtacgggggtaccaccggaccggtcccgggtccgggtacgggtccgtaccgtcccggttaccggtacgtaaccggtaccgttaccgacccgtttccgtaccgtaacgg

SEQ ID NO: 220743 - DNA, 758 bp, Homo sapiens
  misc_feature: GYAE6OF02JJ327.15.73.G07.1.454.CMB.1.raw
  modified_base (307)..(307): a, c, t, g, unknown or other
  misc_feature (307)..(307): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggcctcgccaggctccgagggaaggggctggagtgggtctctgctattccgtggcaggtggtgatatacgaatactacgcaggtacctccggtaggaacgggtccggttctactgtttccagagacaacttccaagaacacactgtatctgcagancgaccagccgtgagcgaccgaggtaccgacggtacgtacttaattcgtagtacgacgaaaaccggccctaaaggttacgtttttagggaacggtttggtttaaactttacgtttaaccgttttgtaccgttcggttacgggggacccgtaacgggtaaccccgttggtacccgtaccgtcccttcccgttaccgacgtacccgttacccgaacccggtaaccggggaccctacgttcccgggttacccctttcccccgtaccgggtacccctaccccgttaccctacccggtaaccgtaccggtacccgtaccctccggggtaccggggaccctaccggaccggtcccggggcccgttaccggggtcgttacccggtacccggtttacgggtaacccggtaacggtaccccgtttaccggtaccccggtaccgtttaaccggttaaccggg

SEQ ID NO: 220744 - DNA, 585 bp, Homo sapiens
  misc_feature: GYAE6OF02FH9YI.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatacttactgtgacgaacgccaagtattttggagttgttattattacctttgacttcttgggccagggaccctggtccaccgtctcctcacgcctaccaccgacggcccagtccggtcccttccccgtcggacctaccccgtccctcctaacgacgcctacctcgtacggggccacgcggcccggtacccgtcgggtacctcggtcccgttgggtaccgaacgggtaccttacccgtttcccggaccgttaccggttaaccgg

SEQ ID NO: 220745 - DNA, 704 bp, Homo sapiens
  misc_feature: GYAE6OF02IY1Y6.15.73.G07.1.454.CMB.1.raw
  modified_base (494)..(494): a, c, t, g, unknown or other
  misc_feature (494)..(494): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaaggggctgggaggtgggtctgtgcttattcctggcaggttggtgatatacgaatactacgcagactccgtaggaacggccggttcacttgtttaccgagacgaacgaattaccaagaacgacactagttatcgtcgacagtagtacggaccacgccgtaggaggaccggaccggacggaccgacggtacgtacttacttacgtagtacgaacgaacgtaccgtaaggttattttagggtagttaggtttattaactttaccgtttacgtacttcggttacggtaccgacgggtaacccgtcggtccgaccgtctcccgtacnccgtacctacccgaccgaacggccctacgttacccggttcctcccccgtcgggtcccttaccccgtcccgttaccgaacgtacccgtccgacccggttcggtaccggggaccacggaccggtcccggtcccggttcggtaccggtcggttacccgtacgggttaccgacgggttacccttacccggtttcccgtaccgttacgggtacgg

SEQ ID NO: 220746 - DNA, 716 bp, Homo sapiens
  misc_feature: GYAE6OF02JWPT3.15.73.G07.1.454.CMB.1.raw
  modified_base (182)..(182): a, c, t, g, unknown or other
  misc_feature (182)..(182): n is a, c, g, or t
  modified_base (262)..(262): a, c, t, g, unknown or other
  misc_feature (262)..(262): n is a, c, g, or t
tcagtctacgtagccacgaccggtgctcgatttagctctacgctcagggtcgttcgtggctcacgtccaccaccacgcatgtgacctcaggggtccctgagactctcctgtgcagcctctggattcgtctttagcagctatgccatgagctgggctcgccaggctccgaggggagggctggngtggtctctgctatcgtggcagtgtgatgtacaatacacgcagactccggtgacgggtccgtacacttcgttccaggtanaactattccaaaggacacactgtatcgtcgactagagtcgaaccaggtcctaggacggtacggacggaacggaccgtaacgggtccggttaataccgttacgtacggtacggaaccgtaaaccggacgtaaacggtttggttttaggggacgtttaggtttaacttaacgttacgttttgaaccgttcgggttacgggacccgtaacgggtacccgtgggtaccctaccgttcgtaccctacgtccggacccgttaccaaccggaccggtccctacgttacccgttcccgtccccgtagaccccgtacccgtcccgaaccgtacgtaccgtctacccggtgggtacccggggacaccggtcgtccccgggtccgggtaggtccgtacccggaccgttaccggtaccggtaaccgggtaacctttacccggtccggtacggttacccgtaacggg

SEQ ID NO: 220747 - DNA, 747 bp, Homo sapiens
  misc_feature: GYAE6OF02IMKW5.15.73.G07.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccgagggaagggctggagtgggtctntgctattccnggcagtggtgatatcgaatactacgcagctccgtggaacgggtccgttcactgttccgagagaacaattaccaagaacactactgtatcgtgacgagtatacgaccacgccgtagagacgccggaacggaccgacggtaccgtaattactttacgtcggtacgaaccgtaaacgtacctaaggtttagtttttagggaagtttaggtttaactttacgttaccgttttggtacgtttcggttacggggtacccgtaacggggttacccgtcggttacccgtacccgttaccttcccgtccgaccgtcccgtacccgacccgaacccgggtaccctacggttccccggtcccgtttcccccggtccggtaccccttaacccctcccgtaacccgtaacggtaccgtacccgtacccgttccgggtccggggtaccacccggtaccgggtcccgggtcccgttccggggtaccgttccggtcccggttacgggtacccgtaacgggttacccgtaacccggtttcccggtaccggttacggtaacccgg

SEQ ID NO: 220748 - DNA, 505 bp, Homo sapiens
  misc_feature: GYAE6OF02JB5CT.15.73.G07.1.454.CMB.1.raw
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgccaggctccagggaagggctggagtgggtctctgcttattcctggcagtggtnatatccgaatactacgcagtacctccgtgaagggccgttnactgtttccagagacaattccaagaacacactgtatctgcagatcgaccagcctgacgagccgaggacaccggctatatactgtacgacgaaacgcaagtatttgagtgttatatcttgctgtggacaggacctgcncgtcncncncncctcacagccnctcgtctacccngccnccctctccagcnccaccngtcgggcacgcggccgccgtcggctcgcctaggtacaacggtctacgtcctacgtacgtacg

SEQ ID NO: 220749 - DNA, 837 bp, Homo sapiens
  misc_feature: GYAE6OF02HHECX.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctgggctcgcaggctccgagggaaggggctggagtgggtctctgtctattcctggactggtggtgatatacgtaatcgtacgcagacgttcccggaggaacggggtccggttactacgttgtttcccgagtaacgtaactaacttaccgaaacgtaacctaacaccgttgttaatacgtcggactagtacgtaccggacgtaccggtacccgtaggaacggacggtaacccggaccgggtaaccggtacccgggtaccgttaagttaacgtttacgttcggggttaaaccgaccggaaaaccggtacccgttaaaaggttttacggtttttaacggggaagggttttaacggtttttaacttttaaccgttttacccggttttacgttaccgttttccggtttaccgggggacccgtaaccggggtaaccccgttcggggtacctacccgttacctcccgttacgacccgtacccgttacccgaaccggtacccggaccccgtcggttacccgttccccttaacccggtccggtaacccctcccgtacccttacccgaacgacctcccgtacccgtcgggtaccggggccctaccggaccggtcccgggtccgtcggggtacccttccgggccttacgggtaccgaaccggtaccgtttaccccggtaccgtaccgtaacccggtacgg

SEQ ID NO: 220750 - DNA, 734 bp, Homo sapiens
  misc_feature: GYAE6OF02F6IH7.15.73.G07.1.454.CMB.1.raw
tcagtctacgtagccacgaccggtgctcgatttagctctacgctcagggtcttcgtggctcacgtccaccaccacgcatgtgacctcaggggtccctgagactctcctgtgcagcctctggattcgtctttagcagctatgccatgagctggctcgccaggctcgagggagggctggagtggtctctgcttatcctggcaggtggtagatacgtacgaatacgtacgcacggtacctccggtaggaacgggtccggttacacgttcgttccaagaacggtaacaacttaccgaaagtaaccactacgtagtactcgtagacagactagaccacgtcgtagagacgacggaacgacgacggtacgtatacttacgtagtacgacgaaaccgtacgtaagttagttttacggaagtttagttactttacgttaccgtttcgtaacgttcgttacgggaccgtaacgggtaccgttcggtacctaccgttccgttacctaccgtacgtaccccgttaccgaacccgtaaccgggtcccttacgttcccggttaccccgttccccgtacggtacccctaccccgttacccgtaaccgtaaccgaccgtacccctaccgggttcgggtaccgggacctaaccggcggtacccgggttcccgcggttacccgtccggttacccggtacgttaacggaccgtaccgtttacccgtttaccggtaccgttaccgggtaaccg

SEQ ID NO: 220751 - DNA, 876 bp, Homo sapiens
  misc_feature: GYAE6OF01BYQ32.18.87.H10.1.454.CMB.1.raw
  modified_base (163)..(163): a, c, t, g, unknown or other
  misc_feature (163)..(163): n is a, c, g, or t
  modified_base (346)..(346): a, c, t, g, unknown or other
  misc_feature (346)..(346): n is a, c, g, or t
tcagtacgagtatgcacgaccggtgctcgatttagcagtactgcgtttggggttttggggactcgcttggtccgaggcctgggggtccctcgagactcgtcctgtcgcgaggccctagcattcgattcgtttaactagttattggatggcctacgtggtcccncgacgctaccggggagggccgagtgggtcgccaagataactgacaagagtggaacttgagaaggactaggtcgtgactctacgaggaacggggcctagttacaccattcgacagacacaacactaaagtaacttacgtctatcagacctaaatgaacaagtcctacgagacaccgtaaggacncggtcttggtacgttaactttaccgaggtacgaacgtaaacgtacggtttccaagggttaggacgtttaggggaacctagttggggtaacccgtcccggtacgggggaccctaaaaggggacccctaacggggtttaccttaacccggttaccttcccggtacgaaccggtacccgttaacccgaaacccggtaaaccgggtacccttaaacgtttccccgggttttaccctttttacccccgggagggttcccggtttaccccgtttacggtaaccccgtaaccccgtaagggacccgtaccggtaaccccgggttcccgaacggaaccccggacggaacccggaacgggtacccgggtaccccgttcgggggtaccctaccggttacccgttacgggttaaccaaaacccgggttaacccctttaacccgttaaccccgggtaaccttaacccggttcccggtttacccgtacccggaaccgggtcccgggtacccgttaccgggacccgtaaacggggcgtaacccg

SEQ ID NO: 220752 - DNA, 538 bp, Homo sapiens
  misc_feature: GYAE6OF01BPMMM.18.87.H10.1.454.CMB.1.raw
  modified_base (515)..(515): a, c, t, g, unknown or other
  misc_feature (515)..(515): n is a, c, g, or t
tcagtacgagtatgcacgaccggtgctcgatttagcagtactgcgttgggtttgggggaggattggtccagcctggggggtccctgagactctcctgtgcaggccctgcattcatcttttaatagttattggatgcactgggtccgccaggctccggggaagggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctggggacatggacgtcgtggggccaaagggaccacgggtcaccgtctcctcagcctccaccaacgggcccactcggtccttccccgtcggccgccctcgcctccgacggacgccacctccgacgacgcacagccggccctgggctgcctggtcaacggactacctcccgactactcgtcngacgcgggctggacaggcgcgag

SEQ ID NO: 220753 - DNA, 578 bp, Homo sapiens
  misc_feature: GYAE6OF01CVCYA.18.87.H10.1.454.CMB.1.raw
  modified_base (549)..(549): a, c, t, g, unknown or other
  misc_feature (549)..(549): n is a, c, g, or t
tcagtacgagtatgcacgaccggtgctcgatttagcagtactgcgtgggtttggggaggcttggtccagcctggggggtccctgagactctcctgtgcaggccctgcattcatctttaatagttattggatgcactgggtccgccaggctccggggaagggccggagtgggtggccaacataaatgcaagatggaaactgaagaagaactatgtggactctgtgaagggccattcaccatctcagagacaacactaaagaacttactgtaatctgacaaaatgaacagcctcagagccgaggacacggctgtgtattactgtgacgaagagcagtggctggggacagtggacgtctggggacccaaagggccaacggtcaaccggtctccctcacgccctccaaccgaaacgggcccaacgtccggtccttcccccgtcggacccgccctcgcctaccgacggacgccaccgtccgagacgccaccacggccggcccgtcgggcctggtcccgtggtccaaaggacctaaccgttcccatactcgtacncggacgcgggctcggcaacggcgcgtaag

SEQ ID NO: 220754 - DNA, 258 bp, Homo sapiens
  misc_feature: GYAE6OF01C2F3I.18.87.H10.1.454.CMB.1.raw
  modified_base (252)..(258): a, c, t, g, unknown or other
  misc_feature (252)..(258): n is a, c, g, or t
tcagtacgagtatgcacgaccggtgctcgatttagcagtactgcgttgggtctgggacagacttcactctcaccatcagcagactggagcccgaagatttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatagnnnnnnn

SEQ ID NO: 220755 - DNA, 253 bp, Homo sapiens
  misc_feature: GYAE6OF01DKYQ2.18.87.H10.1.454.CMB.1.raw
  modified_base (253)..(253): a, c, t, g, unknown or other
  misc_feature (253)..(253): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatagn

SEQ ID NO: 220756 - DNA, 253 bp, Homo sapiens
  misc_feature: GYAE6OF01CNCUX.18.87.H10.1.454.CMB.1.raw
  modified_base (252)..(253): a, c, t, g, unknown or other
  misc_feature (252)..(253): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttcccgcatctgacatactcgtactgagcgggctggcaaggcgcatagnn

SEQ ID NO: 220757 - DNA, 730 bp, Homo sapiens
  misc_feature: GYAE6OF01CUTSD.18.87.H10.1.454.CMB.1.raw
  modified_base (242)..(242): a, c, t, g, unknown or other
  misc_feature (242)..(242): n is a, c, g, or t
  modified_base (343)..(343): a, c, t, g, unknown or other
  misc_feature (343)..(343): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccgggggaagggccggagtgggtggccaacataatgcaagatggaactgagaagaactatgtggactctgtgaagggccattcaccatcncagagacaacactaaagaacttactgtaatctgacaaaatgaaacagcctcgaagacgacccgaaggaccacgggctgtagtaattactgtagacgaaagngcaggtggcgtggggaacagtgggacgtcgtagggggacccaaaggggacccaacgggttccaacccggttctacccgtacgaacgtcccctacccgaaccgaaacgggccccctaacgttcccgggttcccctttccccccgtcgggccccgtccccgtcggcccgttacccgaacgggaccgtacccgaaccccgtcccggaacgacgacccgaaccgaccgggaccccgggtcccccgttaggggcccttcgggacccgttcgggtacccgaaacgggtaccctttaacccgttaccccgaacttaacccgttccggttaaccgtacgggtaaccgggcccggggtaccttacggggaaccgtaaaccggggccgacgtaaagg

SEQ ID NO: 220758 - DNA, 692 bp, Homo sapiens
  misc_feature: GYAE6OF01EDBHT.18.87.H10.1.454.CMB.1.raw
  modified_base (302)..(302): a, c, t, g, unknown or other
  misc_feature (302)..(302): n is a, c, g, or t
tcagtacgagtatgcacgaccggtgctcgatttagcagtactgcggttgggtttgggaggagccttagccctggactccaaggcctttccacttggtgatcagcactgagcactagaggactcaccatggaattggggctgagctgggttttcctcgttgctattttagaaggtgtccagtgtgacgtgcagctggtggagtcgtgggggagcttggtccagccgtgggggtccctgagactctcctgtgcacggccctgcattcattctttaatgttattggatgactacgtcgggtcccnccaggccgtaccgggggaaggggccggtaggtgggtcggcccaaacgtagtaaagtcgacaaggtatggaactgaagaagaactagtgtggtactcgtgtacgaaacgggtcctaattccgaaccgtattcctacccgaaggaacgaacctaaacgtaaacgttaaaagtaaaccttttaacgtagtttaacttcgttaaggtaacctaaaagttcggaaaacctacggtacccttacgaaacggtaacgtaccccgggtaagggtaacccgtaccggggtcttagggttaacgttaacgttaacgtggtacgacgaaaggacgtacgtaggtcggacttggggaacctaggttacgggtaccgttcggtcgggggaccctaaacggggg

SEQ ID NO: 220759 - DNA, 541 bp, Homo sapiens
  misc_feature: GYAE6OF01DCOHB.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccattcaccatctccagagacaacactaagaacttactgtaatctgcaaaatgaacagcctcagagccgaggacacggctgtgtattactgtgcgaagagcagtggctggggacatgggacgtcgtgggggaccaaagggaccacggtcaccgtctcctcagcctccaccaagggcccatccggtcttccccctggccgccctcgctccgaggacgccaccctccgagacgccacgacgccggccctgggcctgcctggtccaaggacctactcccatactcgtactgagccgggctggcaacggcgcgtaag

SEQ ID NO: 220760 - DNA, 667 bp, Homo sapiens
  misc_feature: GYAE6OF01C66AF.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccagccgtgggggtccctgagactctcctgtgcaggccctgcattcatctttaatagttattggatgcacgtgggtccgccgagggccgtccgggggaaggggcccgggaggttggggtcggccaaacagtaaagtgacgaaagagtaggaaactggaagaaagaactagtgtaggacttctaggtagaagggccgtaatttccaacctatcctaccaagaacgaaccaactaactaaagtaacctttaactagttaatctaggaacctaaaagtcgaaacctacggcccttacgacgggaacggaccccggaagggaacccgtaccggggtacttagggttaacggttaatttaacccgtggttacgggaaccggaaaagggtacggaccgtaagggttaggggtacccgttaggggggaaacctagggttacggggg

SEQ ID NO: 220761 - DNA, 573 bp, Homo sapiens
  misc_feature: GYAE6OF01BKRYI.18.87.H10.1.454.CMB.1.raw
  modified_base (268)..(268): a, c, t, g, unknown or other
  misc_feature (268)..(268): n is a, c, g, or t
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
  modified_base (567)..(567): a, c, t, g, unknown or other
  misc_feature (567)..(567): n is a, c, g, or t
tcagtacgagtatgcacgaccggtgctcgatttagcagtactgcggtttggggtttggggaggcttggtccagcctggggggtccctgagactctcctgtgcaggccctgcattcatctttaatagttattggatgcactgggtccgcctaggctccggggaagggccggagtgggtggccaacagtaatgcaagatggaactgaggaagaactatgtgactctgtgaaggccattcacatctccagagacaacactaagaacttacngtatctgacaaatgaacagcctcaagacgccgaggacacggtctgtgtattactgtgcgaagagcagtggctgggacagtggacgtcgnggggaccaaagggtccacgggtccaccgtctcctnacgccctccaccgaacggcccagtccggttcccttccccgtggcccgccctcgcctccgaggacgccaccgtccgacgacgcacacggccggtcccgtgggcctcgccgtaggtacgaacggtaccttaccgttcccattacctcgtacgtgacggcgggctcgggacacggcgngtaacg

SEQ ID NO: 220762 - DNA, 547 bp, Homo sapiens
  misc_feature: GYAE6OF01BJPPB.18.87.H10.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (454)..(454): a, c, t, g, unknown or other
  misc_feature (454)..(454): n is a, c, g, or t
  modified_base (540)..(540): a, c, t, g, unknown or other
  misc_feature (540)..(540): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggtccctgagactctcctgtgcaggccctgcattcatctttaatagttattggatgcacgtgggtccgccaggcgtccgggggaagggccggagtgggtggccaanataangacaagatggaactgaagaagaactatgtggactctgtgaagggccgaattcaaccatctaccaagacgaacaacactaaagtaacttactagtactctaganaaagttgaaacagccctagagacgaccgaggaccacggctgtagttaactacgtggtagcgaaagagacgaggtcggatcgggaanagtcggg

SEQ ID NO: 220763 - DNA, 557 bp, Homo sapiens
  misc_feature: GYAE6OF01B4GGT.18.87.H10.1.454.CMB.1.raw
  modified_base (553)..(553): a, c, t, g, unknown or other
  misc_feature (553)..(553): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaaagaacttactgtatctgcaaatgaacagcctcagagccgaggacacggctgtgtattactgtgcgaagagcagtggctggggacagtggacgtcgtggggccaagggaccacggtcaccgtctcctcacgcctccaccgaacggcccagtcggtccttccccgtggccgccctgcctccgaggacgccacccgtccgagacgccacacggccggcccgtgggcctggcccgtggtcgaacggaccttaccttcccacttacctcgtacgtgacggcgggtctggacaacggcgntacg

SEQ ID NO: 220764 - DNA, 596 bp, Homo sapiens
  misc_feature: GYAE6OF01BOUZZ.18.87.H10.1.454.CMB.1.raw
  modified_base (143)..(143): a, c, t, g, unknown or other
  misc_feature (143)..(143): n is a, c, g, or t
  modified_base (352)..(352): a, c, t, g, unknown or other
  misc_feature (352)..(352): n is a, c, g, or t
  modified_base (596)..(596): a, c, t, g, unknown or other
  misc_feature (596)..(596): n is a, c, g, or t
tcagtacgagtatgcacgaccggtgctcgatttagcagtactgcgtgggtttggggaggcttggtccagcctggggggtccctgagactctcctgtgcaggccctgcattcatctttaatagttattggatgcactgggtccnccaggctccggggaagggccggagtgggtggccaacataatgcaagatggaactgagaaagaactatgtggactctgtgaagggccattcaccatctcaagagacaaacataaagaactttactgtaatctagacaaaatgaaacagcctcaagagccgaaggactacggctgtgtattactgagacgaagagcagtggctggggaacngtgggacgtcgtggggaccaaagggaccacgggtcaccgtctcctcacgcctaccaccgaacggcccacgtccgtccttccccgtcggccctccctaccctaccgaacgaccgccaccgtcggtcgggcctacgcgccggcccgtcgggccgtcgcccgtcggtaccgaacggtacctaccgttcccaacgttaccgtaccgtacgtcggcggccgggtcgtaggaccgacggcgactagtcgn

SEQ ID NO: 220765 - DNA, 603 bp, Homo sapiens
  misc_feature: GYAE6OF01C6846.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccattcaccatctccagagacaacactaagaacttactgtaatctgacaaaatgaaacagcctcagacgccgaaggaccacggctgtgtattactgtgacgaagagcaggtcgggccggtagacgtggtacggtcgtcggggaccgaacgggaccgaccggtccgaccgtacctcctctacgcctcccaccgaacggacccgacctcggtcccttcccccttccggcgcccctccgctcccacggacgccgacccccgacgagccacgacggtccggcccgtcgggtccgtccgccgtcggtcgaacggtacccgttacctccctactacgttccgtactcggaggccgggtactggacgaacggccgcagtgc

SEQ ID NO: 220766 - DNA, 639 bp, Homo sapiens
  misc_feature: GYAE6OF01D6CJW.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagctgggttttcctcgttgctattttagaaggtgtccagtgtgacgtgcagctggtggagtcgtgggggaggcttggtccagccgtggggggtccctgagactctcctgtgcaggccctgcattcattctttaatgttattggatgcacgtgggtccgccgaggccgtccgggggaaggggccggaggtcggggtggaccaaacgataaatgacaagataggaactagaagaaagtaactagtaggtgactcgtggtaggaacggggcctaattccaacctattccctacccgaagaacgtaaccaaactaaccttaaagtaacctttactaggttaactcgtagaacaaagtcgaaaccacggaccctacgaaggaccgacccggaagggaaccacgggtcttaggtagtttaacgtttaccgtggtacggacggaaaggacgtaccggtaagggttcggacgttagggggaacctgggttaccgggg

SEQ ID NO: 220767 - DNA, 671 bp, Homo sapiens
  misc_feature: GYAE6OF01BRT9T.18.87.H10.1.454.CMB.1.raw
  modified_base (296)..(296): a, c, t, g, unknown or other
  misc_feature (296)..(296): n is a, c, g, or t
  modified_base (557)..(557): a, c, t, g, unknown or other
  misc_feature (557)..(557): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctatttagaaggtgtccagtgtgacgtgcagctggtggagtcgtgggggaggcttgggtccaggccgtggggggtccctgagactctcctgtgcaggcctgcattcatcttaatagttattggatgcacgtgggtccnccgaggccgtccggggaaggggccggaggtgggtggaccaaagataaatgacaagatcggaactagaagaaagaactagtggtgaacttcgtaggtaggaacgggccgtattcaccattccaccaaggacaaccaaacaacttaaaagaactttacagttaactctaagaactaaaagtcgaaactaggacccctagaaacgaccggtaccggaaacgggtacctaacgggtcctttggtaagttaaccgttttaaccggngggttaccggaaaggaaacgtcgggacgtagggtcgggtaccggtaaggggtaacctaggggttaccggggtaaccggtttccggggaaccggggggaaacccgtaaacggggg

SEQ ID NO: 220768 - DNA, 588 bp, Homo sapiens
  misc_feature: GYAE6OF01EJ8AL.18.87.H10.1.454.CMB.1.raw
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (484)..(484): a, c, t, g, unknown or other
  misc_feature (484)..(484): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcactgggtccgccaggcgtccggggaggggccggagtgggtgccaanataangacaagatggaactggaagaagaactatgtggactcgtggtggaaggggtcccgaatttccgaacctatcctcccaaggacgaaccaacaactaaagtaacttactgtactctagactaaatcgaacacgcctanagacgccggaaggaccacgggcttcgttaggttaactttaccggtgtacggaaccgaaagggacgcggtaagggttcggaccgttggggaacctggttacgggg

SEQ ID NO: 220769 - DNA, 648 bp, Homo sapiens
  misc_feature: GYAE6OF01D85SJ.18.87.H10.1.454.CMB.1.raw
  modified_base (609)..(609): a, c, t, g, unknown or other
  misc_feature (609)..(609): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctgggtggagtcgtgggggaggcttggtccagccgtggggggtccctgacgactctcctgtgcacggccctgcattcattctttaatagttattggatgcacgtcgggtccgccgaggccgtaccggggaggggccggaggtgggtcgaccaaagataagtgacaagagtaggaactgaagaaagaactagtgtaggactcgtaggtaggaacggggtcctatttaccaacctaattcccgtaacccgaagaacgaaaccaaaccgtaactaaacggtaacctttacgtagttaactcgtaagaacctaaagtcgaaaccacgtacccttacgaacggacggacccgggaaggaccgtaaccgggtcttagggtagtttaacgttcgttagggtacgacgggaaagnggacgtagggtcgggacgtcgggacgtagggtaccgggg

SEQ ID NO: 220770 - DNA, 613 bp, Homo sapiens
  misc_feature: GYAE6OF01B2HUO.18.87.H10.1.454.CMB.1.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccggggaagggccggagtgggtggccaaacataatgcaagatggaactgagaagaactatgtggactctgtgaagggccgattcaccatctccagagacaacactaaagaacttactgtatctgcaaaatgaacagcctcagagccgaggacacggctgtgtattacngtgcgaagngcagtggctggggacagtggacgtcgtagggggcccaaagggcccacgggtcacccgtctccctcacgccctccaccgaacgggcccagtccggtccttccccgtggccgccctgcctccacggcnccacccgtccgagacgccacacggccggccccgtggggccctcggcccgttcgggtaccaaacgggtacccttaaccgttcccccgtaagttaacccgtccggttaaccgtcggaaccggccggggtaccgtcgggaccgaacgggccgactaacgg

SEQ ID NO: 220771 - DNA, 601 bp, Homo sapiens
  misc_feature: GYAE6OF01BYUEK.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccattcaccatctccagagacaacactaaagaacttactgtaatctgacaaatgaaacagcctcagagccgaggacacggctgtgtattactgtgacgaagagcagtggctggggacagtggacgtcgtggggaccaagggacccacgggtcaccgttctcctcgagccctccaccgaacgggcccagtccggtcccttccccgtggccgccctgcctcccaggacgccacccgtcgacgacgccacgacggccggcccgtcgggacctggccctgggtaccgaaacggtacccttaaccttaccccgacttacccgttacccgtaccgtcggaacggccggggtacgttcgggacgaacgggccgcgtaacg

SEQ ID NO: 220772 - DNA, 628 bp, Homo sapiens
  misc_feature: GYAE6OF01BJX25.18.87.H10.1.454.CMB.1.raw
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccgggggaaggggccggagtgggtggccaacataatgcaagatggaactgagaagaactatgtggactctgtgaagggccattcaccatctccagagacaacactaaagaacttactgtatctgacaaatgaacngcctnagagccgaggacacggctgtgtattactgtgacgaagagcaggtggctgggacagtcgggacgtcgtaggggacccaaaggggcccacgggtccacccgttctccctcacgcccctacccgaacccgaaacgggccccctaagttcccggttacccctttccccccggtcgggccccgtccccgtcgcccgtcccgacgggaccgcccacccgtaccggacgacgccaaccgacggcccggtcccgtgggcctcggccgtggaccaacggtaccttaccttcccgacttaccgtcggtactcggacgccggggtcacgggacgaacggcgatacg

SEQ ID NO: 220773 - DNA, 275 bp, Homo sapiens
  misc_feature: GYAE6OF01B6ITT.18.87.H10.1.454.CMB.1.raw
  modified_base (254)..(275): a, c, t, g, unknown or other
  misc_feature (254)..(275): n is a, c, g, or t
tcagtacgagtatgcacgaccggtgctcgatttagcagtactgcgttggggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttccgcatctgacatactcgtactgagcgggctggcaaggcgacaatagnnnnnnnnnnnnnnnnnnnnnn

SEQ ID NO: 220774 - DNA, 604 bp, Homo sapiens
  misc_feature: GYAE6OF01BMTDV.18.87.H10.1.454.CMB.1.raw
  modified_base (346)..(346): a, c, t, g, unknown or other
  misc_feature (346)..(346): n is a, c, g, or t
  modified_base (488)..(488): a, c, t, g, unknown or other
  misc_feature (488)..(488): n is a, c, g, or t
tcagtacgagtatgcacgaccggtgctcgatttagcagtactgcggttgggtttggggaggtctcagataggagccttagccctggactccaaggcctttccacttggtgatcagcactgagcacagaggactcaccatggaattggggctgagtcttgggttttcctcgttgcttattttagaaggtgtccagtgtgacgtgcagctggtggagtcgtgggggagcttggtccagccgtggggggtccctgagactctcctggtgcaggccctgctattcattctttaatagttattggatgcacgtggtccgcgaggcgtcggggagggccgagtggtgacaanataatgacaagataggaactgaagaagaactagtgtaggactcgtaggtagaacggggtccattccaaccgtatcctacaagtaacgaccaaacactaaagtaaccttactagtaactcgtaagactaaatcgaaacgtacncccgtagaacggacggtacccgaaggtaaccacgggtcttacggtattaaccttaggtggtacggaccgaaaggtcgaacgtagggtcggagttaggggaccgtaggttacggggg

SEQ ID NO: 220775 - DNA, 601 bp, Homo sapiens
  misc_feature: GYAE6OF01A5G19.18.87.H10.1.454.CMB.1.raw
  modified_base (568)..(568): a, c, t, g, unknown or other
  misc_feature (568)..(568): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtcgggtccgccgaggccgtccgggggaaggggccggaggtcggggtggaccaaacgagtaacgtgacgaagagtggaactgaagaaagaactagtggtggacttcgtaggtaggaaggggcctattccaaccgtatcctacccaagacgaaccaaacactaaagaactttacgtagtactctagaccaaatcgaaactacgccctacgagacgacccggaaggaccacgggtcttggtacgttacttacgtggtacgacggaaagngacgtaggtcggacgtaggggactggtacgggg

SEQ ID NO: 220776 - DNA, 584 bp, Homo sapiens
  misc_feature: GYAE6OF01B82B4.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctctgtgcaggccctgcattcatctttaatagttattggatgcactgggtccgccgaggccgtaccgggggaagggccggaggtcgggtcggaccaacgataatcgacaaagatagggaactagaagaaagaactagtgtaggactcgtagtaggaacggggcccgtaattccgacctattcctaccgaagagaaccaacaactaagaaactttacgtagtactctagacaaatcgaaacacgacctagagacgaccgaggacacggctagtagtacttacgtgtaggacggaaagaggacgtagggtcggagtaggggactggtacggg

SEQ ID NO: 220777 - DNA, 609 bp, Homo sapiens
  misc_feature: GYAE6OF01C3BFZ.18.87.H10.1.454.CMB.1.raw
  modified_base (480)..(480): a, c, t, g, unknown or other
  misc_feature (480)..(480): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtcccgccgagggccgtccgggggaaggggccggaggtgggtcggccaacataatgacaagataggaactgaagaaagaactagtggtaggtactcgtaggtgaaacggggccattccgacctatcctaccgagaacgaaccaacaacttaaagaacttactgtaactcgtagaacaaatcgaaacngaccctagagacgaccggagaccgacggtcttaggtagttaacttacgtggtacgacggaagacggcgaaggtcggcgttagggaactagggtacggacggttccggcgggggtaacccgaaaccgggg

SEQ ID NO: 220778 - DNA, 780 bp, Homo sapiens
  misc_feature: GYAE6OF01C96TQ.18.87.H10.1.454.CMB.1.raw
  modified_base (145)..(145): a, c, t, g, unknown or other
  misc_feature (145)..(145): n is a, c, g, or t
  modified_base (183)..(183): a, c, t, g, unknown or other
  misc_feature (183)..(183): n is a, c, g, or t
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttatggatgcactgggtccnccaggctccgaaggggaagggccgagtgggtcgccaanataatgcaagatggaactgaagaagaactagtgtggactcngtaggaagggccattcacctatctacagagaccaaacactaaagacttactgtatctgacaaatgaacagccctanaaggacgaccggaggaccacggcttgtagttaattacgtggtagaccgaaaggacgtcgaaggttggaccgtagggaacctaaggtcgggaaccgtcggtacgggggacccgaaaaggggtcccaaccggggttacccacccggttccttcccgtcgaaccgtccctacccgaacccgaaacgggtccccctaacggttccccggttcccgttccccccggtgggtccccgtccccgtccggtcccgtacccggaacggccgtacccgaacccgtacccggaacggaccgacccgaaccgaacgggtccccgggtcccgtccgggggtacctcccgggacccgttacgggtaacccgaaaccgggttaacccttaccccgtttaccccgtaccgtttaacccgttcccggttaacccggttacgggtaacggggtcccgggggttacgtaccggggtaaccggaacgggccggtaaccgg

SEQ ID NO: 220779 - DNA, 687 bp, Homo sapiens
  misc_feature: GYAE6OF01CHLGN.18.87.H10.1.454.CMB.1.raw
  modified_base (425)..(425): a, c, t, g, unknown or other
  misc_feature (425)..(425): n is a, c, g, or t
  modified_base (488)..(488): a, c, t, g, unknown or other
  misc_feature (488)..(488): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtgccaaacataatgcaagatggaactgagaagaactatgtggactcgtgtgaagggcctattcaccatctccagagacaacactaaagaacttactgtaatctagacaaaatgaaacagcctacaagagcccgaagggaccacggctggtataatttactggtgacgaaaggagcgtaaggcggcgtagggatagtcgggaccgttcggacggggaccgaaacgggacccgacggtccacccgtcttacccncgtaccgtccctacccgaaccgaaccgggtcccctaacggttcccgttccccctttaccccgnggcccctccccgtagcccgtaccgaaggaccacctaacccgcgaacgcgaccaacgaccggcccggtcccggttaggaccgttccgaccggttacgtaaaccggtaaacgtaccccttacccttaccccgtaactttacccgacgtttaccggaggaccgggaccgggtcgtaacggaccggaaacggccgactaaagg

SEQ ID NO: 220780 - DNA, 620 bp, Homo sapiens
  misc_feature: GYAE6OF01EODWW.18.87.H10.1.454.CMB.1.raw
tcagtacgagtatgcacgaccggtgctcgatttagcagtactgcgtggagtctgggggaggcttggtccagcctggggggtccctgagactctcctgtgcaggccctgcattcatctttaatagttattggatgcactgggtccgccaggctccgggggaagggccggagtgggtggccaacataatgcaagatggaactgagaagaactatgtgactctgtgaaggccgattcaccatctccagagacaaacactaagaacttactgtatctgacaaatgaacagcctcaagacgaccggaggacacgggcttggtagttattactggtgacgaaagagcgagtggctgggacagtggacgtgtggggaccaaggggacccacgggtcaccgtctcctcagccctaccaccgaacggcccacgtccggtccttccccgtcggcccgcccgtcgcctccgacggacgacccaccgtccgacgacgcaccgacgccggcccgtcgggcctcggtcccgtcgggtaccgaaaccggtaccttaacccgttacccctaacgttacccgttaccgttacggtacggtacgggaccggggtaccgtacgggccgaagggtaccgg

SEQ ID NO: 220781 - DNA, 575 bp, Homo sapiens
  misc_feature: GYAE6OF01E3ZQ1.18.87.H10.1.454.CMB.1.raw
  modified_base (327)..(327): a, c, t, g, unknown or other
  misc_feature (327)..(327): n is a, c, g, or t
tcagtacgagtatgcacgaccggtgctcgatttagcagtactgcgtgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaaagaacttactgtatctgcaaatgaacagcctcagagccgaggacacggctgtgtattactgtgcgaagngcagtggctgggacagtggacgtcgtgggaaccaagggccacggtccaccgtctcctcacgcctccaccaacgggcccacgtccggtccttcccccgtcggccgcccctcgcctcccgacggacgcccacccgtccgacgacgccgaaccgacgccggcccgtgggcctcgcccgtggtacaacggtactaccttcccacttacctcgtactcgacggccgggtcgtacgggacgacgggcgcgaacg

SEQ ID NO: 220782 - DNA, 652 bp, Homo sapiens
  misc_feature: GYAE6OF01DKPWJ.18.87.H10.1.454.CMB.1.raw
  modified_base (183)..(183): a, c, t, g, unknown or other
  misc_feature (183)..(183): n is a, c, g, or t
  modified_base (333)..(333): a, c, t, g, unknown or other
  misc_feature (333)..(333): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggcgtccgggggaagggccggagtgggtgccaaanataatgcaaagatggaaactgaagaaagaactatgtggactctggtgaaagggccattcaccatctcagagacaaacataaagaacttatgtatctagactaaaatgaacagccctagagagccgaaggacacggtctggtattattacnggtagacgaaagcgctaaggtggtacgaggggactaggtcgggacggttcggacgggaaccggaacggaccgacgtcctacccgttctcccacgacctccctaaccgaacggaccggccgtacgttcccgtccccttcccggcgtccctccgcgcccgtacggacgggaccaccccgtacgaccgggaagacgacccaccgggaccggcccgtacccggtcgtacgccgtacggtacgaaaccgtaccgtaacccttaccctacgtaaccgttcgtaccggtgaaccgggcggccggtcacgggagacggtccagtacg

SEQ ID NO: 220783 - DNA, 623 bp, Homo sapiens
  misc_feature: GYAE6OF01BMVPI.18.87.H10.1.454.CMB.1.raw
tcagtacgagtatgcacgaccggtgctcgatttagcagtactgcgttgggtttgggggaggcttggtccagcctgggggtccctgagactctcctgtgcaggccctgcattcatcttttaatagttattggatgcactgggtccgccaggctccggggaagggccggagtgggtggccaacataatgcaagatggaactgagaagaactatgtggactctgtgaaggccattcaccatctccagagacaacactaagaacttactgtaatctagacaaaatgaaacagcctcagacgccgaaggacacggtctgtgtattactgtgcgaagagcagtggctgggacagtggacgtcgtggggaccaaagggacccaggtccaccgttcctcgtcacgccctaccaacgaaccgggcccacgttccggttccctcccccgtggcccgccctgcctccgagacgccaccgtccgagacgcgacacggccggcccgtgggcctcggcccgttaggtaccgaaacggtacccttaacccgtttaccccaacgtttacccttacccggttaaccgtcggaacgggtcccggggtccgtacgggaccgaacgggtcccgacgtaaacgg

SEQ ID NO: 220784 - DNA, 691 bp, Homo sapiens
  misc_feature: GYAE6OF01EKUJ4.18.87.H10.1.454.CMB.1.raw
  modified_base (589)..(589): a, c, t, g, unknown or other
  misc_feature (589)..(589): n is a, c, g, or t
tcagtacgagtatgcacgaccggtgctcgatttagcagtactgcgttgggtttgggggaggtctcagagaggagccttagccctggactccaaggtcctttccacttggtgatcagcactgagcacagaggactcaccatggaagttggggctgagcgttgggttttcctcgttgtcttattttaagaaggttgtccagtgtgacgtgcagctgggtggagtcggtggggggaggtcgttcggtccacggtccggtcggggggtccctggacgtcttcctcctgtcgcgacggccctgctacttctatttacttttaaattagtttagttggattcgaccgtacggttcggggtcccgccggacgggtccgggtaccggggggaacggggccgggtagggtcggggtacggacccaaaacgtagtaacgtacgacgaaagagttagggaacgtaggaaagaaaagtaactagtacggtgtaacttcgtaggtagggaacgggtcctaacttccaaccgtatcccgtaccgaagaacaacaaactaacgtaaacgtaactttacgtgtactgtacgaactaaatcgaaanccgtacctagaagaccggacccggaagccgacggtcttagggtacttaagttcgtggacggacgaaggcgcgtagggcgaccgtaggggactgggtaccggg

SEQ ID NO: 220785 - DNA, 535 bp, Homo sapiens
  misc_feature: GYAE6OF01AYRJB.18.87.H10.1.454.CMB.1.raw
  modified_base (444)..(444): a, c, t, g, unknown or other
  misc_feature (444)..(444): n is a, c, g, or t
tcagtacgagtatgcacgaccggtgctcgatttagcagtactgcgttgggtttggggaggcttggtccagcctgggggtccctgagactctcctgtgcaggccctgcattcatctttaatagttattggatgcactgggtccgccaggctccggggaagggccggagtgggtggccaaacataatgcaagatggaactgagaagaactatgtggactctgtgaagggccgattcaccatctccagagacaacactaagaacttactgtatctgcaaaatgaacagcctcagacgccgaggacacggctgtgtacttactgtgcgaagagcagtggctgggacagtggacgtcgtggggaccaagggccaacggtcaccgttctcctcagccctccaccgaagggcccagtcgtccttcccactcggcgccctgcctccaggacncgacctccgagacgcacagccggccctgggctcgcctggcaaggacctacttcccattacctcgtactgacgcggactggccaaggcgacg

SEQ ID NO: 220786 - DNA, 644 bp, Homo sapiens
  misc_feature: GYAE6OF01CI4BZ.18.87.H10.1.454.CMB.1.raw
  modified_base (466)..(466): a, c, t, g, unknown or other
  misc_feature (466)..(466): n is a, c, g, or t
  modified_base (488)..(488): a, c, t, g, unknown or other
  misc_feature (488)..(488): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccaagagacaacactaaagaacttactgtatctgacaaaatgaaacagcctcagacgccgaggacacggctgtgtattactgtgacgaagagcaggtggcgtgggacagtgggacgtcgtcggggaccaaacggggaccacgggtcaacccgttctccctcgacgccctacccgaaccgaacgggtccccacgtcccggttcccccttccccgtgggaccccncccgtcgccctccgacggtacnccaacccgtcggaacgcgccacgacgcccgggcccttggggccttcggacccgtgggtaccaaacggtacccttacccgttccccgtaacgtacccgttcggttctacgggaccggtcccgggtacgtcggggacctaacggggcgtaaccgtaag

SEQ ID NO: 220787 - DNA, 535 bp, Homo sapiens
  misc_feature: GYAE6OF01B54TS.18.87.H10.1.454.CMB.1.raw
  modified_base (420)..(420): a, c, t, g, unknown or other
  misc_feature (420)..(420): n is a, c, g, or t
  modified_base (477)..(477): a, c, t, g, unknown or other
  misc_feature (477)..(477): n is a, c, g, or t
  modified_base (511)..(511): a, c, t, g, unknown or other
  misc_feature (511)..(511): n is a, c, g, or t
  modified_base (528)..(528): a, c, t, g, unknown or other
  misc_feature (528)..(528): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagccgtggggggtccctgagactctcctgtgcaggccctgcattcatctttaatagttattggatgcacgtgggtccgccagggcgtccgggggaaggggccggagtggggtggaccaacagtaatgacaagatggaactgaagaagaactagtgtggactctgtggaaggggccattccaaccattccnccaagagaaccaaacactaaagaacttactgtatctagaccaaatcgaacagcctanagacgccgaggcaggctgtgtatctgtgcgaagngcaggtcgagtgggacngtacggg

SEQ ID NO: 220788 - DNA, 590 bp, Homo sapiens
  misc_feature: GYAE6OF01ANBCE.18.87.H10.1.454.CMB.1.raw
  modified_base (377)..(377): a, c, t, g, unknown or other
  misc_feature (377)..(377): n is a, c, g, or t
  modified_base (510)..(510): a, c, t, g, unknown or other
  misc_feature (510)..(510): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcacgtggtccgcaggcgtccgggggaagggccggaggtcgggtcggccaacgataatgacaagacgtggaactgaagaanaactagtggaggtactcgtagacggaagggccctattccaaccgtattcctaccgaacggacgtaaccgaaacctaacgtaaacgtaaccttactaggtaactctacgaactaaacgttgaaacacgtcctanacgtaacgccggaaggccaacggtcttagtagtattacgtggnggacgaagnacgtaggtcgcgtgggacctaggtcggg

SEQ ID NO: 220789 - DNA, 578 bp, Homo sapiens
  misc_feature: GYAE6OF01DJSOT.18.87.H10.1.454.CMB.1.raw
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
  modified_base (548)..(548): a, c, t, g, unknown or other
  misc_feature (548)..(548): n is a, c, g, or t
  modified_base (566)..(566): a, c, t, g, unknown or other
  misc_feature (566)..(566): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagaggactcaccatggaattggggctgagcgtggtttcgcgtagcgtatttagaaggtgtcagtgtgacgtgcagctggtggagtcgtgggggaggcttggtccagccgtggggggtccctggagactctcctgtgcaggccctgcattcatctttaatagttattggatgacacgtgggtcccgcgaggccggtccggggggaacggggccggaggtggggtcggaccaaactataagtgacgaaagngtaggaactgaagaaagaactagtggtagacgtcgtggtaggacggggtcacttccgaacctntacctccaggaacaacaacaataaacgtaccttagtgtactctagacaatacgacacgctacgagacncggagacaccggtntgttatacgttacgtgtacggaacgaagnggacaggtgggtccgagngtaggtaccggg

SEQ ID NO: 220790 - DNA, 694 bp, Homo sapiens
  misc_feature: GYAE6OF01DZSFI.18.87.H10.1.454.CMB.1.raw
tcagtacgagtatgcacgaccggtgctcgatttagcagtactgcgttgggtttggggaggtctcagagaggagccttagccctggactccaagtcctttccacttggtgatcagcactgagcacagaggactcaccatggaattggggctgagcttgggttttcctcgttgctattttagaaggtgtccagtgtgacgtgcagctgggtggagtcgtgggggaggcttggtccagccgtggggggtccctgagactctcctgtgcaggccctgcattcattctttaatagttattggatgcacgtcgggtccgccgaggccgtccgggggaaggggccggaggtggggtacggacccaaacgataaagtgacaaaggatagggaaactggaaagaaagtaacttagtggtaggacttcgtaggtaggaacgggggccctaatttcccaacctagttaccctacccgaaggaaacgaaaccaaaacctaaccttaaaaggtaaacctttaacgtaggttaacttcccgtagaacctaaaacgtacggaaacctacggtcccttagaacggaacggtaccccggaagggaaccctaaccgggtccttaggttacgtttaaacgtttaacgtgggttaggaccggaaaggtacggaccgagggttacgggcgttaagggggacctagggtaccgggg

SEQ ID NO: 220791 - DNA, 611 bp, Homo sapiens
  misc_feature: GYAE6OF01AOBBD.18.87.H10.1.454.CMB.1.raw
  modified_base (332)..(332): a, c, t, g, unknown or other
  misc_feature (332)..(332): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccggggaaggggccggagtgggtggccaacataatgcaagatggaactgaagaagaactatgtggactctgtgaagggccgattcaccatctccagagacaacactaagaacttactgtatctgacaaatgaacagcctcagacgccgaggacacggctgtgtattactgtgacgaagngcagtggctgggacagtggacgtcgtggggaccaagggaccacgggtcacccggttctcctcacgccctccaaccgaacgggcccagtcccggtcccttccccgtcggcccgccctcgccctccgacggacgccctacccgtccgacgacgccgaaccgacggcccggtcccgtggggcctcggcccgtcgggtaccgaacgggtaccttacccgttccctaacgttaccctacggtacctcggacggccgggtctcgggaccaacgggccgacgtacg

SEQ ID NO: 220792 - DNA, 589 bp, Homo sapiens
  misc_feature: GYAE6OF01DBDP0.18.87.H10.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
  modified_base (583)..(583): a, c, t, g, unknown or other
  misc_feature (583)..(583): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttatggatgcactgggtccgccaggctccgggggaagggccggagtgggtggccaaacataatgcaagatggaactgagaagaactatgtgactctgtgaagggccattcaccatctccagagacaaanactaaagaacttactgtaatctgacaaaatgaaacagcctnagacgccgaggaccacggctgtgtattacgtgtgacgaagagcaggtggcgtggacagtggacgtcggtggggaccaacgggaccacggtccaccgtctcctcgacgccctaccaccgaacggcccacgtccggtcccttcccgnggcccnccctgcctccgaggacnccacccgtaccgagacgccaccgacggcccgtacccgtggccttcggccgtgggtaccaacggccttaccttcccgaattaccctcgtacgtcgacggcgggcttacgggcaaacgggccngtaacg

SEQ ID NO: 220793 - DNA, 590 bp, Homo sapiens
  misc_feature: GYAE6OF01D3AZE.18.87.H10.1.454.CMB.1.raw
  modified_base (292)..(292): a, c, t, g, unknown or other
  misc_feature (292)..(292): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccgggggaaggggccggagtgggtggccaacataatgcaagatggaactgagaagaactatgtggactctgtgaagggccattcaccatctccagagacaacactaagaacttactgtatctgacaaatgaaacagcctnagagccgaggacacggctgtgtattactgtgcgaagagcaggtggctaggggacagtggacgtcgtggggaccaagggccacggtcaccgtctccgtcacgccctaccaccgaacgggccctacgtccggttccttcccccgtcggcccgccccgtcgcctccgacggacgccacccgtccgacgacgaccacgacggccggcccgtcgggcctgccgtggtaccaacggtaccctaccttacccgataccttcggtacgtcggacgaccgggtcgtacggaccgaacggcgtgaacg

SEQ ID NO: 220794 - DNA, 623 bp, Homo sapiens
  misc_feature: GYAE6OF01BG3HO.18.87.H10.1.454.CMB.1.raw
  modified_base (293)..(293): a, c, t, g, unknown or other
  misc_feature (293)..(293): n is a, c, g, or t
tcagtacgagtatgcacgaccggtgctcgatttagcagtactgcgttgggtttgggggaggcttggtccagcctggggggtccctgagactctcctgtgcaggccctgcattcattcttttaatagttattggatgcactgggtccgccaggctccgggggaagggccggagtgggtggccaacataatgcaagatggaactgagaagaactatgtggactcgtgtgaagggccattcaccatctccagagacaacactaagaacttactgtatctgacaaatgaacagcctnagacgccgaggacacggctgtgttattacgtgtgagaagagcaggtggcgtagggactagtcgggacgtcggtcggggacccaaaggggcccacgggtccaccgtcctcctacacgccctacccgaccgacggccctacgtcccggtcccttccccgcggcccgccctcgcctaccgacggacgccacccgtccgacgacgccacgcggcccggcccgtcgggcctcggtccgtcggtacgaacggtaccttaacccgtttaccccgaacgttacccggtacgtcggacgggcccgggtcgtacgggaccggaagggccgtacgagtacg

SEQ ID NO: 220795 - DNA, 267 bp, Homo sapiens
  misc_feature: GYAE6OF01EF2GE.18.87.H10.1.454.CMB.1.raw
  modified_base (259)..(267): a, c, t, g, unknown or other
  misc_feature (259)..(267): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccgagggtggacatcaagcgaactgtggctgcaccatctgtcttcatcttcccgccatctgacatactcgtacgtgaggcgggctggcaagggcgacaagtgnnnnnnnnn

SEQ ID NO: 220796 - DNA, 647 bp, Homo sapiens
  misc_feature: GYAE6OF01EAK2V.18.87.H10.1.454.CMB.1.raw
  modified_base (354)..(354): a, c, t, g, unknown or other
  misc_feature (354)..(354): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgctattttagaaggtgtccagtgtgacgtgcagctggtggagtcgtgggggagcttggtccagccgtggggggtccctgagactctcctgtgcaggccctgcattcattctttaatagttattggatgcacgtggggtccgccgaggccgtccgggggaagggccggaggtcggggtgaccaanataatgacaagagtaggaactggaagaaagaactagtgtggactcgtggtacggaacggggtcctaatttcccaacctattccctaccgaagaacgaaccaaacgaacttaaagaacctttacgtagttaactctagaactaaagttcgaaactacgaccttacgaaggtaccgacccggagggaaccgaccgggtcttaggttaggtttaacgtttacggttggtacgggaccggaaaaggcggtaccgtaaggggttcgggacgttacgggggtaacctagggtaccgggg

SEQ ID NO: 220797 - DNA, 258 bp, Homo sapiens
  misc_feature: GYAE6OF01EXRU0.18.87.H10.1.454.CMB.1.raw
  modified_base (253)..(258): a, c, t, g, unknown or other
  misc_feature (253)..(258): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccaaggtggagatacaaacgaactgtggctgcaccatctgtctcatcttcccgccatctgacatactcgtactgagcgggctggcaaggcgcatagnnnnnn

SEQ ID NO: 220798 - DNA, 791 bp, Homo sapiens
  misc_feature: GYAE6OF01D4ZZR.18.87.H10.1.454.CMB.1.raw
  modified_base (712)..(712): a, c, t, g, unknown or other
  misc_feature (712)..(712): n is a, c, g, or t
tcagtacgagtatgcacgaccggtgctcgatttagcagtactgcgttgggtttggggaggtctcagagaggagccttagccctggactccaaggccctttccacttggtgatcagcactgagcacagaggactcaccatggaagttgggctgagtcgttgggtttcctcgttgcttatttaggaaggtgtccaggtgtgacgtgcgagcgtgggtggtagtcggtggggggagtcgttcgggtccgacggtcccggttcgggggggtcccctggtacgtaccgttccgtccgtggtcgccgaccggtccctggtcctatttcctaatttacttttaagtagtttagttggattcgactacggtcgggtcccgaccggacgggtccgggtacccggggggaacggggaccggtaggggtcggggtaccgaaccctaaacgtaagtaagtacgaacgaaaggtagtaacgggtaaactaggaaacggtaaagtaaccgtagtgggtacgtaccttggtaggtacgggacgtccgttaccttacaaccctagttaccgaaccaaagaccgaacctaaaacgaacgttaacctaagttactaagtacctacgtaagtaaaccaaaggttaccgaaaccgtcccgtaactcggaaaagggccggttaacccggaaacgggacctacgggtactttcgggttaagttaactttcgggngggttaaccgaaaggaaccggtacggacgttacggggtacggtacccgggttaagggaaacgtccggggtttaccgggg

SEQ ID NO: 220799 - DNA, 612 bp, Homo sapiens
  misc_feature: GYAE6OF01B7VMH.18.87.H10.1.454.CMB.1.raw
  modified_base (320)..(320): a, c, t, g, unknown or other
  misc_feature (320)..(320): n is a, c, g, or t
  modified_base (511)..(511): a, c, t, g, unknown or other
  misc_feature (511)..(511): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtcccaggcccgtggggggtccctggacgactctcctgtgcacggcccctgcattcattctttaaatagttattggatgcacgtcgggtcccncacggccgtaccgggggaaggggcccggaggtcggggtcggcccaaacagtaatcggacaaaggatagggaactggaagaaagaactagtggtaggactcgtgagaacggggtccaatttacccacctatcgtacccaagacgaaccaaacactaagtaacttactgtactctagaactaagtacgaaccncgacctacgagaaccgccggaggaaccgtcgggcctttagacggttaacttacgtagtacggacgaagcgacgtaggtacggccgagggactgggtaccgg

SEQ ID NO: 220800 - DNA, 659 bp, Homo sapiens
  misc_feature: GYAE6OF01EU0K2.18.87.H10.1.454.CMB.1.raw
  modified_base (612)..(612): a, c, t, g, unknown or other
  misc_feature (612)..(612): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgctattttagaaggtgtccagtgtgacgtgcagctggtggagtcgtgggggaggcttggtccagcccgtggggggtccctggagactctcctgtgcaggccctgcattcattctttaaatagttattggatgcacgtgggtccgccgagggccgtccgggggaaggggccggaggtggggtcggaccaaacataatgacaaagagtaggaactggaagaaagtaactagtggtaggacttcgtagtagggaacgggccgtaatttccaacctattccctacccgaaggaacgaaacctaaaccgaacttaaaacgtaacctttactagtaactcgtacggacctaaaagttcgaaaccacgtccctacgaaggtaccggacccggtaagggaacccacgggtcttagggttagttaactttacgtaggtcggaacggaaagnggacccgtaagggtcgggacgtagggggaacctaggttaaccggggg

SEQ ID NO: 220801 - DNA, 694 bp, Homo sapiens
  misc_feature: GYAE6OF01CU2YV.18.87.H10.1.454.CMB.1.raw
  modified_base (187)..(187): a, c, t, g, unknown or other
  misc_feature (187)..(187): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (408)..(408): a, c, t, g, unknown or other
  misc_feature (408)..(408): n is a, c, g, or t
tcagtacgagtatgcacgaccggtgctcgatttagcagtactgcgtggagtctgggggaggcttggtccagcctggggggtccctgagactctcctgtgcaggccctgcattcattctttaatagttattggatgcactgggtccgccaggcgtccgggggaaggggccggaggtgggtggaccaanataatgacaagatggaactgaagaaagtaactatgtggactntggagaagggccattcaccatcncaganaacaacactaaagtaacttacngtaatctagacaaaatgaaacncgccctacaaggaacggcccgaagggtaccacgggtcttgtagttaattaccgtggagacggaaagcgtcgaaggtcggcgtaggggaacagttggaccgtttcggnggggaacccaaaggggacccacggtccacccgtctccctgacgccctaccaaccgaacggcccacgtccggtacccttccccgtcggcccgcccgtacgcccgtccgacgggacgccgacccgtacccggaagaccgaccgaaccgaccggcccgggacccgtcgggccgtccggtcccgtacgggttacccgaaacgggtacccttacccgttaccccgtaacttacccgttaccggttaacgcggtaaccgggccgggtacggtaccgggaccgaacgggaccg

SEQ ID NO: 220802 - DNA, 781 bp, Homo sapiens
  misc_feature: GYAE6OF01D53CF.18.87.H10.1.454.CMB.1.raw
  modified_base (266)..(266): a, c, t, g, unknown or other
  misc_feature (266)..(266): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcggtggtttcgtcgtagcgtatttagtaaggtgtcagtgtgacgtgcagctggtggaggtcgtgggggagcgttggtccagccgtggggggtccctggagctctccgtgtgcncggccctgctattctattctttaatagttattggattgctacgtcggtccgccgaggccggtacggggaacggggccggtaggttgggcggaccaaacgtataaagtggacgaaaggtatagggaacgtaggaagaaacgtaacgtagttggtagtaccgttcgtaggtaggaacggggtccctaattacccgacctaacttcccgaacccaaaggaacaaccctaaacctacgttaaaaagttaacccctttacgttagtttaaacttccggtaaaacgaacgttaaaacgtacgggaaacccgtaccgtaacccgtaagggaaccgggaacccgggaacccgggtaacgggtaaaccccgtacggggttacccgttttaaaggggttaccgttttaaacgttacccgggttagggtaacggggaaacggttaaacggacgggttaacgggtacggggttaacccggggttaacccgggttaagggggtaacccgtaggggggtttaaccgggg

SEQ ID NO: 220803 - DNA, 605 bp, Homo sapiens
  misc_feature: GYAE6OF01A0EAI.18.87.H10.1.454.CMB.1.raw
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (591)..(591): a, c, t, g, unknown or other
  misc_feature (591)..(591): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagcgttgggttttcctcgttgcttattttagaaggtgtccagtgtgacgtgcagctggtggagtcgtgggggaggcttggtccagccgtggggggtccctgacgacctctcctgtcgcgaggccctgcattcattctttaatagtttattggatgctacgtcgggtcccgccgacggccggtaccgggggaacggggccgggagggtgggtcggaccgaaacgtagtaagtcggaacgaagagtaggaaacgtaggaaagtaagaacgttagtcggtaggtactcgtggtacggaacgggcctattaccacctatcctaccgaagaacgaacaacgaataaacgtaaccttatagttactcgtacgaactaancgaaacncgacctagagacgcgagacacgtnttgtnttagtcgtgcgagagtgcgtaggcggacgngggaactggtacgg

SEQ ID NO: 220804 - DNA, 684 bp, Homo sapiens
  misc_feature: GYAE6OF01A8D6Q.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtccgccgaggcgtccgggggaaggggccgggaggtggggtggaccaacgataatgacaaaggatggaactggaacgaaagaactagtggtacggtactcgtaggtaggaaacggggtcccgtaatttccgaaccctattccctacccgaaggaacgaaccaaacgtaaactaaacgtaaacctttaactacgttaactactagaacaaaatcgaaacacggaccctacggaacgtacggacccggaagggaacccgacgggtcttaggttagttaactttacgtggttacggaacggtaaaggacgtacgaaggggttcggaccggtggggaaacgtaggttacggggaaccggtttacgggtccgggggggtaaccgaaaacccggggg

SEQ ID NO: 220805 - DNA, 708 bp, Homo sapiens
  misc_feature: GYAE6OF01DJY36.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccagccgtcgggggtccctgacgactctcctgtgcacggccctgctattcattactttaatagttattggattgcgtacgtcgggtcccgcgacgggccggtaccgggggaacgggccggtaggtcggggtacggaccaaactagtaacgtgacaaagacgtaggaactaggaaagaaacgtaactagtggtacggacttcgtaggtaggaacggggcctaattccgaacctatccgtacccgaagaaacgaacctaaactaactaaaacgtaacctttacgtagttaacttccgtaagaaccttaaaaacgtcggtaaaaccgaccggttacccctacggaaacgggacccggaaccggacgggtaacccgaaccgggttcgttagggttaacgtttaaactttacggtaggtacggaaccggaaaagtcggaccgtaagggttcggacggttaacgggaaccttgggtaacccggggg

SEQ ID NO: 220806 - DNA, 696 bp, Homo sapiens
  misc_feature: GYAE6OF01EEOUU.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccgagccgtcggggggtccctgagactctcctgtgcaggccctgcattcattactttaatagttattggatgcacgtcgggtccgccgaggccggtccgggggaaggggccggagggtgggtcggaccaaacataagtgacaagagtaggaactggaagaaagtaactagtaggtaggtacgttcgtggtagggaacggggtcccgtaatttacccaacccgtattacccgttacccgaaaggaacggaaaccaaaccgtaactttaaaacggtaaaccttttaccgttagttacttcctagaacctaaaagttcgaaacctacggaccccttaagaacggtaccggaaccggacggaacccgtaccggggtactttggggttaaactttaacgtttacgttgggtaacggaccggaaaagcggaccgtagggtcgggacgttaggggtaaacctgggtaccggggg

SEQ ID NO: 220807 - DNA, 688 bp, Homo sapiens
  misc_feature: GYAE6OF01C4GQR.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctggacgactctcctgtgcaggccctgctattcattcttttaatagttattggatgcacgtgggtccgccgaggccgtaccggggggaaggggccggaggttcggggtcggacccaaacgaataagtgacgaaagagtaggaactgaagaaagaactagtggtacgacttcgtaggtaggaacggggacccgttattcccgaacctacgttccctaccgaagaacgaaaccaacgtaactaaacgtaaacctttacgtagttacttactacgtaactaaagtacgaaactaccggtccttaacgaacggaaccggtacccgggaaggacccggaaccgggtctacggttagttaacgttttaccggtaggttaccgggaacgtaaaaggcggtaaccgtaagggttcgggaccggttaagggggacctaacgggttacgggg

SEQ ID NO: 220808 - DNA, 616 bp, Homo sapiens
  misc_feature: GYAE6OF01AHC1W.18.87.H10.1.454.CMB.1.raw
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccattcaccatctccagagacaacactaaagaacttactgtatctgacaaatgaacngcctcagacgccgaggaccacggctgtgtattactgtgacgaagngctaggtggctggggacagtgggacgtcgtggggacccaaggggaccacggggtcacccggttctccctcgacgccctccaaccgaaccgggcccacgttcccggtcccttcccccgtcggcccgtccccgtcgcccgtcccgacggacgccgacccgtaccgacgcgccacgacggccggcccgtcgggccgtcgccgtcggtacgacggtaccctaccgttacccgactaccgttcggtaccgtcggacggtccgggtaccgtcggaccgacgggccgcgtacg

SEQ ID NO: 220809 - DNA, 666 bp, Homo sapiens
  misc_feature: GYAE6OF01B8UIN.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccattcaccatcctccagagacaaacactaaagaacttactgtatctagacaaaatcgaacacgcctacaggacgccggaggaccacggtctggtagttattactggtacgacgaaagagcgagtcgggcgtaggggaacagtcgggacgtcggtgggggacccaaaggggacccacgggtccaccgttctccctacacgtccctacccgaccgaacgggccctaacgtcccggttccccttcccccgtggcccgtcccgtcgcccgtccgacggaccgcccgtaccctccggaacgacgccgaacgacggcccggtcccgtgggccctcggcccgttagggtaccgaacggtacccttaacccgttacccgtaccttaccgttaccggtaccgtgggaccggccgggtcgtacgggacgaacggccgtagtaacgg

SEQ ID NO: 220810 - DNA, 673 bp, Homo sapiens
  misc_feature: GYAE6OF01A14QI.18.87.H10.1.454.CMB.1.raw
  modified_base (257)..(257): a, c, t, g, unknown or other
  misc_feature (257)..(257): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctatttagaaggtgtccagtgtgacgtgcagctggtggagtcgtgggggagcttggtccagccgtgggggtcctgagactctcctgngcaggccctgcattcattctttaaatagttagttggatgctacgtgggtccgccgaggccggtccgggggaaggggccggaggtcggggtacggacccaaacgtaattaacgtcggacaaaggagtacgggaaactgggaaacgaaagtaacgtagtggtacgggtactcgtaggtaggaacggggccctagttacccaccgtactccgtaccgaaggtaacgaaccaaacaacgttaaaggaacctttaacgtagttaactcctaagacctaaaagtcggaaacctacgtacctagaacggacggacccggaggacctacgggtccttaggttaacgttaactttccggtaggtacggaaccggaaaggcggtacggtaagggttcggaccggttacggggaactgggtacgggg

SEQ ID NO: 220811 - DNA, 605 bp, Homo sapiens
  misc_feature: GYAE6OF01DX1EL.18.87.H10.1.454.CMB.1.raw
  modified_base (391)..(391): a, c, t, g, unknown or other
  misc_feature (391)..(391): n is a, c, g, or t
  modified_base (460)..(460): a, c, t, g, unknown or other
  misc_feature (460)..(460): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctggagctgggttttcctcgttgcttattttagaaggtgtccagtgtgacgtgcagctggtggagtcgtgggggaggcttggtccagccgtggggggtccctgagactctcctgtgcaggccctgcattcattctttaatagttattggatgcacgtgggtccgccgaggccgtccggggggaaggggccggaggtgggtcggccaacataatgacaagatggaactgaagaagaactagtgtggactcgtaggngaagggccattccaccatcctaccagacaccaaactactaaagaacttatgtatctgacaaatgaaacncgcctacgaacgacggacccggaagaccgacgggcttggttagtaactttaccgtggacgaccggaaaggcgtacgtaggggtcggaccggttgggaaactggttacggggaccggtttcgggacgggggaccctaaaccggggg

SEQ ID NO: 220812 - DNA, 873 bp, Homo sapiens
  misc_feature: GYAE6OF01B4KZC.18.87.H10.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagtacgagtatgcacgaccggtgctcgatttagcagtactgcgtggagtcgtgggggaggcttggtccagccgtgggggtccctgagactctcctgtgcaggccctgcattcattctttaatagttattggatgcacgtgggtccgccgaggccgtccggggggaaggggccggaggtgggtcgaccaaanataagngacaaagataggaactggaagaagaactagtggtaggacctgtaggtaggaaacgggccctaattcacctattccaaccaaggaacaaccaaactaacgttaaaacgtaactttacgtgttaatctagaacaaaatcgaacncgccagacgacgccggaaggtaccacggtcttaggtatattacgngtagacgaagacgngagtcggcgtaggaactaggtacggacgttggaaccgggaccgaaacgggccctaccgggtcaacccggttctaccccgtacgacccgtaccccgacccgaaccccggtaaccgggtacccctaaccggttcccggggttccccctttccccccgggttcgggaccccccgggtaccccttccggtaccccggttaacccggaaccgggtacccggacccttaaccccgggacccgggtaaggaaccccgggtaccaaccccggggtaacccgggcccccggggtttacccgggtaccccggggttccgtacccgggttacccggtaacgggttaaacccggtaaaaacccggttacccgtttaaaccccccgtttaaccctaaccggttttaccccggttaaccgggttaacccggtaacggggtaccgggtacccgggaccggttaccgggaaccggtaaccgggacccgg

SEQ ID NO: 220813 - DNA, 804 bp, Homo sapiens
  misc_feature: GYAE6OF01CY1LC.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcacatggaagttggggctgagtcgttgggttttcctcgttgtcttattttaggaaggtgtccagtgtgacgtgcagcgtgggtggaggtcggtggggggaggtcgtttgggtccgacggtccgggtcgggggggttccctggacgtacctccgtccgtggtcgcgacggccctgctattctattactttaatagttattggatcgactacgtcgggtccgcgacgggccggtaccggggggaacggggccggagggtcggggtacggaccaaacgtaataagtcgacgaaaggtagtacgggaaactaggaaacggtaaagtaacgttaggttaggtacggtaacttcggttaggtaagggaaaccggggtccgtaacttacccgaacccgtacgttacccaccgaaaggaaccgaacctaaaacctaaacgttaaaacgttaacctttacgttaagtacttacgtaacgaaacctaaaagtccgaaacgtcgtacccctaagggacggaaccgggtccccgggaaaagaccggtaccgggttctttagggttacgttaacgttacggcgggtaacggaaacgtaaagggtccgaggtacggggtggtaccgggttacggggaaacttcggggtaccgggtaccggggtttcccgggaacggggggaaacccccggtaacgggg

SEQ ID NO: 220814 - DNA, 748 bp, Homo sapiens
  misc_feature: GYAE6OF01C2T3I.18.87.H10.1.454.CMB.1.raw
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
  modified_base (266)..(266): a, c, t, g, unknown or other
  misc_feature (266)..(266): n is a, c, g, or t
  modified_base (372)..(372): a, c, t, g, unknown or other
  misc_feature (372)..(372): n is a, c, g, or t
  modified_base (565)..(565): a, c, t, g, unknown or other
  misc_feature (565)..(565): n is a, c, g, or t
  modified_base (694)..(694): a, c, t, g, unknown or other
  misc_feature (694)..(694): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgtggtttcncgtagctatttagaaggtntcctagtgtcgacgtgcgagcgtggtggacgtgtggggaggtcttggccgaggccgtcgggggcctgacgtctctctgtgaccnggccctgctattctactctttaaagtgttattggatgaccgacgtcgggtccgcgacggccggtacgggggaaggccggtaggttcgggacgtaccaaagattaanacggtcaaagacggtaagtaacgtagaaaacggttaacgaaacgttaggtttacggacggttacccgttagtaccgggtttaaggaaaccgggggtccttaaaccgttacaaaccggtacttacccgaccgaaaggttaaacccgaaaacctaaggtaaacccttaaaggtaccctttaagtaggtttaaccnccgttaagtaacgaaaacttggaaacctacggtacctaacggaacggtaaccgttccgggaaacggttccaacgggttcttaacgggttaattaacccggttaggacgtttaaacggaaccgggaaagngggttaaccccgtaggttaacggccggttaaaaggggccctggttaaaccgggg

SEQ ID NO: 220815 - DNA, 603 bp, Homo sapiens
  misc_feature: GYAE6OF01AX8FI.18.87.H10.1.454.CMB.1.raw
  modified_base (248)..(248): a, c, t, g, unknown or other
  misc_feature (248)..(248): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccgggggaagggccggagtgggtggccaaacataatgcaagatggaactgagaagaactatgtggactctgtgaaggccattcaccatctccaganacaacactaaagacttactgtactctgacaaaatgaaacagcctcagacgccgaggacacggcttagtgtacttactggtacgacgaaggagcaggtggctgggacagtgggactcgcggggaccaagggccctacgggtccgccgtcctccgtacacgccctaccgaccgacggacccgacgtccggtcccttccccgtcggccgtcccgtcgcctccgacgacgccaccgtccggaagacgccgaacgcggccggtacccgtgggctcgccgtcgacgtaaccggtactaccgttacccgacttaccgtcgtaccgtggacggtccggtccgtacggaccgacggcgtcgacg

SEQ ID NO: 220816 - DNA, 639 bp, Homo sapiens
  misc_feature: GYAE6OF01BWW00.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccagcctgggtcgtccctgagactctcctgtgcacggccctgcattcattctttaatagttatggatgcacgtgggtccgcgaggccgtaccgggggaaggggccggaggtcgggtgaccaacataagtgacaagatggaactgaagaagaactagtggtaggactcgtgtaggaacgggtccgtattccaaccattccctaccgaagaacgaaccaaacaacgttaaagaaacctttacgtagttaacttccgtagaactaaaagtacgaaaccacgtccctacgaacgacggacccggaagggaacccgaccgggtcttaagggttacgtttaaacgtttaccgtaggttcgggaacggtaaaggacggtaccgtacgggttagggcccggttagggggaacctagggg

SEQ ID NO: 220817 - DNA, 748 bp, Homo sapiens
  misc_feature: GYAE6OF01A2MNE.18.87.H10.1.454.CMB.1.raw
tcagtacgagtatgcacgaccggtgctcgatttagcagtactgcgttgggttttggggaggtctcagagaggagccttagccctggactccaaggcctttccacttggtgatcagcactgagcacagaggactcaccatggaattgggctgagctgggttttcctcgttgcttattttagaaggtgtccagtgtgacgtgcagctggtggagtcgtgggggaggcttggtccagccgtgggggtccctgagactctctgtgcaggccctgcattcattctttaatagttattggatgctacgtcgggtcccgccgagggccgtaccggggggaaggggtcccgggaggtcggggtacggaccccaaacgacgttaaacgtcggtacgaaaggtacgttacgggaaaccgttaggaaacggtaaagtaaccttaagtcgggttaagggtaccttcgttagggtaacgggaacgggggtccccgtaagtttacccgaaccctaacgttaccctaccccgaaaggtaaccggaaacctaaaacccgtaacgtaaaacggtaaacctttaacgttaggttaacttcgtacgtaaccaaacgttacgaaaccaccggtaccctaccgaaggaaccgacccggaaggaacccgaccgggtaccgttaggttacggttaaactttaccgaggttacggaccggaaaggtcgacggtacggttcgggaccgttcgggggaacctagggtaccgggg

SEQ ID NO: 220818 - DNA, 582 bp, Homo sapiens
  misc_feature: GYAE6OF01E4OSW.18.87.H10.1.454.CMB.1.raw
  modified_base (268)..(268): a, c, t, g, unknown or other
  misc_feature (268)..(268): n is a, c, g, or t
  modified_base (345)..(345): a, c, t, g, unknown or other
  misc_feature (345)..(345): n is a, c, g, or t
  modified_base (471)..(471): a, c, t, g, unknown or other
  misc_feature (471)..(471): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttacngtatctgcaaatgaacagcctcagagccgaggacacggctgtgtattactgtgcgaagagcaggtggctggggaacngtgggacgtcgtggggccaaggggacccacgggtccaccggttctcctacacgccctccgacccgaaagggccccaagtcccggtccctttccccccgtggccgtcccctcgcctccgacgggacnccaccctccgagacgcacgacggccggcccgtgggcctgcccgtggtccaacggtacctaccgttcccattacctacgtctgacggtcgggcgtggacacgggcgcgtacg

SEQ ID NO: 220819 - DNA, 593 bp, Homo sapiens
  misc_feature: GYAE6OF01AXVMS.18.87.H10.1.454.CMB.1.raw
  modified_base (549)..(549): a, c, t, g, unknown or other
  misc_feature (549)..(549): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcacgtgggtccgccaggcgtccgggggaaggggccggaggtcgggtggccaaacgataatgacaagatggaaactgaagaagactagtgtggactcgtgtaggaagggccattccaccatcctccaagacgacaaactactaagtaacttactgtaatctagactaaagtcgaaaccagccctagaacgacggcccgtaaggaccacgggtcttgggtattacgttaccgtggttacggaccggtaaaaggngccgaaagggttcggaccggttgggggaaacctgggttacgggg

SEQ ID NO: 220820 - DNA, 764 bp, Homo sapiens
  misc_feature: GYAE6OF01BRWOH.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagcttgggttttcctcgttgctattttagaaggtgtccagtgtgacgtgcagctggtggagtcgtgggggagcgttggtccagccgtggggggtccctgacgtactctcctgtgcgacggccctgctattctattctttaatagttatggatcgctacggtcgggtcccgccgagggccggtaccggggggaacggggtccggagggtcggggtcggacccgaaacgtaagtaacgtcggaaccgaaaggtaacgtacgggtaaaccgtagggaaacggtaaaacgttaaacgttagttacgggtacgggtaaaccttccgggttagggttaacgggaaaccgggggtcccgttaacgtttaccccaacccgttaacttcccgtaaccccgtaaaggaaccgaaaacctaaaccgtaaaccgttaaacgttaaacctttacgtattaacttacgtaacgaactaaagtcgaaacgttaccgcccgttaagaaggacccggaccggaagggaaccctcgggtccttagggttaacgttacgttaccggttaggtacggaaccggaaggacggtaccggtagggttcgggacgttacggggaacctgggtaccggg

SEQ ID NO: 220821 - DNA, 536 bp, Homo sapiens
  misc_feature: GYAE6OF01A1AYU.18.87.H10.1.454.CMB.1.raw
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctgggtggagtcgtggggggaggcttggtccaggccgtggggggtccctggagactctcctgtgcaggccctgcattcattcttttaatagttattggatgcacgtgggtccgccgaggcgtccgggggaaggggccggaggtgggtggaccaacataatgacaagataggaactgaagaagaactagtgtagactcgtggtgaacgggccattccaccatcctaccagacgacaacactaagacttangtatcagacaatgaacagcctanacgacgccgaggacacggtntgtagtattcgngagcgaagngnaggtgngtggactgtcggg

SEQ ID NO: 220822 - DNA, 590 bp, Homo sapiens
  misc_feature: GYAE6OF01AVLY0.18.87.H10.1.454.CMB.1.raw
  modified_base (478)..(478): a, c, t, g, unknown or other
  misc_feature (478)..(478): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcgttggtccagcccgtgggggggtcccctggagactctcctgtgcaggcctgcattcattctttaatagttattggatgcacgtggtccgcgaggcgtccggggaagggccggaggtgggtgccaacataatgacaagatggaactgaagaagaactagtgtggactcgtgtaggaacggggccattccaacctatcctccaagacgaaccaacactaaagaccttacgtgtaactctagactaaagtcgaaacncggaccctgaacggacggcccggaagggacccacgggtcttacggtagttaaccgttacgtgggtacgacggaagacgcgtaagggtcggacgtggggaacctggtaccggg

SEQ ID NO: 220823 - DNA, 915 bp, Homo sapiens
  misc_feature: GYAE6OF01EKD5M.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagagactcaccatggaattggggctgagtcgttgggttttcctcgttgtcttattttagaaggttgtccaggtgtgacgtgcagcgtgggtggagtcggtgggggaggtcttggtccaggtccggtcggggggtccctggacgaccttctcctggtcgcgacggccctgctattcattactttaattagttattggatgctacggtcgggtcccgccgaggggtccggtaccggggggaacggggccgggtaggtcgggggtacggaccctaaaagtagttaaactcggaactaaaggtacggtacgggtaaaccgtagggaaaggaaaacggttaaaccttaaggttcggggttaaccgggaaccttttcgggtagggttaacggggaaaccggggtacccggttaactttacccggaaccccttagttacccccttacgaaacggaaaccgaaaccgtaaaacctaaaccggtttaaaacgttaaacccgttttacttacgggtttaacctttacgttaaccggaaaacttaaaacgtccggaaaacctacccggtacccgtaaccggaaaacggggttaaccccgggaccccggggtaaaaccggggtacccggtaaacccgggggtttaccttttacgggggtttaaacttttaaacccggttttacccggtttagggggtaaccggttaacccgggaaaaggggtacccggttaacgtaaccggggggttccgggtaccgggttaaccggggggtaaacccttagggggttaaaccccgggggggg

SEQ ID NO: 220824 - DNA, 672 bp, Homo sapiens
  misc_feature: GYAE6OF01BWY5I.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcgttggtccaggccgtggggggtccctggagactctcctgtgcaggccctgctattcattactttaatagttattggatgcacgtgggtccgccgaggccgtaccgggggaaggggccggaggtggggtcggaccaacagtaatggacaaaggagtagggaaactggaaggtaaagaactagtggtaggaacttcgtagtaggaaggggtccattccaacctatcctaccgaagaacgaacaaaccgtaactaaagaacctttacgtagtactcgtagaactaaagtcgaaacacgaccctagaacggaccggaccggaaacgggacccgaaccgggttcgttaggttaacgggtttaacttttaaccggttgggtacgggtaacccggaaaggtaccggaccggtaagggttcgggaccgttagggggaacctggggttaaccggggg

SEQ ID NO: 220825 - DNA, 658 bp, Homo sapiens
  misc_feature: GYAE6OF01A80E0.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttattttagaggtgtccagtgtgacgtgcagctggtggagtcgtgggggagcgttggtccagccgtggggggtccctgagactctcctgtgcacggccctgcattcattctttaatagtttattggatgcacgtgggtcccgccgaggccgtaccgggggaaggggccggaggtcggggtcggacccaaacgagtaactgacgaagagtaggaacgtaggaagaaagtaacgtagtggtggactcgtaggtacggaacggggtcctattccgaaccgtattcccgtaccgaaggaacaaccaaacaacgttaaacgtaacctttacgtacgttaatacgttagaacctaaagttcgaaacctacgggaccctacggaaggaccggaccggaaggaaccgaccgggtcttaggtagttaacgtttacggtggtacggaacggaaagcggcgtaaggtcgggaccgttaggggaacctagggtaccggg

SEQ ID NO: 220826 - DNA, 666 bp, Homo sapiens
  misc_feature: GYAE6OF01B7SN9.18.87.H10.1.454.CMB.1.raw
  modified_base (547)..(547): a, c, t, g, unknown or other
  misc_feature (547)..(547): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgttgggttttcctcgttgcttattttagaaggtgtccagtgtgacgtgcagcgtggtggagtcgtgggggagtcgttggtccaggccgtggggggtccctgagactctcctgtgcacggccctgcattctattctttaatagtttattggatgctacggtcgggtcccgccgagggccggtaccggggggaaggggccgggaggtcggggtcggacccaagataagtcgacaagagtaggaacgtgaagaagaactagtggtaggtactcgtaggtaggaacggggtcctaactttaccgaacctacttacccgtaccgaaggaacgaaacccaaactaacgttaaaacgtaacctttacgtagttactcgtagaacctaaagtacgaaaccncggtaccctagaacggaccgaccggacggaaccgtaccgggtcttaggtacgtttaacgtttacggtagtacggaacgaagtcgacggtaggtcgggacgtaggggactagggtacggg

SEQ ID NO: 220827 - DNA, 612 bp, Homo sapiens
  misc_feature: GYAE6OF01A3HFJ.18.87.H10.1.454.CMB.1.raw
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggcgattcaccatctccagagacaacactaaagaacttactgtatctgactaaatgaacagcctcgagagccgaggacacggctgtgttattacgtgtgacgaagagcaggtggcgtaggggacagtcgggacgttcggtggggacccgaaagggacccgacggtccaaccgtctccacgacgccctccgaaccgaacggccctacgtccggtccttccccgnggtcccgccctcgcctccgacggacnccaccgtcgacgacgccaacgacggccgccgtggccgtcgcccgtcggtaccgaacggtaccttaccgtacccgtacgttactaccgtacgtacggacggtccggtacgtagggaccgaacgggccgtacgtaacgg

SEQ ID NO: 220828 - DNA, 706 bp, Homo sapiens
  misc_feature: GYAE6OF01CDY8Z.18.87.H10.1.454.CMB.1.raw
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (609)..(609): a, c, t, g, unknown or other
  misc_feature (609)..(609): n is a, c, g, or t
  modified_base (687)..(687): a, c, t, g, unknown or other
  misc_feature (687)..(687): n is a, c, g, or t
  modified_base (696)..(696): a, c, t, g, unknown or other
  misc_feature (696)..(696): n is a, c, g, or t
tcagtacgagtatgcacgaccggtgctcgatttagcagtactgcgtggagtcgtgggggaggcttggtccagccgtggggggtccctgagactctcctgtgcaggccctgcattcattcttttaatagttattggatgctacgtgggtccgccgacgggccggtaccgggggggaagggggcccgggagggtgggggtacggaccaaaacgtaataaacgtggacaaaggtagtagggaactaggaaagaaaagtaacttagtggtaggtactcgtaggtacggaacggggtcctaattccaacctactactaccgaagaacgaactaaacaacgttaaagtaacctttagtgtactctagaacaaatcgaaacncgtcctagacggacgaccgagtacgcggtntagtagttattcgaggtcgaacggagaacgcgtagggtcggacggtacgggattaggcgggtacgttagggaccggggaactaacggggacctcggtacctacccgtctccgacaccgacccaccgaaccgaccggtcctacgttccgtacccgtcccgtgccctcgtcgtcccgtacgacgcactacccgcgaacgaccgacncggaccggtcccggcgtcggctccggtcgtaccggaaccgaaccgtaccgttaaccctccctaagttccgtcgtacgngcggacggnaccgagcgac

SEQ ID NO: 220829 - DNA, 646 bp, Homo sapiens
  misc_feature: GYAE6OF01ARTJY.18.87.H10.1.454.CMB.1.raw
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (514)..(514): a, c, t, g, unknown or other
  misc_feature (514)..(514): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcgttggtccagccgtggggggtccctgagactctcctgtgcaggccctgcattcattctttaatagttattggatgcacgtggtccgcaggcgtccgggggaagggccgaggtgggtgccaanatangcaagatggaactgaagaagaactagtgtggactcgtggtacggaaggggtccctaagtttccaaccgtattccctacccgaaagggtaacgaaaccctaaaaccaaccgttaaaaggaaacccttttacgtagtacttacgtagaacctaaaagtccgaaacncggtaccctagaacggacgtcccggaaggaccgacggtcttagggttacgttaagtttaccgaggtacgggaccgtaaaaggcggtacgtaacggggttcggaccggtaaggggaaccttagggtaccgggg

SEQ ID NO: 220830 - DNA, 815 bp, Homo sapiens
  misc_feature: GYAE6OF01CTUKV.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccagccgtggggggtccctgacgctctctgtgcaggcctgcattcatctttaatagttattggatgctacgtgggtcccgccgagggtccgtaccggggggaaggggccgggaagggtggggtacgggacccctaaacaacgttaatcggactaaaacggagttaggggaaaccgtaggaaaggaaaacggtaaaccgttaagtagggttacgggtaaccgttcgttagggtacgggtaaacgggggaccccggttaagtttaccccgaaaccgtacgttacccgtaccccgaaagggaaacggtaaaccctaaaccgtaacctaaaaaccggttaaaccttttaaccgttaggtttaaccgtttaacccgtaacgggtaaccctaaaagttaccggaaaaccgtaaccggtacccctaaccggtaacggaaccgggtcccgggtaaacgggtacccgaaccggggttccgtacgggttagtttaaaccgtttacgggttaggttaacggggtacggaaaacgggcggtaccggtaaaggggttcggggtaaccgggttacggggtaacgtgggttaacccgggggg

SEQ ID NO: 220831 - DNA, 684 bp, Homo sapiens
  misc_feature: GYAE6OF01AHT6Y.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttatttagaaggtgtccagtgtgacgtgcagctgggtggagtcgtgggggagcttggccaggccgtggggggtccctggacgactcctccgtgtcgcgacggcccctgctattcgtacttacttttaagtagtttattcgggattcgccgtacggttcgggtcccgacccgtaggggtcccggtacccggggggaacggggtcccgggtagggtcggggtcgggaaccccaaagtagtaacgtcggaacgaagtacgtaggaacgtggaaacgaaacggtacttaaggtggtacgtaccgtggtaggtaacgggaacgggtccctattacccgaacctacgtccgtacgaggaacaaccaacgtactaaacgtactttacagttactctaagaacctaaagtcaacgactctacgagacgtaccgagaccgtacgtcgttgtaagttacgttacctagggacggtacgaagggactcggtacgggacgtacggtacggaagtcgggtacgggg

SEQ ID NO: 220832 - DNA, 661 bp, Homo sapiens
  misc_feature: GYAE6OF01AKUPW.18.87.H10.1.454.CMB.1.raw
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (270)..(270): a, c, t, g, unknown or other
  misc_feature (270)..(270): n is a, c, g, or t
  modified_base (386)..(386): a, c, t, g, unknown or other
  misc_feature (386)..(386): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccagtggaattggggctgagtcgtggttcgcgtagctattagagtntcngtgtgagngatgcgtggtgctggtgggagtcgttggcnggccgttgggggacctggcgtacctctccgtggcaactccgggtccctnactattactattacgtttagtacgttgtaggtactcggacggtaccggtcgggaccgtccggtcgggtaccgggacggggacgggtcggtaggtcggtacgaactagtaataacgngaagtagacgtagactagaacgtagtacgtagtacgtacgtagtagtacgggtacggtacggacgtaacgtaaccgactaactacgacgaacgacgaactaaagtaactaacgtaacttacgtacgtacgtacgaactaacgaactacgaacgtacgtaccgtaacgacggtacgacggaccgtacgtacggacgttagtacgttacggttccgtaaggtacggtacgaacgtgtacggtacggtacggtacggtaacggtacggtacggtacgg

SEQ ID NO: 220833 - DNA, 822 bp, Homo sapiens
  misc_feature: GYAE6OF01AEEFU.18.87.H10.1.454.CMB.1.raw
tcagtacgagtatgcacgaccggtgctcgatttagcagtactgcggttgggtttggggaggtctcagagaggagcccttagccctggactccaaggtcctttccacttgtgatcagcactgagcacagagactcaccatggaagttggggctgagtccgttcggttttcctcgttgcttagtttagaaggtcgtccagtgtgacgtgccagcgtggtggagttcggtggggagtcgttcggccgacggtccggtcggggggtccctggacgtaccttcgtccgtgtcgaccgccggccctagctacttactaactttactttaagtgttagtcggtacttcgaccgtaccggttcggcccgacggacggtccgggtacgggggacggtccggtaggtcgggacgaccaatagtacgtgaacgtaaggtacgtaggaactaggaaacgtaacgtaagttaggtcggtacggtacgttcggtagggtaacggtaccgggtccttaaccgtaccaacccggtacttaccccggaacgtaaacggtaaaccaaaacccgtaaaccgttaaaccccggtttaaattaaaccccgtttacgtacggttaaccttaacggaacgtaaaccgtaaacggtaccgaaccccgtaccggtaacccgtaaccggaaacgggtacccggaaacgggtacccggtaacggtacggttaccgtttaggttaaacccgttacgtttaaccggacggaacggaaacgggtacgggtaagtcggggtaacgggtttcggggaaccgggttacggtaacggtacgggggttaccccgggg

SEQ ID NO: 220834 - DNA, 792 bp, Homo sapiens
  misc_feature: GYAE6OF01ALZL0.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggttttcctcgttgcttattttagaaggtgtccagtgtgacgtgcagctgggtggaggtcgtgggggagtcgttggtccaggccggtggggggtccctgacgtctcctcctggtcgcgacggtccctgctattcatttactttaaagtgtttagtggatcgccgtacggttccgggtcccgcgacggggtccggtaccggggggaacgggccgggtagggtcggggtacggaaccctaaatagtaaagtcggaacgtaaaggtacgtaacgggtaaaccgtagggaaacgtaaacgttaacgttaaggttaggtaccgggtaaccttcgggttaagggtaacggggtaaccgggtacccggttacttacccaacccgttagttccccgtaaacccgaaagggtaaccaaaccctaaacgtaaaccgttaaaactttaaccgtttaaccgtagtttaaccgtacgtaacgtaaaccgtaaagtccgtaaaacccgcgtaacccttaggaaacgggtacgaacccgggaggtaccgaccggttcggttagttaacgttagttcggtcgggtaagaaccggtaaggacgtccgggtagggttaccggtagggtacggaagtacgggggttaccggg

SEQ ID NO: 220835 - DNA, 707 bp, Homo sapiens
  misc_feature: GYAE6OF01A8B6A.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgcttattttagaaggtgtccagtgtgacgtgcagctggtggagtcgtgggggaggcgttggtccaggccgtggggggtccctggagactctcctgtgcaggccctgctaattcattactttaatagttattggatgcacgtcgggtcccgcgaggccggtccgggggaacggggccgggagggtgggtcggaccaactagtaatgacaaggtataggaactgaagaagaactagtgtacggtactcgtagtacgggaacgggtcccgtaatttacccgaaccgtaacttcccgtacccaaggtaacgaaccctaaactaacgttaaaaggaacccttttacgtacggttacttaccgtagtaacctaaaacgttcgaaaaccgccggtacccctaaggaacggaaccgggtaccccgggaaacggaacccgtacgggtccttttaagggtaaccgtttaacgttaccgtaggtacgggtaacgaaaggtccggtgtaaacgggtcggtaccggtaacggggactaggggtacccggg

SEQ ID NO: 220836 - DNA, 941 bp, Homo sapiens
  misc_feature: GYAE6OF01BBTU2.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggttttcctcgttgcttattttagaggtgtcagtgtgacgtgcagctggtggagtcggtgggggaggcgtttcggtccgtacggtccggttcgggggggtccctggtacgaccgttcctccgtggtgccgacggtccccttgacctagttctaatttacttttaagttaacgtttagttaggtatcgtacgtacgttcggggtcccgccgacgggccggttaccggggggaaggggtccgggtaagggttcgggggtaccgaacccgtaaacgtaacttaacgtacggaacgtaaacggtaagtaacgggtaaacctgggtaaacggtaaaacgtaaaccgttagttacgggtacgggtaacccgttacggttaacgggtaagggtaaaccgggggtacccttaacgtttacccgaaacccgttacgttacccgttaaccgaaaacggaaccgtaaaaaccctaaaaacccgttaaaccgtttaaaaacgggttaaaccccttttaacgttaccggtttaaattacccgtaacggtaaaacctaaaacggttaacccggaaaacctaccggtaaccgtaccgggttaaacggacccgggaacccgggtaacgggaaccccgggtaacccggggtttaccgtttagggttaaaccgttttaacggtttaaaccggttagggttaaacggttaaccggggaaaacggtacggtaacccggggttaagggttacccgggggtaggtttaaaaccggggggaaacttgggggttaaaaccccgggg

SEQ ID NO: 220837 - DNA, 696 bp, Homo sapiens
  misc_feature: GYAE6OF01A8WZF.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccagccgtgggggtccctgacgactctcctgtgcacggccctgcattcatctttaattagttattggatgctacgtgggtcccgccgacgggtccggtaccgggggaacgggggccgggagggtcggggtacggacccgtaaacaagtaatggaccgaaagaacgtacgggaactaggaaggaaagaactagtggtacggacttcgtaggtagggaacgggtcccgtaattaccgaacctagtacctacccgaaaggaccgaaacgtaaacctaacgttaaaacggtaaacctttacccgttaggttaacctacgttacgaactaaaagtcgaaactaccggccttaacgacggaacgaccgggaacgaaccgtccgggtaccttaggttaacgttaacgtttcggtggtacggtcggaaaggacggtacgtacggtagggaccgttggggtaacgtaggtaccgggg

SEQ ID NO: 220838 - DNA, 932 bp, Homo sapiens
  misc_feature: GYAE6OF01DL7M9.18.87.H10.1.454.CMB.1.raw
  modified_base (194)..(194): a, c, t, g, unknown or other
  misc_feature (194)..(194): n is a, c, g, or t
tcagtacgagtatgcacgaccggtgctcgatttagcagtactgcgttgggtttgggggaggcttggtccagcctggggggtccctgagactctcctgtgcaggccctgcattcattctttaatagttattggatgcacgtgggtcccgccgaggccgtaccgggggaaggggccggaggtggggtgacccaaanataatgacaagataggaactgaagaaacgaacttatggtaggacttcgtggtaggaacgggcctattaccaacctattccaccgaagaacgaaccaaacgaactaaaagtaacctttactgtaacttccgtagaactaaaagtcgaaaccacgcccctagaaggaccggacccggtaaaggaccgacgggttcttaggttacgtttaacttaccgtaggtacggaaacggaaaaggcggtacgtaaggggttcgggtacggtaacgggggaacttaggtacgggggtaacccgtttcggggaacgggggaaaccccaaacgggggtacccctacgggttacccacccggttctaccccgtccgaaccgtccccgtacccgaacccggaaaccgggtcccctaaccggttccccgggtttacccccgtttccccccggtcgggtcccccgtccccgttaccgggccccttaacccgggaaccggtaccgtacccccgtaaccccgttaccgggaaacggacccggacccaaccgggacccggccccggggttccccggtaccggggtcccgttacccgggacccgtttaaccgggtaaaccgtaaaaacccggttacccctttaaccccgtttaaaccccgtaacgtttaaccccgttaccggttaacggttaccggggaaccgggtcccggggtaccggttaccgggaaccggaaccggggtcccgtaaacgtaacgg

SEQ ID NO: 220839 - DNA, 639 bp, Homo sapiens
  misc_feature: GYAE6OF01D74F1.18.87.H10.1.454.CMB.1.raw
  modified_base (513)..(513): a, c, t, g, unknown or other
  misc_feature (513)..(513): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
  modified_base (602)..(602): a, c, t, g, unknown or other
  misc_feature (602)..(602): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgctattttagaaggtgtccagtgtgacgtgcagctgggtggagtcgtgggggaggcttggtccagccgtggggggtccctgacgctctcctgtgcaggccctgcattctattcttttaattagtttattggtatcgctaccgtcggggtcccgccgacgggccggtaccggggggaacgggggccgggtagggtcggggtacgggacccaaacgtaataacgtaggacaaaggtagtagggaactggaaagaaacgtaaactagtggtaggtactcgtggtaggaacggggcctacttccaacctatccaccgaagacaacaaactactaaagtacttacgtntactctagactaaancgaaaccnaccctagaggaccgaccggaggaaccgtcggacttggtagttaagttcgtggtacggacggaaagngacgtagggtacggacgttgggaacgtagggtacggg

SEQ ID NO: 220840 - DNA, 860 bp, Homo sapiens
  misc_feature: GYAE6OF01BC1KR.18.87.H10.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
tcagtacgagtatgcacgaccggtgctcgatttagcagtactgcgtggagtctgggggaggcttggtccagcctggggggtccctgagactctcctgtgcaggccctgcattcattctttaatagttattggatgcacgtgggtccgccaggcgtccgggggaaggggccggaggtgggtgaccaacataatgacaagatggaactgagaagaactagtgtagactcgtgtaggaacgggcctaattccaccactcctccaagacgacaacaactaagtaacttactgtaatctagaccaaatcgaaacngccctagagacgccggagacgacggtctggtatacttacgngtacgacgaagagcgtaggtcggcgtaggggactagtcgggaccgttacggtcggggaaccctaagggggtaccccgtaacgggttccctaaacccggtttccccgtcccttaaccggtaccgacccccgttaaccccggaaaccccggtaacccggggtacccccttaaacccggttccccgggtttaccccgtttacccccccggtaccggggtccccgtcccccgttaccggtccccgttaccccggtaacgggtaacccgaacccccgtaaccccggtaaccggaccggtaaccggaccgtaacccggtaaccgggtacccgggtccccggtacgggggtaccccgttcggtaccccggtttacgggtaaacccgtaaacccgggttaaaccccgttaccccgtttaacccccgttaaacgttcccggtttaccccggtaaacggttccgggaaaccggggtccccggggtaacgtcccggggtaagggtaaacggtaccccggg

SEQ ID NO: 220841 - DNA, 624 bp, Homo sapiens
  misc_feature: GYAE6OF01BCGPE.18.87.H10.1.454.CMB.1.raw
  modified_base (618)..(618): a, c, t, g, unknown or other
  misc_feature (618)..(618): n is a, c, g, or t
tcagtacgagtatgcacgaccggtgctcgatttagcagtactgcgtgggtttgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccgattcaccatctccagagacaacactaaagaacttactgtatctgacaaatgaacagcctcagacgccgaggacacggctgtgtattactgtgacgaagagcagtggcgtaggggacagtggacgtcgtcggggaccgaacgggacctacgggtccacccggttcctcccgtcgacgtccctacccgaaccgaaccgggcccctacgttcccggttccccttcccccgtcggcccgtccccgtcgccctaccgacggaccgtccacccgtccgacgacgccacgacggaccggtcccgtcgggctcggccgtacggtcaacggtaccttacccgttcccgacttaccgtcgtacgtcggacggccgggtacgtcgggaccgacggccgngtaacg

SEQ ID NO: 220842 - DNA, 593 bp, Homo sapiens
  misc_feature: GYAE6OF01COGCE.18.87.H10.1.454.CMB.1.raw
  modified_base (309)..(309): a, c, t, g, unknown or other
  misc_feature (309)..(309): n is a, c, g, or t
  modified_base (548)..(548): a, c, t, g, unknown or other
  misc_feature (548)..(548): n is a, c, g, or t
  modified_base (562)..(562): a, c, t, g, unknown or other
  misc_feature (562)..(562): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcacgtgggtccnccgaggccgtccgggggaagggccggagtcggggtgccaaacataatgacaagatggaactgaagaagaactatgtaggacttacgtgtaggaacggggcccaatttccaacctatcctaccaagaacgaaacaaacaactaaagaacctttactagtaacttccagaacctaaagttcgaaactacgccctagaagacgacccgagggaccaacgggtctagttgtaacgtttaacgngtacggacgaaagngacgtaggtcggcgtaagggactggtacggg

SEQ ID NO: 220843 - DNA, 737 bp, Homo sapiens
  misc_feature: GYAE6OF01CE9P8.18.87.H10.1.454.CMB.1.raw
  modified_base (603)..(603): a, c, t, g, unknown or other
  misc_feature (603)..(603): n is a, c, g, or t
  modified_base (624)..(624): a, c, t, g, unknown or other
  misc_feature (624)..(624): n is a, c, g, or t
  modified_base (682)..(682): a, c, t, g, unknown or other
  misc_feature (682)..(682): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagcgttgggttttcctcgttgcttattttaggaaggtgtccagtgtgacgtgcagcgtggtggagtcggtgggggaggtcgttggtccgaggtcccgggttcgggggggtcccctggacgtaccttccgtccgtggtcgccgacggtcccctgctactttactatttacttttaaagttagtttagttggtatcgacgtacggttcgggtcccgaccggtacgggcccgggtaccggggggaacgggggccggtagggtcggggtacgaaccgtaaactaagtaagtgaacgtaaaggtacgtacgggaaacgtaggaaagaaacgtaacgtagttacggtagtacgttcgtagggtacggaacgggtcctaacttaccaacccgtattccccgaaacgaaacgaaccgaaacctaaacgtaacgttaaaacgtacgtttcgtataccgtntaacgaaaactatacgaaccncgtcccaaggaacgcccggacggaacgcgtacggtgttacgtaagttacgttaccggnggacggaaaccgaagtcgtcgggtaagggcgggtagcgggtaatcgggtacgggg

SEQ ID NO: 220844 - DNA, 747 bp, Homo sapiens
  misc_feature: GYAE6OF01BLXY1.18.87.H10.1.454.CMB.1.raw
  modified_base (580)..(580): a, c, t, g, unknown or other
  misc_feature (580)..(580): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcggtgggggggcttggtcgacgccggtcggggtccggtcgagactctcctgtgcgacggccgtcgtcacttctattactttaattagtttagttggtatcgtcgacgtcgggtccggccgacgggcggtccggggaacgggggaccgggaggtggggtcggaccgaaccgtaagtaagtacgacgaaagagtacgggaacgtacggaaaggaaacggtaaacgttagttagggtacggtaacgttccgtagggtagggtaaccggggacccgttaactttacccgaaccctacgttaccctacccggaaggaaacgtaacccaaaccgtaaaccgttaaacgttaaattttacccgtagtacttacgngaaacctaaagtacgaaccagtcccctaagacggtaacggccgggaacggacgtaaccggtgtttacggttagttaaccctttacggtgggtacgggaacggtaaacggagtcccggtaaggttcgggaccggtaaggggacctaagggttcgggtaaaccccgggg

SEQ ID NO: 220845 - DNA, 639 bp, Homo sapiens
  misc_feature: GYAE6OF01DBBAN.18.87.H10.1.454.CMB.1.raw
  modified_base (370)..(370): a, c, t, g, unknown or other
  misc_feature (370)..(370): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgcttattttagaaggtgtcagtgtgacgtgcagctgggtggagtcgtgggggagcgttaggtccaggcccggtggggggtccctggacgtactctcctgtgcgacggccctgctattcattctttaaatagtttattggatgcacgtcgggtccgccgacggcggtaccgggggacggggccgaggtgggtgacccaaanataagtgacaagatagggaactgaagaaagaactaagtggtaggactcgtggtaggaacgggcctaagttccaacctactcctaacccgagaacgtaaaccaaactaacgtaaattaaacccgtttatacgtaacttctagaacctaaagtacgaaacgccgacctcgaagacggaccgaggaccacgggtccgttagttacgttagtttacgtgggtacggacgtaaaggcgtacgtaggcgggtaggtacggacgtaggtaccgggg

SEQ ID NO: 220846 - DNA, 760 bp, Homo sapiens
  misc_feature: GYAE6OF01DQTBE.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaagttggggctgagcgttgggtttttcctcgtttgcttatttttaaggaaggtgtccgagtgtgacgtgcagcgtggtggagtcgtgggggacgtcgttggtcccaggcccggtcggggggtcccctgacgtaccttcctcctggtgccgacggcccctgctagtttcaatttacttttaaagttacgtttagtttcgggattcggcctacggtcggggtccccgaccgacgggtccgggtaccggggggaacgggggcccgggtaggttcgggggcgaacccaaacgtagtaaagtgacaagacgtagaactaggaaagaaacgaacttgtaggtggtacctgtggaggaacgggtctaacttccactaacgtcctaccgaaggtaacgaaaccaacgtaaacgtaaactaactttaacgtcgttaactcgtaaggaaccaaagttccggaaaccacggtcctacgaacggtacgacccgggaaggtaccacgggttcctaggttacgttaacttcggtaggtaccgacggttaaagacggtacggttaacgggcgggtacggtaaccgggaacgttcggtacggggaacccggtttcgggaacccgggggttacccggaaaacccggggg

SEQ ID NO: 220847 - DNA, 651 bp, Homo sapiens
  misc_feature: GYAE6OF01CCB5R.18.87.H10.1.454.CMB.1.raw
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
  modified_base (564)..(564): a, c, t, g, unknown or other
  misc_feature (564)..(564): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtggggggaggtcgttgggtcccgaggcccggttcggggggggtcccctggacggtaccttccgtccgttggtgccgacgggcccctggcctatttcaattacttttaatagtttattggatgctacgtgggtcccgccgacggccggtaccgggggaaggggccggaggtggggtcgaccaanagtaatgacgaagataggaacgtagaagaaagtaacgtaagngtacggacttacgtggtacgtaacggggtcctacgttaccaacctaacgttccgtacccaaggaacgtaaaccaactaaccgttaaacgtaactttacgtattagtactagaactaagtcgaaanacgccctagaacgacggaccgagtacgacgtctgtaattacgtactgtacgcgaagtgcgtagggtggaccgtagggtcaggtcggg

SEQ ID NO: 220848 - DNA, 782 bp, Homo sapiens
  misc_feature: GYAE6OF01D5LIG.18.87.H10.1.454.CMB.1.raw
  modified_base (576)..(576): a, c, t, g, unknown or other
  misc_feature (576)..(576): n is a, c, g, or t
tcagtacgagtatgcacgaccggtgctcgatttagcagtactgcgttgggtttgggggaggcttggtccagcctgggggtccctgagactctcctgtgcagccctgcattcattctttaatagttattggatgctacgtgggtcccgccgaggcgtcccgggggaaggggccggaggtgggtcggccaaacagtaatgacaagatggaactgaagaagaacttagtgtggactccgtggtaggaacgggcccgtaatttaccaaccgtattcctacccgaaggaacaaccaaactaaacttaaagtaaaccttttaactcggttaactcctagaacctaaaaattcgaaaactacggaccccttacaaggtaaccggcccgggaaaggaacccgacggggtcctttaggttcggttaactttaccggtggttacgaacggaaagacggtcaagggttggccgtaggaacagtggtaaccgtcggtacggggaccaagggtaccccaggtcccaccggtcctaccgtcgacgtcctccgaaccgtaccgggcctacgttccggtcccccttccccgnggtacccctcccgtcgcccgtacgacgggcctccgaccgtacccggagtacgccgaaccggaccgtcccgggtacccgttggggaccctcggtaccgtcggtaaccctaaacgggtcccttaacccttcccgaaacgtttaccgtaccggtttaaaccctgggccgggtaccgggaccgttcgggaactaaaccggcgtcgtaaag

SEQ ID NO: 220849 - DNA, 930 bp, Homo sapiens
  misc_feature: GYAE6OF01DEFGI.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctggagtcgttcgggttttcctcgttgtcttattttagaaggtgtccagttgtgacgtgcagcgtgggtggaggtcggtgggggaggtcgttggtccaggtccggtggggggtccctgacgtactctcgtgtgccacggccctgactattcctagtttactttaattacgttagttaggagttcgcctacggtcgggtcccggtaccggacgggtccgggtacccgggggggtaacggggccgggtaacgggttcggggtaccggaaccctaaacgtaagttaaacgtggtaaccaaaagggtacgttaacggaacgtaggtaaacggtaaacgtaaacgttaggtaggttacggtaaccttcgggttacgggtaagggaccgggggtacccttaacgttacccgtaaccgtaacgttaccccgtaacccggaaacggaaaccgtaaaaacccgtaaacctaaaaaccccgttaaaacggtttaaacccttaaaccgtttaacgttaacccggtttaaccgtaacgtaaaacccgttaaaaacggtaaccgttaaaacccggaacccggtaaccccggttaagaaccccggggtaaacggacccccgggaaacgggtacccggtaaacccgggttccggttttaacgggttaaaccttaaccgggttttacggtaaccgggtacggggtaaaacgggtaaaacgggtcggttaaacccgggttaaggggtaccccgggttagggtaaccggggaaacggtttccggggtaaaacccgggggg

SEQ ID NO: 220850 - DNA, 700 bp, Homo sapiens
  misc_feature: GYAE6OF01DVK3D.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcacggccctgcattctattctttaatagttagttggatgctacgtcgggtcccgccgaggccggtaccgggggaaggggccggaggtcggggtacggacccaaacataagtgacgaagagtaggaacgtaggaaagaaacgtaacgtagtggtaggtaccttacgtgggtaacggaacggggtacccgtaattcccgaacctattacccgtacccgaaagtaaacgaaacctaaaccaacgttaaaacggtaacctttacgtagttactctacgaactaaagtacgaacacgtaccctacgaacggtaacggcccggaacggtaaccgaccggtacgttacggttacgttaacgttaccggttagggtacggaacggaaaacggcgtaacccggtaggggttacgggcggttaacggggaacgttagggtaccggggg

SEQ ID NO: 220851 - DNA, 734 bp, Homo sapiens
  misc_feature: GYAE6OF01C2D3S.18.87.H10.1.454.CMB.1.raw
  modified_base (711)..(711): a, c, t, g, unknown or other
  misc_feature (711)..(711): n is a, c, g, or t
tcagtacgagtatgcacgaccggtgctcgatttagcagtactgcgttgggtttggggaggtctcagagaggagccttagccctggactccaaggtcctttccacttggtgatcagcactgagcacagaggactcacatggattgggctgagtcgttggtttcctcgttgcttagttttagaaggtgtctagtgtgacgtgcagcgtggtggaggtcggtgggggaggtcgttcggtccgacggtccggttcggggggtccctggacgtcctcgtccgtggtcgcgacggtccctgcctattctaattactttaattagtttagttgagtcgactacggtcggtcccgacgacgggtccgggtaccgggggaagggccggtaggtcggggtacgacccgaaagtaacgtaagtcgacgtaaaggtaacgtaggtaacgtaggaaacggtaaacgtaacgttaagtcggttacggacgttaggtaggtaacgggaccggtacgtacctaccaacctacgtacctaccgaaaggtaaaccaaccgtaaactaacgtaaacggttaacctttagtacttaacgtcgtaactaaacgtaaacgcgtaaacgtaccgaaccgttacggaaccggaccgtaccggaacgacggtcggtactaggtttagttaacgtttcggagttaggaaccgtaagacggacggtacggtacgggtntaacggggatccggggtaacggg

SEQ ID NO: 220852 - DNA, 799 bp, Homo sapiens
  misc_feature: GYAE6OF01E02HG.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcacatggaattggggctgagcttgggtttcctcgttgcttattttagaaggtgtccagtgtgacgtgcaggtctgggtgggagtcggtggggggagtcgttcgggtccaggtcccgggtcgggggggtcccctggaccggtaccttccgtccgtggtacgccgaacggtccccttggctaacttctaactttactttaaagttagttattggattcggctacggtcgggtcccgaccgacgggtccgggtaccggggggaaggggccgggtagggtcggggtacgacccgtaaagtagtaacgtcggaaccgtaaaggtagtacggggtaaactagggaaacgtaaacggtaaccttaggtcggtaggtaccgttacgttagggtaacgggtaaccggggtcccttaagttacccgtaacctaacgtttccctaaccggaaacgtaacggtaacctaaaaacccgtacgttaaaacgttaacctttaacggtaacgttacctacgttaacgaaaccgtaaaagtcgaaaacccgtaccgtaccctagggaacgtaaccggaccgggaactcccgggaagtcggtagttacgttacgttacggtagggtaccaaaggtaacggagtaaccgcgggttagggaccgttaagggcgtaagggtcccgggg

SEQ ID NO: 220853 - DNA, 904 bp, Homo sapiens
  misc_feature: GYAE6OF01BOIXY.18.87.H10.1.454.CMB.1.raw
  modified_base (198)..(198): a, c, t, g, unknown or other
  misc_feature (198)..(198): n is a, c, g, or t
tcagtacgagtatgcacgaccggtgctcgatttagcagtactgcgttgggtttgggggaggcttggtccagcctggggggtccctgagactctcctgtgcaggccctgcattcattcttttaatagttattggatgcactgggtccgccaggcgtccgggggaagggccggagtgggtgaccaacataatgacaaagntaggaactgaagaagaacttatggtaggacttcgtggtaggaacgggcccgtaattccaccatcctaccgaaggaacgtaaccaaactaacgtaaaagtaaccttactagtaactcgtagaactaaaagtcgaaacagtccctagaaggaccggaccgggaacggtaaccgacgggttacgttggttaggttaacttttaccggtgggttacgaaccgggaaaaggtcggacggttaagggtcggggtacccgtaggggggtaaaccctagggtttaaccgggggaccggtttaccgggggaaccggggggtaaaccccccggaaaacggggggtaccccctaacggggtacccgaccccgggtttaccctccccggttaacggacccgtaccccgtaccccgaaacccggtaacccgggaccccttaccggttccgggttaccccccgttccccgtacgggtcccctccccggttacgacccgtacccggtaacgggccgtaccctacccgtaccggaagacgtacccgaccgccggaccgggtcccgtacggggtctccggttacgtaccgggtaaccgacgggttacccctttaaccgttaccccgtaaacgttacccgttacccggttaaacggccgggggtaaaccgggtccgggggtaaccgggttcgggaaaaccgggtacggaccggttaacgacggg

SEQ ID NO: 220854 - DNA, 953 bp, Homo sapiens
  misc_feature: GYAE6OF01E5TO0.18.87.H10.1.454.CMB.1.raw
tcagtacgagtatgcacgaccggtgctcgatttagcagtactgcggttgggtttgggggaggcttggtccaggccgtggggggtccctgagactctcctgtgcaggccctgcattcattacttttaatagtttatggatgcacgtgggtccgccgagggccggtaccggggggaaggggccgggaggtggggtacggacccaaacaataagtgacaaaggagtagggaaacgtaggaaagaaagaacttagtcggtggaccttgtaggtacggaacgggtcctaccttaccccatccgtaccgaagaacgaaccaaacctaaacgtaaacgtaacctttactacgtatctaggaacaaatacgaacacggtacctacggacggaaccggccggaacgggaccggtaccgggttcttaggtttacgttaaagtttaccggtagggtacggtaacggaaggtacgggacggttacgggacggggtcggttaacggggaaccggttaggtaccgggggtacggttaccgggggaaccgggggtaacccggaaacccggggttaccccgtaacccgggtacccttacccgtcccgttacccgtccgaacccgttcccccgaaccccggtaacccgggaaccccggtaccccgtttacccggtcccccgggtttcccccccgtttacccccgggtccggggttccccccgtcccgggttacccgacccggtaacccggaccgggtaccccgacccggtaaccccggtaccgggaacgtaccgaccgacccgggcccgggtcccgggtccggtacgggtcccgttaccggtaccggttacgggtaaccgtaaccggttaccctaaccccgttacccgttaacgttcccggttagtaaccgggccggggtaccggtcggggaccggtaccgggaacgggtaccggacgggataagggtcg

SEQ ID NO: 220855 - DNA, 844 bp, Homo sapiens
  misc_feature: GYAE6OF01BTN7H.18.87.H10.1.454.CMB.1.raw
  modified_base (142)..(142): a, c, t, g, unknown or other
  misc_feature (142)..(142): n is a, c, g, or t
  modified_base (704)..(704): a, c, t, g, unknown or other
  misc_feature (704)..(704): n is a, c, g, or t
  modified_base (749)..(749): a, c, t, g, unknown or other
  misc_feature (749)..(749): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctaagngcgtggttttcctcgttgcttatttagaggtgtccagtgtgacgtgcagcgtgggtggagtcggtgggggacggtcgttcgggtcccgaggtcccggttcggggggtcccctggacgaccttcctccgtgtcgcgacggcccctgctactttctaatttacttttaaagtagtttagttggtaagtcgtcgtaccggttcggggtccccgaccgacgggtccgggtacccgggggggaacgggggcccgggtaaggggttcggggtaccggaaccaaacgtagttaaagtcgacgaaagtagtacggaacgtaggaagaaacgtaacgttagttacggtaggtaccgtttacgtagggtaacgggaaccggggtacccgttaacgtttaccccgaacctactttacccgtaccgaaaacgggaaccgtaaaccgtaaaacccttaaacgtaaaaaaccggttttacccttaacgttggttaaccttcggtaaacaaacttaaacgtccgaaaaccgtcgtacccaaggaacgaccggacccggtaggtaacccgtcgggttntttaacggtgtttaaccgttaggtcgggaccgaaaggtaaccggngggttacggacggtttcggggagggtaaccggaacgtttcggttacccgggggaacccggtttgggaaaccgggggaaacccccgtaacccgggg

SEQ ID NO: 220856 - DNA, 743 bp, Homo sapiens
  misc_feature: GYAE6OF01CN400.18.87.H10.1.454.CMB.1.raw
  modified_base (676)..(676): a, c, t, g, unknown or other
  misc_feature (676)..(676): n is a, c, g, or t
tcagtacgagtatgcacgaccggtgctcgatttagcagtactgcgttgggtttggggaggtctcagagaggagccttagccctggactccaaggccctttccacttggtgatcagcactgagcacagaggactcaccatggaattggggctgagcttgggttttcctgttgcttattttagaaggtgtccagtgtgacgtgcagcgtgggtggagtcggtgggggaggtcgttggtcccgaggtcccggttcgggggggtcccctggacgtaccttccgttccgtggtgccgacggccctgctattctattacttttaagtagtttagttggatcggacctacgtcgggtacccgccggacgggccggtaccggggggaacggggccggggtagggttcggggtacggaccctaaacgtaagtaaacgtcggaacgaaaggtaacgtacgggaaaacgtaggaaacggtaaacgtaaaccgtttaaggtcgggttaacgggtaaccggtttccgttaggggtacgggaaaccgggggtcccttaagtttaccccaacccgttagtttcccgtaacccgaaagaaccgaaaacctaaacctaaccgttaaaacgtaaccttttacgtacgttactacgtagaactaaagtcgaaacacgtccagaggaccgaccggngaaccgcggtctggtacttagttcgtggacgagaagagtcgaggtcggacgtggacctggtaccggg

SEQ ID NO: 220857 - DNA, 868 bp, Homo sapiens
  misc_feature: GYAE6OF01D53BI.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagcttgggttttcctgttgctattatagaaggtgtccagtgtgacgtgcagcgtgggtggagtcggtggggggaggtccgttgggtccacggtcccggttcgggggggtcccctggacgaccttccgtccgtggtcgccgacgggtccctgtctatttctatttacttttaaatagtttattggtactgtacgtacggtcggggtcccgccgacgggtccggtaccggggggaacggggccgggtagggtcggggtacggaccaaacgaagttaacgtggaacgtaaaggtagtaacgggtaaacgtaggaaaacggtaaaggtaaaccgttaggttacgggtacgggtaaccttcggttagggttaacgggggaaccggggtacccttaacgttttaccccgaaaccccgttaacgttacccctaaacccggaaagggtaaaccgaaaacccctaaaaccgtaaaacgtttaaaaaccgttaaaccttttaccgtaggttaaacttccgtaagtaaacctaaaagttacggaaaccaccgttacccgtaaacgacgggtaacccggaccgggaaacggaacccggtccgggttacgttagggtttaaaccggttttaacgtttaacccgggtaggggtacccgggaaaacgggaaacgggtaccggtaacgggtaagggggttaggggaccggttaacgggggaccgtaacgggggg

SEQ ID NO: 220858 - DNA, 717 bp, Homo sapiens
  misc_feature: GYAE6OF01CWP5N.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgctattttagaaggtgtccagtgtgacgtgcagctggtggagtcgtgggggaggcttggtccaggccgtggggggtccctgacgactctcctgtgcacgccctgctattcattactttaatagtttatggatgctacgtgggtcccgcgacgggccggtaccggggggaagggccgggtaggtggggtacgaccaaacagtaatgacgaagagtaggaactaggaagaagaactagtcggtacggactgttaggaggtaacgggtcctaatttcccgaaccgtataccctaccgaagtaaccgaaactaaaccgtaactaaaacgttaacctttacgtacgttaactctaacggtaaacaaagttaccgaaactaccgacccgttacgaaggtaaccggaacccggaggtaaccctaacgggttccttacgggttaagttttaaaccgttccggttagggttaaccgggaaacggttaaacggtacggaccgtttaacggggacgggttaccgggtaacgggggaccgttaacggttaaccgggggg

SEQ ID NO: 220859 - DNA, 846 bp, Homo sapiens
  misc_feature: GYAE6OF01C0VYQ.18.87.H10.1.454.CMB.1.raw
  modified_base (634)..(634): a, c, t, g, unknown or other
  misc_feature (634)..(634): n is a, c, g, or t
  modified_base (809)..(809): a, c, t, g, unknown or other
  misc_feature (809)..(809): n is a, c, g, or t
tcagtacgagtatgcacgaccggtgctcgatttagcagtactgcggttggggtttgggggaggtctcagagaggagccttagccctggactccaaggtcctttaccacttggtgatcagcactgagcacagacggactacaccagtaggtaagttggggctggagtcgtttcggggttttcctcgttgtacttagttttagaaggtgtcgtaggtgtgacgtgcgtagcggttgggtagggtaggttcggggtaggggggtacggttccggttcggggtacccggtacgggtccggggttccggggggggtaccctggtaccgtaccgttccgttccggtacggttccgacccggtaccgggtccccttaggtacctttattaccgtttaagtttacctttttaaggttaacgttttagtacggtagtacgtaccgtaccgggttccggggtccccgaccggtaccggggaccgggtaccgggggggaacggggcgggttagggtcggggtacgtaacccaaggtaacgtaacgtaggaacgtaaaggtagtaaggtaaacggtggaaagaaaacgttaacggtgttaacgggtacgtcgttaggtacggttaaggggaaccggggacctttanaacccgtaccttaaccgttcccaaacgaaggaaaccaaaccgttaaacgaaaccgttaaacgttactaacttcggttaactactaaggaaacccttaagacctaacggctaaccaggaacgccgaacggcgtacggtcgtatacgggttatacggttcgaggcgtaacggaaggngttaacggtggcgggtagttagggaatcgggtacggg

SEQ ID NO: 220860 - DNA, 800 bp, Homo sapiens
  misc_feature: GYAE6OF01B1TFY.18.87.H10.1.454.CMB.1.raw
  modified_base (689)..(689): a, c, t, g, unknown or other
  misc_feature (689)..(689): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccagtggaattggggctgagcttgggttttcctcgttgcttattttagaaggtgtccagtgtgacgtgcagcgtgggtggagtcgtgggggaggtcgttggtccgaggcccggtcgggggggtcccctaggacgtacctcctccgtggtcgccgacggccctgctacttctattactttaatagtttagtggatgcgtacggtcgggtcccgccgacgggtccgggtacccggggggaaggggccgggtagggtcggggtaccggaccaaacgtaagtaacgtcggaacgaaaggtagtaacgggtaaacgtaggaaaggaaacgtaaacgttagtagggtacggtacgttacggtagggtacgggaacgggggtcccttaactttacccgacctaacgttccccgtaccgaaaggaaccgaaaaccaaacccgtaacgtttaaaacggtaaaccttttacgtacgttaacttccgaacgaacctaaaagtccggaaaacctccggaaccctacggaaacggtaacggacccgggaagggaaccccgtacgggtnttaacgggttagtttaactttaccgggtgggtaaacggacgggtaaaagggtcgacggttacggggtacgggtcccgggttaacgggggaacttgggggttaacccggggg

SEQ ID NO: 220861 - DNA, 651 bp, Homo sapiens
  misc_feature: GYAE6OF01ATNRA.18.87.H10.1.454.CMB.1.raw
  modified_base (526)..(526): a, c, t, g, unknown or other
  misc_feature (526)..(526): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgttgggtttttcctcgttgcttattttagaaggtgtccagtgtgacgtgcagctggtggagtcgtgggggaggtcttgggtccaggtcccgtggggggggtcccctggacgacctcctcctgtcgcaggccctgcattcatctttaatagttattggatgcacgtgggtccgccagggcgtaccgggggaagggcccggaggtgggtcggccaacataagtgacaagataggaactaggaagaaagaactagtgtggacttgtaggtaggaacggggtcctaatttccaccctagtccctacccgaagtacgaaaccaaaccaacgttaaagtaaacctttacgtagtatactagaacctaaagtcgaaacncgtacccttagacggacgccggaacggaccgacggtccttaggtaccgtttaagtaccgttggcggaaaccgaaggtccggaacgtagggttcgggccgttaggggaaccctgggttacccgggg

SEQ ID NO: 220862 - DNA, 769 bp, Homo sapiens
  misc_feature: GYAE6OF01AGHOV.18.87.H10.1.454.CMB.1.raw
  modified_base (315)..(315): a, c, t, g, unknown or other
  misc_feature (315)..(315): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagcgttgggttttcctcgttgcttattttagaaggtgtccagtgtgacgtgcagctggtggagtcgtggggggagtcgttgggtcccaggcccgttggggggtcccctggagacctctcctgtgcacggcctgcattcattactttaattagttattggatgcacgtcggggtccnccgagggccggtaccgggggaacggggccggtagggtggggtacggacccaaacgaataagtggacgaaagtaagtacggtaaactggaaagtaaacggtaaacttaggttagggttacggtacccgtttcggtagggttaacggggaaaccggggtcccgtaaacgtttcccgaaccctacttccccgttaccaaagggaaccgtaaaccaaaaccttaaacgttaaaacgttaaccgttttaactacggttacttaccgtaacgaacctaaaaagttcgaaaacctcggtaacccttacggaacggtaccggacccggaaggtaacccgacgggttcttaggttacggtttaactacgtggttacggaacggtaaggtacgcgtaaggtccggacggttacggggatacggttacgggaaccggttcgggtggggaaccccgtaaacggggg

SEQ ID NO: 220863 - DNA, 680 bp, Homo sapiens
  misc_feature: GYAE6OF01BIX7W.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcacggccctgcattcattctttaatagttattggatgcacgtcgggtccgccgagggccgtccggggggaagggggccggagggtggggtacggacccaaacagtaagtgacaaagagtagggaactgaagaagtaactatggtacggactcgtagtagggaacgggcctattccaacctatccgtacccgaagaacgaaccaaacctaacgtaaacgtaaacctttactagttacttccgtacggtaacaaaacgttcggaaaacaccgggtaccctaagaacgggaaccggacccgggaaaggacccgaaacgggttcttacgggtacgttttaacgttacgttgggttacgggacggtaaagggagaccgggttaagggtcgggaacggtggggtaacctagggtacccgggggg

SEQ ID NO: 220864 - DNA, 737 bp, Homo sapiens
  misc_feature: GYAE6OF01EO1V9.18.87.H10.1.454.CMB.1.raw
  modified_base (227)..(227): a, c, t, g, unknown or other
  misc_feature (227)..(227): n is a, c, g, or t
  modified_base (588)..(588): a, c, t, g, unknown or other
  misc_feature (588)..(588): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagcgtggtttcgtcgtgctatttagagtgtcagtgtgacgtgcagcgtggtggagtcgtgggggaggtcttggtccncggccggtcgggggtccctggacgctctcgtgtcgcacggccctgctacttcattactttaaattagtttagtggtatcgacgtaccgttcgggtcccgaccggtagggtccggtacccggggggaacgggggtccgggtagggttcggggtacgggaaccctaaagtaataacggtcgaacgaaggtacgtacgggaaacgtaggaaaggtaaacgtaacttaggtaggtacgtaacgttcgtaggtagggaaccggggtcctaaccggtttaccaaaccgttcttaccccgtaagaacgtaaaccgaacctaaaccgtaacgtttaaaccgtaaactttactaaggttacttcgttaanaacgtaagtaccgaacgtacggaccctaacgaacggtaccgacccggaaggacccgtacgggttcgttagttaaccgttacgttcgtagggacggtaaccgaaggtacgcgtaacgggttcgggaacgtacgggtatcggggtacgggg

SEQ ID NO: 220865 - DNA, 814 bp, Homo sapiens
  misc_feature: GYAE6OF01EB45E.18.87.H10.1.454.CMB.1.raw
  modified_base (720)..(720): a, c, t, g, unknown or other
  misc_feature (720)..(720): n is a, c, g, or t
tcagtacgagtatgcacgaccggtgctcgatttagcagtactgcggttgggtttgggaggagccttagccctggactccaaggcctttccacttggtgatcagcactgagcacagaggactcaccatggaagttggggctgagtcgttgggttttcctcgttgcttatttaggaggtgtcagtgtgacgtgcagcgtgggtggtagtcggtgggggagtcgttcggtaccgacggtccgggtcgggggtccctggacgtaccttcctccgtgtcgccgtacggcccctgtactacttcctatttacgttttaaataggtttagttcggtagtcgcgtacggttccggggtcccgccggacgggtccgggtacccgggggggtaacgggggtccgggtagggtcggggtaccggaccctaaacgtaagtaacgtaggaacgtaaggtacgtaacggaacgtaggaaacgtaaagtacgtagttggtaccgtaacgttgtacgggtacgggaaccggggtcctaacgttaccgacctaacgtccctaacgaagtaaccgaacaaaccgtaaacgtaaacgttacttacgtatacgtactacgtaaacgtaatacgaactacccgtactacggaacgggtaaccgcccgggtaaacggaccgttaccgttaggttaacgttacggtttaagttaccgttaggggaacccgaaacgggttaagngtaacccgggtggttaccgggacggtaccggggtaattacggttaccgggggaaccggttaccgggggcgggtaaaaccccgggaacccggggg

SEQ ID NO: 220866 - DNA, 670 bp, Homo sapiens
  misc_feature: GYAE6OF01A9P4Q.18.87.H10.1.454.CMB.1.raw
  modified_base (542)..(542): a, c, t, g, unknown or other
  misc_feature (542)..(542): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgtgggttttcctcgttgctattttagaaggtgtccagtgtgacgtgcagctggtggagtcgtgggggaggcgttggtccaggcccgtgggggggtcccctggagactctcctgtgcaggccctgcattcattactttaatagttattggatgcacgtgggtccgccgaggcgtccgggggaagggccggagtggggtcgaccaaacgataagtgacgaagagtaggaacctaggaagaaagtaacttaagtcgggttaggaaccttcgtaggtagggaaccggggtccctaatttccccgaactacgttacccgttacccgaaaggaaccgaaacccaaaaccttaacgtaaaacgtaaacctttaaccgtagtttaactccgttaanaactaaagtccgaaacacgcccgttaagaacgaccggtacccgaacgggaaccaccgggtcttacggtagtttaacttcgtgtaggaccggaaagcggactagggtcggagtgggacgtagtacgggg

SEQ ID NO: 220867 - DNA, 777 bp, Homo sapiens
  misc_feature: GYAE6OF01BP8VN.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggttttcctcgttgcttattttaggaaggtgtccagtgtgacgtgcagcgtggtggagtcggtgggggagtcgttgggtccacggccggttcggggggtccctggacggacttcctccgtgtcgacgacggccctgctattctattacttttaatagttagtggatcgacgtacgtcgggtcccgccgacgggccggtaccggggggaacggggccgggtagggttcggggtacggaacccgtaaatagttaacgtcggaacgaaaggtagtaacgggaaacgtaggaaagaaacgtaaacgttagtcggtacggaccttaggtagggtacgggaaccgggtaccctactttacccaaccgtccttaccgtaccgaaaggaaccgtaaaccaaacccgtaacgttaaaacggttaaccctttaacgttacgttacctcgtaacgtaaactaaagtacaaacccgcgttaccccgttaagggaaaccggtccggtaacccgggacggaaacccgggtccggttaacgttaggttaccgtttaaacgttaccggttagggtacggaacggtaacgtacggacgtaggggttacgcgggtaaggtacgcgggttaccgggg

SEQ ID NO: 220868 - DNA, 675 bp, Homo sapiens
  misc_feature: GYAE6OF01CF8Z3.18.87.H10.1.454.CMB.1.raw
  modified_base (497)..(497): a, c, t, g, unknown or other
  misc_feature (497)..(497): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggttttcctcgttgcttattttagaaggtgtccagtgtgacgtggcagcgtggtggtagtcggtgggggagcgtttggccgaggccggttcgggggggtccctggacgtccgtctccgtgtacgcacggccctgactattctattcttttaagtagtttacgtggattcggaccgtacggttcgggcccgaccgacgggcccgggtaccggggggaacggggcccgggtagggttcggggccggacccaaagtaacgtaagtcggacaaaggagttacgggaaactaggaaagaacggtaacttgtagtggtaacctgtaggtagggaacggtccgtntaacccgactctaccgacgaaagtaaccgaacaaactactaaaagacttacgtatacgttcagaactaacgntaaacncgtacgaacagggacaccggtacgacggtactcgttgtagttagtccgtgaccgtaggaaagccggaatggggacctaggtagggattgggttaccgggg

SEQ ID NO: 220869 - DNA, 250 bp, Homo sapiens
  misc_feature: GYAE6OF01B5FMF.18.87.H10.1.454.CMB.1.raw
  modified_base (249)..(250): a, c, t, g, unknown or other
  misc_feature (249)..(250): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtgacatcaagcgaactgtggctgcaccatctgtcttcatcttcccgcatctgacatactctactgagcggctggcaaggcgcatagnn

SEQ ID NO: 220870 - DNA, 808 bp, Homo sapiens
  misc_feature: GYAE6OF01DLSEZ.18.87.H10.1.454.CMB.1.raw
  modified_base (485)..(485): a, c, t, g, unknown or other
  misc_feature (485)..(485): n is a, c, g, or t
  modified_base (727)..(727): a, c, t, g, unknown or other
  misc_feature (727)..(727): n is a, c, g, or t
  modified_base (774)..(774): a, c, t, g, unknown or other
  misc_feature (774)..(774): n is a, c, g, or t
tcagtacgagtatgcacgaccggtgctcgatttagcagtactgcggttgggtttggggaggtctcagagaggagccttagccctggactccaaggtccctttccacgttggtgatcagcactgagcacgagaggactcaccagtggaagttggggctgagtcgtttgggttttcctcgttgtactttagttttaaggaaggttcgtaccgtagttggttcgacgttgacaggtcgttggggtcggtaggtcgggtgggggacgtcgtttcggccgaggtccggtcgggggtcctgaacgtccttccgtcgtggtcgaccgacggtccctgtaccttattactaactttacgttttaagtagttttacgtaggttactcggtccgtacgggtccgggttacccgacggtaccggggtccggggtaccggggggaacggggtcccgggtagggttccggggacgtaacccgtaaagtaagttaaggnggaaccgaaaggtaaggtaacggaacgttagggaaaacgttaaacaaagtttcggtacggtacggtactttacggacggggttaaagggtaacccgggttacctacggtacccctaaccggttacttacccgaaacgaacggtaaacgaaccctaaaacgtaaccgtaaacgttaacgttaacctgttaactcgaagtaactaacgtaacgaccgtacgcccgtaagacggacgtaaccggnggtaccgtacgtgtacgttagtaagtcggttgaacggttgaacgggntaacggtgggcgtacgacgggtgaggttaccggg

SEQ ID NO: 220871 - DNA, 832 bp, Homo sapiens
  misc_feature: GYAE6OF01B04MO.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaagttggggctgagcgttggttttcctcgttgcttattttagaggtgtccagtgtgacgtgcagctggtggagtcgtgggggagtcgttggtccaggtccgtcgggggtccctggacgtacctcctccgtgtcgcacggccctgctattcattctttaatagttattggatgctacgtcgggtccgcgacggccggtaccggggaaggggccggaggtggggtcgaccaaacataagtcgacgaagagttacggaacgttaggaagtaaagtaaacgttagttaggtacggtaaccttcgttaggtaacgggaacggggtaccctaaccgtttaccacccttaacgttccctacccggaaacgtaacggaaccctaaacgtaaaccgttaaaacgttaacccgttttaacgtacgtttaacttacccgtaacggaaaaccctaaaacgtacgaaacccgtaacgtaaccccgttagaaaccgggaccggtaaccccgggaaacgggtaaccccggaccgggttactttacggggttactttaaaccgttaccggttagggtaccggtaaacccgggaaaggtccgggaaccttagggggtcccgggttaccgggtaacgggggtaaaccgttacggggtacgggggttaaaccccggtttcccgggggtaaccgggggtaaccccccggtaaaacccggggggg

SEQ ID NO: 220872 - DNA, 1082 bp, Homo sapiens
  misc_feature: GYAE6OF01BEUJI.18.87.H10.1.454.CMB.1.raw
tcagtacgagtatgcacgaccggtgctcgatttagcagtactgcgttgggtttggggaggcttggtccagcctggggggtccctgagactctcctgtgcaggccctgcattcatctttaatagttattggatgcacgtgggtccgccaggcgtccgggggaagggccggaggtgggtcggaccaacgattaagtggacaagagtacggaactggaagaaagaacttagttggtaggaactcgttggtacggaaacgggggtcctaatttccaacctacttaccgttacccgtaaagggaacgaaaccgtaaaaccaaaccgttaaaacggttaaaaccttttaacccggttaggttaactttaccgtaccggtaaacttaaaaagttaaccggaaacccgttaacggacccttacggaaacggaaccggttaacccggggaaacgggaacccggtaacccgggtccgtttaaagggtttacgtttaaaccggttttaaccgttggggtaccgaaaccgggttaaaagggtaccgaaacggtacgggtttcgggaacggtttaacgggggaaccttaagggtaccggggttaacggttaccgggaacgggggtaaccccgaaaagggggtaccccgttaacgggtaccccgttaacccgttacctccccggttacggaacccgttacccgtaaccccggtaaccgggaaacccggtttacccccgtaacgtttccccccggggttttaaccccgttttccccccgggaacggttcccccggttaaccccgtttcgggaccccgttaaccggaagggttacccggaccccgttaaccccggttaacgggaccggtaaccggaccccgtaaaccggacccggggtacccggggtcccccggtaacggggttccgtaccccgggttaccggttacgggtaaaccgggaaaccgtttcccgttaaaaccccggtttaccccgtaacgtttaaaccgggttcccggtttaaaccggcggggggaaacccgttccgggggttaaaccggcccggttaaaacgggtcgggaaacgggtcccttaaagggg

SEQ ID NO: 220873 - DNA, 794 bp, Homo sapiens
  misc_feature: GYAE6OF01BTU13.18.87.H10.1.454.CMB.1.raw
  modified_base (155)..(155): a, c, t, g, unknown or other
  misc_feature (155)..(155): n is a, c, g, or t
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (784)..(784): a, c, t, g, unknown or other
  misc_feature (784)..(784): n is a, c, g, or t
tcagtacgagtatgcacgaccggtgctcgatttagcagtactgcgttggggtttgggggaggcttggtccaggccgtggggggtccctgagactctcctgtgcacggccctgctattcattactttaatagttatggatgacacgtcgggtcccnccgagggccggtaccgggggaaggggccggaggtgggacgaccaaanattaagngacaagataggaactaggaagaaagaactgtggtgtactgtaggaggaacggctactcaactactaccgacaagaacgaacaaacgtaacgttaaaactaaccgtttataagttactaccgtaagaacaaagtacgaaacgcgtcacgaagacggaccgaaggtaccgcgtgtagttattaacgtgtacggagaacggaaagcggacgttacgggcggtacgggtaagggaactaggggtaccgggtacggtacggggaaccggggaacccaaacggggttacccgtaaccgggttaccctacccggttacctacccggtaccgaaccccggttaaccccgaaccccgaaaccgggtaacccggtccccttaaccgggttccccgtttcccccgtacccggtcggcccccgtcgtaaccgtccgtaaccgaccggtacccgaccgtaccgtacgacgtaccgacctacgggcccggccgtccggacggcctcggaccggtacgaccgtacgtcctaccgtaccgtacgtaccgtacggacggtcggacggtacccggtaggaccgtaacgggacncgtaagtacg

SEQ ID NO: 220874 - DNA, 1025 bp, Homo sapiens
  misc_feature: GYAE6OF01D9PUW.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactccaccatggaattggggctgagcgttgggttttcctcgttgcttattttagaaggtgtccagtgtgacgtgcagcgtggtggagtcggtgggggaggtcgttcggtcccgacggtcccggttcggggggggtcccccttggaacgtacccttccgttccccgtggttcggcctaacggggtcccccttggcctaactttcctaatttaccgtttttaaaagttaaggttttaagtttgggaattcggtaccgtaaccggttcgggggttccccggacccggtacggggtcccgggttaccccgggggggaaacggggggccccgggtaagggggttcggggtaccgggaaccccgtaaaaccgtaagttaaacgtaggaaccgaaaggtagtaacgggaaacgttaggaaaggaaaacgtaaccgttaagttacgggtacgggtaaccttcggtacgggttaagggaaaccggggggtccccttaaacgtttacccccgaaaccccgttaacgtttaccccgttaacccccggaaaggttaaaaccgaaaaccccgtaaaaaccccgttaaaccgtttaaaaaccggtaaacccgtttttaaaccgttagggtttaaccctttacggttaacgaaaccgttaaaaatacccgggtaaaaccctaccggtaacccccttaacggaaaccgggttaaccgggaccccgggaaacggtaccccgggtaacgggttacccgttagggttttaaaccgttttaaacgttaccgggtttaggtaacggggtaaacccccggttaaaaaggggtacccggaacccgggtttaaggggttacccggggaaccggggtttaaacccggggtaaacgttcggggtttaaaacccccggggggg

SEQ ID NO: 220875 - DNA, 869 bp, Homo sapiens
  misc_feature: GYAE6OF01C4XRM.18.87.H10.1.454.CMB.1.raw
  modified_base (218)..(218): a, c, t, g, unknown or other
  misc_feature (218)..(218): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcacagtggaagttggggctgagcgttgggttttcctcgttgtcttattttaggaaggtgtccagtgtgacgtgcagcgtggtaggngtcggtgggggagtcttggtccaggtccggtcggggggtcccctaggaacgtccttcgtccgtggtagccgaccgggtccctaggactattactattacgttttaaattaggttaagttggatcggtaccgtacggttccgggcccgaccggagggtaccgggtacggggggaacgggccgggtaggtcgggtacgacctaaacgtaagtaagtcgaacgtaaggaagtacggaagtagaaaagtaaacggtaatacgtagggtacggtaccttggtaggaacgggtaacgggaccctaacttacccgaactacgttacccaacgaaaggtaaaccaaacctaaaacgttaaccgtaaaaacgttaaccctttaacggtaatttaacctacggttaaacgaactaaaacgttaccggaaaccctaacccggtaaccccgtagtaaaacggggcccgtaacccccggggaaaggtaaacccgtacccggggttatttaaagggggtttaacccgtttaaaactttacggggtaacccgggttaaaggaaacccgggaaaaacggggtccggtaaacggggtttcggggaaacgggggtttccccggttaaacggggggaaacttaccccgggggttttaaaacccggggggg

SEQ ID NO: 220876 - DNA, 834 bp, Homo sapiens
  misc_feature: GYAE6OF01CL41X.18.87.H10.1.454.CMB.1.raw
  modified_base (250)..(250): a, c, t, g, unknown or other
  misc_feature (250)..(250): n is a, c, g, or t
  modified_base (479)..(479): a, c, t, g, unknown or other
  misc_feature (479)..(479): n is a, c, g, or t
  modified_base (663)..(663): a, c, t, g, unknown or other
  misc_feature (663)..(663): n is a, c, g, or t
tcagtacgagtatgcacgaccggtgctcgatttagcagtactgcgttgggtttggggaggtctcagagaggagccttagccctggactccgaaggtcctttccacttggtgatcagcactgagcacagaggactcaccagtggaagttggggctgagtcgtttcgggtttcctcgttgtctttaagttttaaggaaggttcgtaccgaggtggtaggtacgtgacaggtcgtggggtgggaggtcggggngggggtacgtcggtttcggaccgtcgggtccgggttcggggggtccctaggacgtcctccgttccgtggtcgccggtacgtcctgtctacttctatttactttaagttaagttcgtgtatcgacgtcggtcggtcccgcggacgggccggacgggggacggccgggtaggttcgggactaacaagtaactagtacgaaacgtaaggacgtaaggaacttaaggggaaanaacggttaaacttagggtacggttaaacggtcgttacgggtaacggtaagggggtaacccggtacgttaacccgtaccaaacccgttcgttaaacccgaacggaaaacgtaaaccgaaaaccgtaaaaccgtaaaacgttttaaacccgtaacgttttaacgtcggttaaccttaacggttaanaaaaccgtagtaaccaaccgtccgtaccaacggggaaccgacgggacgtaacggtacggacggtttcgaaacggtttatcgggtttagagggtaacgaaaccgggttaggaacggacgggtttaccggggaagtaccgggggttagggaacgtaacgggggttacccgggg

SEQ ID NO: 220877 - DNA, 696 bp, Homo sapiens
  misc_feature: GYAE6OF01DNUE6.18.87.H10.1.454.CMB.1.raw
  modified_base (191)..(191): a, c, t, g, unknown or other
  misc_feature (191)..(191): n is a, c, g, or t
  modified_base (268)..(268): a, c, t, g, unknown or other
  misc_feature (268)..(268): n is a, c, g, or t
  modified_base (394)..(394): a, c, t, g, unknown or other
  misc_feature (394)..(394): n is a, c, g, or t
tcagtacgagtatgcacgaccggtgctcgatttagcagtactgcgttgggtttgggggaggcttggccagccgtggggggtccctgagactctcctgtgcaggccctgcattcatctttaatagttatggatgcacgtgggtccgccagggccgtaccgggggaaggggccggaggtggggtgacccaaanataatgacaagatggaaactgaagaagaactatggtggactctgtaggaacgggcctattccactatcctccgaganaacaaacataacgaactttactgtaactctagtaacaaaagttcgaaacacgtacccctacgacggacggcccggaagggaaccaccgggtcttaggttacgttaatttacgtggtcgacgaaagngcaggtcggacgtgggactaaggtcggaacgtcggtcgggacgaacgggacctacggtcacccgtcgtccgtcgacgccctaccgaaccgtaccggcctacgtccggtccctcccgtcggccctccctgccgtaccggacgaccacccgacctccggaagcgtaccgaaccggaccggtcccgggacccgtcggtccgtcgcccgggtaggtaccgaacggttccttacccgtacccctaaagttcccggtacgtacgtcggaacgggccggtcgtacgggaccggtaacggcgtaaccgag

SEQ ID NO: 220878 - DNA, 829 bp, Homo sapiens
  misc_feature: GYAE6OF01AW0CF.18.87.H10.1.454.CMB.1.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggtttttcctcgttgcttaagttttagaaggtgtccagtgtgacgtgcagcgtggnggngtcggtgggggagtcgttcggtccaggccggtcggggggtccctggaacgtccttccgtccgtggtcgccgtacggtccctgacctattcattacgtttaattagtttagttggatcgccgtacgtcggggtcccgaccgacgggtcccgggtaccggggggaacggggccggggtaagggtcgggggtacggaacccgtaaacgaagttaaacgtcggaaaccgaaggtaacgtaacgggtaaacgtaacggaaacggtaaaaggtaaacgttacgggttaagggtaacggggttactttacgggtaaggggtaacgggtaaaccggggtacccgttaaacgtttaccctaaccgtaaccgttccttaaccccggaaacggaaaccgttaaaccaaaacgttaaaccgttaaaacggtaacctttaaccgtaggtaacttaccgtaacggtaacttaaaacgaccgaaacgtaccgtaaccgtaccggaacgtaacgggacccggaaaggtaccccctaggtccgttaaggttacgttaagtaaccgttggaacggtaacggaagtacgtacgtaacgggttggtacccggagggtacgacggttacggg

SEQ ID NO: 220879 - DNA, 749 bp, Homo sapiens
  misc_feature: GYAE6OF01DF3SW.18.87.H10.1.454.CMB.1.raw
  modified_base (433)..(433): a, c, t, g, unknown or other
  misc_feature (433)..(433): n is a, c, g, or t
  modified_base (671)..(671): a, c, t, g, unknown or other
  misc_feature (671)..(671): n is a, c, g, or t
  modified_base (737)..(737): a, c, t, g, unknown or other
  misc_feature (737)..(737): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctggagtcgttcggggtttttcccttcgttgtacttaagtttttaaggaagggttcgtcctaggtgtgacgtgcgagcgtgggtgggaggttcggtgggggacggtcgttcgggtaccgacggtcccggtcgggggggtccctaggacgtacctccgtccgtggcgccgacggtccctgctacttactactttactttaaagttagtttatggtatgctacgtcgggtcccgcgacggccggtaccggggggagggccggaggtgggcgaccaacgtataacgngaacgaagagtaggaactagaaagaagaacgttagtcgttacggtacttacggtaggtacggtaacgggtaccggtacttaacccaaccgtatacccgtaacgaagaaaccaaaccgaaaactaacgtaaacttaaaaccgtttacgtacgttaaccgttataaccgtaataaacgttaaccgaaactaaccgaccctacggaaacggaccggaaccggaacgggacgtaaccgggtntaacggtttagttaccgttaacgtgggtaacgacggtaagaggacggtcggtaggacggtaagggntagggtccgggg

SEQ ID NO: 220880 - DNA, 773 bp, Homo sapiens
  misc_feature: GYAE6OF01C8PQA.18.87.H10.1.454.CMB.1.raw
tcagtacgagtatgcacgaccggtgctcgatttagcagtactgcgttgggtttggggaggtctcagagaggagccttagccctggactccaaggccctttccacttggtgatcagcactgagcacagagactcacagtggaagttgggctgagtcgttcgggttttcctcgttgtacttagttttaggaggttgtccgtagtggtcgacgtgcgagcgtgggtggtagtcggtgggggagtcgttcgggtccgaggtccgggttcggggggtccctggacgtccgttccgtccgtggtcggccgacggtccctgacttacttactatttactttaagttagttagtggatgaccgtcgtccgggtcccgacgacgggccggtacgggggacgggtccggaggtcgggcgacctaaagataagtgaacaaaggtatacgggaaactaggaaacggtaaacgtaacgttaagtaggtacgtaacgttcggtagggtacgggaaccgggtcctaaccttccctaaccgtacttacccgacggaaagaaccgtaaaacaaccgtaaacgttaacgttaactttacgtaacgtttagtaccgtaataaaccgtaaacgtaaccgaacgtaccgtaccgtaaccggacgggaacccgttaacccgggaaggacccgtaacggttcttaaagggtttagtaaccgttaaccgggtgtaaccggtaaacggagttacgccggtaaggggacgtttcgggaaaggtgttacgggtaccgggg

SEQ ID NO: 220881 - DNA, 694 bp, Homo sapiens
  misc_feature: GYAE6OF01CATDV.18.87.H10.1.454.CMB.1.raw
  modified_base (653)..(653): a, c, t, g, unknown or other
  misc_feature (653)..(653): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttgggctgagtcttgggttttcctcgttgcttattttagaaggtgtccagtgtgacgtgcagcgtgggtggaggtcgtgggggaggtcgttgggtcccgaggcccggtcgggggggtcccctggacgtccgtctccgtgtgccgacggccctgctattctattactttaatagtttattggatgctacgtcgggtccaccgaggccggtccgggggaagggccggaggtgggtacgaccaacattaagcgacgaaagacgtaggaactaggaagaaacggtaaatagtaggtacggacttcgtggtaacggaaggggtccctaatttaccgaaccccgttatacccgtaacccgaagaaccgtaaacccaaacaacgttaaaagtaacccttacgtagttactacgtagaaacctaagtcgaaactacggtcccctaaggaacggacggtacccggaggtaccacgggtcttagtagttaaaccgtttgcggttcggaacgaaacgggtnacggtaagggttcggaaccgttaggggaactggggtccggg

SEQ ID NO: 220882 - DNA, 891 bp, Homo sapiens
  misc_feature: GYAE6OF01BBUVA.18.87.H10.1.454.CMB.1.raw
  modified_base (729)..(729): a, c, t, g, unknown or other
  misc_feature (729)..(729): n is a, c, g, or t
  modified_base (839)..(839): a, c, t, g, unknown or other
  misc_feature (839)..(839): n is a, c, g, or t
  modified_base (860)..(860): a, c, t, g, unknown or other
  misc_feature (860)..(860): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggtttttccctcgttgtcttattttaggaaggtgtccagtgtgacgtgcagcgtggtggagtcggtgggggtaggcgttcgggtcccgacggccggttcgggggggtcccctggacgtaccttccgtccgttggtacgccgtaccggccccttggacctactttacctatttaccttttaaagttagtttacgttgggtacttcggtaccgtaacggttccggggttccccggcccggtaacggggtcccggggttaacccggggggggtaacggggggtccccggggtaacggggtttgggggtacccgggtaaccccgaaaaaccgttaagtaaacggttcggtaaaccgtaaagggtaaacggttacgggtaaaccgttagggaaaagggtaaaacgtaaaccgttaaggttcgggtacgggtaaccgtttaccgggtgggtttaaccgggggaacggggtacccgttaacgtttacccaaccccgtaaccttccgacccgtaaaggaaccgtaaccaaaacccgtaacgtaaaccgttaaacctttacgttacgtaacttccgtanaaaccgtaaagtaccggaaaccgtcggtaacccctggaacggaacccgggcccgggtaaaggaccgtaccgggtcgtttacggtagtttaacgttcgtagggttaccggnggaaaacgcgtagtaccgggngggtaccgtggggtaccgaaggttcccgggg

SEQ ID NO: 220883 - DNA, 786 bp, Homo sapiens
  misc_feature: GYAE6OF01EWSR1.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagcttgggttttcctcgttgcttattttagaaggtgtccagtgtgacgtgcagcgtgggtggaggtcggtggggggagtcgttcggtccacggcccggttcgggggggttcccctggacgtaccgttccgttccgttggtcgccgaacgggtcccctggcctaatttcctaatttaccttttaaaagttaggttttagttcgggatcggcctaggtccggggtcccgaccgacggggtccggtaccggggggaaggggccgggtaggtcgggggtacgaccaaacgtataagtcgacgaaaggtagtagggtaacaggaagaaagtacgtagtacggtaggtacttcgtagggtacgggaacgggtcccgtaactttacccgacctaacttcccgtaacgaagtaaccgaaacgtaaacctaaaccgtaaataccttttaaggtataacttcgaacgtactaaaaggttccgaaacctaccggtccccttaaggaacggaccggtaacccggaagggacccgtcggggtacctttaggggtacttttaaagttcccgtgggtaacgggaacgtaaaccgggtagcggttaacggggtcgaacccgggaggggtaaacctaggggttacccgggg

SEQ ID NO: 220884 - DNA, 707 bp, Homo sapiens
  misc_feature: GYAE6OF01CRY58.18.87.H10.1.454.CMB.1.raw
  modified_base (509)..(509): a, c, t, g, unknown or other
  misc_feature (509)..(509): n is a, c, g, or t
  modified_base (537)..(537): a, c, t, g, unknown or other
  misc_feature (537)..(537): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttatggatgcactgggtcccgccaggccgtccggggggaaggggcccgggagtggggtcggccaaacataatgacaaagatgggaactgaagaagaactatcggtggactctggtaggaacgggccctattccacctatcctaccgaagacgaaccaaacgtactaaaagaactttactgtaatccgtgacaaatcgaaacagtcctacgagacgaccggaaggaccacggtctggttgtaacttactggacgacgaagagcaagggtggcgtaggactacgtgggacgtcggtacggggacccgaaagggcccacggtccaccgttctacccgtcaacgtccctacccgaacggaaccggcctacgtcccgtccccttccccgnggcccgccctcgtccgtaccgacggtcnccgtacctcgaagccgtacaccgtccgggacccgtccggtggcccgttcggcccgttacggtacccgaaacggtcccttaaccgttaccccgtaacgtacccgttcgggtaactacgggccggggtacccgggtacgacgggtaccgtaaaccgggccgtaaccgtaagg

SEQ ID NO: 220885 - DNA, 708 bp, Homo sapiens
  misc_feature: GYAE6OF01EIC4U.18.87.H10.1.454.CMB.1.raw
  modified_base (207)..(207): a, c, t, g, unknown or other
  misc_feature (207)..(207): n is a, c, g, or t
  modified_base (273)..(273): a, c, t, g, unknown or other
  misc_feature (273)..(273): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagcttgggttttcctgttgcttatttagaaggtgtccagtgtgacgtgcagcgtggnggagtcggtgggggaggtcgttcggtccgacggtccggtcgggggtccctggacgtcgtccttccnggtcgcgaccggcctgctatacctattacttttaatagttagttggactggtcgtacggtcgggtccgccggacgggtccgggtaccggggggacgggccgggtaggtcggggtacgaacccaaagtactaagtcgaacgaaagacgtacggaagtaagaagtaaagtaacgttagtaggtacggtacgtacggtaggttacgggacgggtaccgtaacgtcctaaacgtcctcgaccgaagaacgtaaacctaacgtaaactacgtaaacttacgttacgttactacgtaacgactaaaacgtgtaaaccctagacccgttaacgaaggaccggaacccggaacgggtaccgtacggtcggtaacggttatttaccggtagtacgtaggacctaaggcgaacggtgtacggggctaggggactgggtaaccggg

SEQ ID NO: 220886 - DNA, 1108 bp, Homo sapiens
  misc_feature: GYAE6OF01EL2BV.18.87.H10.1.454.CMB.1.raw
  modified_base (585)..(585): a, c, t, g, unknown or other
  misc_feature (585)..(585): n is a, c, g, or t
  modified_base (613)..(613): a, c, t, g, unknown or other
  misc_feature (613)..(613): n is a, c, g, or t
tcagtacgagtatgcacgaccggtgctcgatttagcagtactgcgtttggggtttgggggaggcttggtccagccgtggggggtccctgagactctcctgtgcacggccctgctattcattacttttaaatagtttagttggatcgcgacgttcggggtcccgccgagggtccggtaccgggggggaaacgggggccgggaggttcgggggtacggacccaaaacgtaatttaaagtcggaacgtaaaggtaagttacggggaaaaccttagggaaaaggtaaaagtaaaaccgtttaggttgggttacgggtaaccgtttccgtttggggtaaacggggaaaaccggggtcccgttaaacttttaccccacccttaacgtttccctaaccccgaaggtaaaccgaaacccttaaaaaccgtaaaccgtttaaaaaaggttaaccctttttaagttagggtttaacctaccggtttaagaaaccttaaaacgtacgaaaaccgtccggaaccccttaggacgggaaccggaccccggtaagggtaccgacccgggtttgtttaggtaacgttttaacgtttacgngggtaaccggaaaggtaaaggtcccggnggtaacggggttcggacggtacgggaacttaggtcgggggtcttaccgggggaccggggaaaccgggtaacccgggaccgttacccggtttacccgaaccccgttttccggtcccctaaacggccccgtccccgttaacccgaacccgggttaaacccggcccctttaccggttcccccggtttaccccccgtttccccgggccgttacccccggtccccggtaccgtaccccggacccggtacggaccggttacccctaccccgggtaacccgacggacccgtaccccggcgggtaaccccggtcccccggggtccggtttccggggcccgttacccgggtccccggtttaagggtaaaccccgtaaacccgtttcccccgtttaaacccgttaccccggttaaaccgtttacccggtaccgggttacggtaacccggggcggtttaaccccggggtcggtaacggacccggttaaggggccctacggtaaagg

SEQ ID NO: 220887 - DNA, 809 bp, Homo sapiens
  misc_feature: GYAE6OF01AT6CA.18.87.H10.1.454.CMB.1.raw
tcagtacgagtatgcacgaccggtgctcgatttagcagtactgcgttgggtttggggaggtctcagagaggagccttagccctggacctccaaggccctttccacttggtgatcagcactgagcacagaggactcaccatggaagttggggctgagcgttgggttttcctcgttgtcttattttagaaggtgtcctagtgtgacgtgcagtcgtgggtggtacgtcggtgggggaggtccgttggccgaggccggtcggggggtccctggacgaccttcgtccgttgtcgcgacggtcccctgtcctattcttacttacgttttaaattaggtttagttaggtagtcgtcgtacggtcgggtacccgccgtacgggccgggtaccgggggaacggggtccggagggtcgggtacggaccctaaacgtaataacgtgaacgaagagtaggaacgtgaaagaacgtaacgttataggtagtacgttacgtggtaacggaacgggtccgtaacttacccgacctacgttacccacgaacggaacaaaccgtaacctaaccgtaaaacgtttaccgttaacgttacgttaacgtccgtacgtaaactaaacggttccgaaacgtaccgtcccgttaaccggacggtaaaccccgggaaccgaacccgggaaccgtacgggtttaccgtacggtttaacggtttaaccgtttacggggttaccggttaagggttaaacccgggaaaggtacggttaccgggtaaacggttggggacccggggtttaaacgacgggtttccgggtaacccggggg

SEQ ID NO: 220888 - DNA, 749 bp, Homo sapiens
  misc_feature: GYAE6OF01CMZQU.18.87.H10.1.454.CMB.1.raw
  modified_base (217)..(217): a, c, t, g, unknown or other
  misc_feature (217)..(217): n is a, c, g, or t
  modified_base (624)..(624): a, c, t, g, unknown or other
  misc_feature (624)..(624): n is a, c, g, or t
  modified_base (631)..(631): a, c, t, g, unknown or other
  misc_feature (631)..(631): n is a, c, g, or t
  modified_base (654)..(654): a, c, t, g, unknown or other
  misc_feature (654)..(654): n is a, c, g, or t
  modified_base (699)..(699): a, c, t, g, unknown or other
  misc_feature (699)..(699): n is a, c, g, or t
  modified_base (726)..(726): a, c, t, g, unknown or other
  misc_feature (726)..(726): n is a, c, g, or t
  modified_base (733)..(733): a, c, t, g, unknown or other
  misc_feature (733)..(733): n is a, c, g, or t
  modified_base (742)..(742): a, c, t, g, unknown or other
  misc_feature (742)..(742): n is a, c, g, or t
tcagtacgagtatgcacgaccggtgctcgatttagcagtactgcgttgggtttggggaggtctcagagaggagccttagccctggactccaaggtcctttccacttggtgatcagcactgagcacagagactcaccagtgagttgggctgagtcgttggttttcctcgttgcttatttagaggtgtccagtgtgacgtgctagctggtggagtcggngggggagtcgttggtccacggccggtcgggggtccctggacgtctcctcctggtcgccgacggtcccgtgaccttactttacctaacttttacgttttaaagtttaacggttttagttacggggtattacggtccggtaaccggttccggggttaccccggacccggtaacggggccccggggttaaccgggggggaacgggggtcccgggtaagggttccggggacgaacccgaaagtaacgtaacgtcggaacgtaaaggtaacggtacgggtaaaccgaggaaacggtaaagtaacgttacggtcgggtaacggtacttcggtaggtacgggaaccgggtccctattacccgaacctaccgttcaacgtaagtaacacccgtaaaactacgtaattaaccttcncgttaancggataaaccgaatccgaaaccncgtaccgtagaaccggtcaaccggtaggtaacctcgtgttaacgngttaacgttggcgagtcggagcgttgnggtacgnggacgtcgnggtcggg

SEQ ID NO: 220889 - DNA, 779 bp, Homo sapiens
  misc_feature: GYAE6OF01D2UJC.18.87.H10.1.454.CMB.1.raw
  modified_base (674)..(674): a, c, t, g, unknown or other
  misc_feature (674)..(674): n is a, c, g, or t
  modified_base (745)..(745): a, c, t, g, unknown or other
  misc_feature (745)..(745): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcttgggttttcctcgttgcttattttagaaggtgtccagtgtgacgtgcagctggtggagtcgtgggggagcttggtccagccgtggggggtccctggacgtactcctcctgtcgcgacggccctgctattctatttactttaaagttagtttagttaggattcggcgtaccggtcggggtaccccgccggacgggtccgggtaccggggggaacggggcccgggtagggtcggggtacgaacccgtaaacgtaagttaaacgtcggaacgtaaagacggttaacgggaaaccgtagggaaacggtaaaacgtaaacttacggttacgggttacggtaccgttcggttacgggtaacgggtaaccggggtcccttaatttaccccgaaaccgttactttaccccgtaaccccgaaagggaaccgaaaccctaaacccgtaaacgttaaacgttaaccctttaacggtcgtttaactccgttaacgaaccgtaaaagtcgtaaaacccgcgtaccccgtanaaacgggtccgaacccggaggtacccacgggtccttaggttacgttaagttccgtggtaaccggacgaagnggaccgtgggtacgaggtcggactgggtaccggg

SEQ ID NO: 220890 - DNA, 789 bp, Homo sapiens
  misc_feature: GYAE6OF01DLWPK.18.87.H10.1.454.CMB.1.raw
  modified_base (774)..(774): a, c, t, g, unknown or other
  misc_feature (774)..(774): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgtggtttcctcgtgtcgtatttagaaggtgtccagtgtgacgtgcagctgggtggtaggtcgtgggggaggtcttggtccgagccggttggggggtcccctgacggacctcctccgtgtgccgacggcccgtcgctacttctaattacttttaatagtttagtggtatcgctacggttcgggtccgacgacgggtcccggtacggggggaacggggtccggagggttggggtacggacccaaactattaagtcgaacgaagtaagtaacggtaacgtagaacggaaaacgtaactaggttcggtacgacgttacgtaggtaacgggtacgggacttacttacccaaccgtagttacccgtacaaacggggaactaaaccctaaaacgaacccgtttaaaagtaaccccgttttagttaaggtaccctttttaacgaacccggaattaaaaaaccggtgggtaaaccccaacggttacccccaagggtaaacccgacccggaccggggaaagtacccccggtagggtaacccggtttgttaaacgggttacttttacgaccggggttaggaacccggggtaaagacccgtggtaaccgggtcgggtacttaaacggggggnttacgggtaaccggg

SEQ ID NO: 220891 - DNA, 688 bp, Homo sapiens
  misc_feature: GYAE6OF01B41AZ.18.87.H10.1.454.CMB.1.raw
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (582)..(582): a, c, t, g, unknown or other
  misc_feature (582)..(582): n is a, c, g, or t
  modified_base (618)..(618): a, c, t, g, unknown or other
  misc_feature (618)..(618): n is a, c, g, or t
tcagtacgagtatgcacgaccggtgctcgatttagcagtactgcgttgggtttggggaggtctcagagaggagccttagccctggactccaaaggcctttccacttggtgatcagcactgagcacagagactcacatggaattggggctgagcgttcgggttttcctcgttgtacttattttagaaggtgtccagtgtgacgtgcagcgtaggtggacggtcgtaggggggagtcgttggtccgaggccggttggggggtccctggacgtactcgtcctgtgcacggcctgactattactaattacttttaaatagtttagtcggtatcgcctacggtcggtacccgccgacggaccggtaccgggggaagggtccggaggtcgggtacgaccaaanagtaangaactaaaggagtaggaactaggaagaaacgtaacgtataggtacgtaactcgtaggtaacggaaacgggccctaagttaccaacctaaggtaccctagaaagaaacgtaacccaaagttaaacgtaaaacgtaacctttaacaggtttactaccgtacggaaactaaagacccgaaanaccgtccctaagaaggcccgtacggagaccgtacgnttaggacttaatcgtaggaacgaagaaacggcgtactagggtcggaattcggggaaactagggtaccggg

SEQ ID NO: 220892 - DNA, 843 bp, Homo sapiens
  misc_feature: GYAE6OF01BLWHC.18.87.H10.1.454.CMB.1.raw
  modified_base (225)..(225): a, c, t, g, unknown or other
  misc_feature (225)..(225): n is a, c, g, or t
tcagtacgagtatgcacgaccggtgctcgatttagcagtactgcgttgggtttggggaggtctcagagaggagccttagccctggactccaaggtcctttccacttggtgatcagcactgagcacagaggactcaccatggtaagttggggctagagtcgtttcgggttttcctcgtttgtcttagttttagaaggttgtccagtgtgacgtgcagcgtggtggngtcggtgggggacgtcgttggtccgaggtccgggtcggggggtcccctggacgtaccgttccgtccgtggtacgccgtacgggcccctggcctagtttccttaagtttacttttaaagtaagtttgttaggacttccggactaccgggttccggggtccctaccggacgggtccggggtaaccggggggaacggggtcccgggtagggttcgggtacggaccctaaagtaagtaacggtacgaaccgaaaggtagttaacggaaacgttagggaacgtaaaacggttaacttagggtacggtaacggtacgtaccgttagggtacgggtaacccggtaccggtattacccgaaaccttcgttacccgtaccccgaaggaaacgtaaacccgtaaacccttaacggttaaaacctttaaacggttaactttacggttaacgtacgtacgtaaactaagtaaccgggtaaacctagtaccccgtacgaaaggacccggtaaccggaagtcccgtaaccgggttcttaaagttaaggtttacctaaggttcgggaaggacgggtaagtaccggacgttaccggtagggtaaccggtcgggtaagttcggggtaaaccgggg

SEQ ID NO: 220893 - DNA, 762 bp, Homo sapiens
  misc_feature: GYAE6OF01B62D8.18.87.H10.1.454.CMB.1.raw
  modified_base (725)..(725): a, c, t, g, unknown or other
  misc_feature (725)..(725): n is a, c, g, or t
  modified_base (734)..(734): a, c, t, g, unknown or other
  misc_feature (734)..(734): n is a, c, g, or t
  modified_base (751)..(751): a, c, t, g, unknown or other
  misc_feature (751)..(751): n is a, c, g, or t
tcagtacgagtatgcacgaccggtgctcgatttagcagtactgcgttgggtttggggaggtctcagagaggagccttagccctggactccaagcctttccacttggtgatcagcactgagcacagaggactcaccattggaagttggggctgagtcgttggttttcccgtcgttgcttattttaagaaggttgtccgaagttgtagacgtgcagcgtggtgaggtcgtgggggacgtcgttggtccgaacggtccggttgggggtaccctggaacggtactccgtcctaggtgaccgtacggccctgacttacgttcctaattttaactttaaacgttagttttagtagggacttacggaccgaacggtcgggtaccccgtacggaacgggtcccggtaaccggggggtaacgggggaccggtaagggttacggggtccgaaaccgtaaaacgaattaacgtacgaagaaacgtaagttacgggaaactgggtaaacaaacgtaacgtaagtggtaacggacgtttacgtacgggtaacgggaacgggttaacctacgtttacgacctaagtctaacgaacgagaacaaactaacgtaaataaccttacggataacgtcttaaggaaacaaagtaacgaaccgtacaaccgtagtaaacggacgtaacgacgtaacccaggtacttacgttagttacgtaactggtacggaaccctaagggaacncgggtaaancggtagcgggtaaacgngttaaacccgg

SEQ ID NO: 220894 - DNA, 841 bp, Homo sapiens
  misc_feature: GYAE6OF01BPBD2.18.87.H10.1.454.CMB.1.raw
  modified_base (769)..(769): a, c, t, g, unknown or other
  misc_feature (769)..(769): n is a, c, g, or t
  modified_base (822)..(822): a, c, t, g, unknown or other
  misc_feature (822)..(822): n is a, c, g, or t
  modified_base (830)..(830): a, c, t, g, unknown or other
  misc_feature (830)..(830): n is a, c, g, or t
tcagtacgagtatgcacgaccggtgctcgatttagcagtactgcgttggggtttggggaggtctcagagaggagccttagccctggactccaaggcctttccacttggtgatcagcactgagcacagacggactcaccagtaggaagttggggctgagtcgttcgggttttcctcgttgtcttagttttaaggaaggttcgtccgtaggttggtcggacgttgacgaggtcggtgggtcgggaggttcgggtaggggggtacggtcgtttcgggtacccgtacgggtcccggggttcgggggggttcccctaggacgtaccgttccgttccgtcggtcgacccgaccgggtccccgttggtaccttaactttaccttaacttttaaccgtttttaaaaagtttacgggtttttaagtttcgggtactttacgggtacccgtaaccggggtttccggggtaccccggacccgggtacggggaaccccgggggtttaacccggggggggaaacgggggtcccgggtaagggtcggggtaaccggaacctaaaacgtagttaaacgtacggaacgaaaaggtaggtaacgggaaaccgtaggaaaacggtaaacgtaacgtaggttagggtcgaacgttaggtaggtacgggtaaccggtcctaattaccccgactacgtaccgtaacgaagtaacaaacccgtaaacgtaacgttaaacgtaactttacgtagactcgtaagaactaagtacgaactacgccagaaccggngaccggagcgtagtgttcgtaagttcgtagtagacgacggagtcggagtacgnggaggcgngtcgggtacgg

SEQ ID NO: 220895 - DNA, 854 bp, Homo sapiens
  misc_feature: GYAE6OF01B6GNG.18.87.H10.1.454.CMB.1.raw
  modified_base (319)..(319): a, c, t, g, unknown or other
  misc_feature (319)..(319): n is a, c, g, or t
tcagtacgagtatgcacgaccggtgctcgatttagcagtactgcgttgggtttgggaggagccttagcccctggactccaaggtcctttccacttggtgatcagcactgagcacagaggactcaccagtggtaagttggggctgagtcgttgggttttccttcggtttgtctttaagttttaagaaggttcgtccgtaggtgtgacgtgcagcgtggtagggaggttcggtgggggaggtcgtttcggtcccgtacgggtccgggttccggggggtcccctggacgtaccttccgtccgtggtcgcgacggtcctgctnttactatttactttaattagttagttggtatcgtacctcggtcggtcccgacggtacgggtccgggtaccggggggaggggtccgggtggggtacggggtccggaccgaaacgtaagtaagtacgacgaaaggtagtaacggtaagtaggtaaagtaaagtaacgttaggttaggtacggtaaccgttcggtaggtacgggaaccgggtacctaccgttacccaaccttacgtacccgtacgaaacgtaacaaacctaaacgtaaactaaaccgttaactttacgttaagtaccttaagtacgtaaacgtaaaacgtcgaaaaccgtacccgttccgaacggaacggtaacccggttaccggaaacggggtaacccgtccgggttttacgttaaggtttcgtttaaacggttccggagggttacgggaaacgaagggtaccggttgggtaaccgggttggaacccgggttaaggcggtacgggttaccgggtaccgggttccgggggaaacggggtaaccccgggtaaacccggg

SEQ ID NO: 220896 - DNA, 931 bp, Homo sapiens
  misc_feature: GYAE6OF01CD9G7.18.87.H10.1.454.CMB.1.raw
tcagtacgagtatgcacgaccggtgctcgatttagcagtactgcgtttgggtttggggaggtctcagagaggagccttagccctggactccaaggcctttccacttggtgatcagcactgagaacagaggactcaccagtaggaagttggggctgagtccgttgggttttcctcgttgtcttagttttagaaggtgtccagtgtgagtgcagtcgtggtggaggtcggtgggggacgtcgttcggccgacggtccggtcgggggtccctaggacgtacctcgtccgtgtcgcgacggccctgtctacttctaatttactttaagttagttgttaggattcggacgtacggttccgggtcccgaccggtacgggaccggtaccggggggaacgggtccgggtagggtcgggtacggaaccgtaaacgtaagtaacgtaggaaccgtaaggtaggtaacggtaaacgaggaaagtaaacgtaacgtgttaggtaccggttaactcggttaagggtaaccggaacgggttaccccttaacgttacccgaaccgtaccgttaccgtaaacccggaagtaaaacccgaaaccgtaaaccgtaaaaccgttaacgttaaaaccgtttccggttaaacgttaacgtttaaccgtaacgttaaaacccgtaaaggttaacccgaacgtacccgtaacccgggtaaacgaacggggtaacccggggaccggtaaaacggggtacccctacggggtttaacgttacgggtttaaacccgtttaaaggttacgggttttaaaccggaaccggggttaaacgggaaaccgggttttaaaacggacccccgggtttaaaggggggttaacccgggttaacccggggtttaaaacggggccgtttaaaggggggggtttaacccccgggtaaaccccgggggggg

SEQ ID NO: 220897 - DNA, 727 bp, Homo sapiens
  misc_feature: GYAE6OF01BTWII.18.87.H10.1.454.CMB.1.raw
  modified_base (709)..(709): a, c, t, g, unknown or other
  misc_feature (709)..(709): n is a, c, g, or t
tcagtacgagtatgcacgaccggtgctcgatttagcagtactgcgttgggtttggggaggtctcagagaggagccttagccctggactccaaggtcctttccacttggtgatcagcactgagcacagaggactcaccagtggaagttggggctgagcgttcgggtttttcctcggttgtctttaagtttttaggaaggtgtccagttggtgacgtgcaggcgtggtggagtcggtgggggagtcgttcggtccacggtccggtcgggggtccctggacgtactccgtcctggtcgccgacggtccctgcctacttcgtatttacgttttaagttacgttagttcggatcgccggtacggttcggggtcccgccgtacggggtaccgggtacggggggaacggggaccgggtgggtcgggtacggaccaaacgtagtaagcgaacgaagtacgtaacggacgtaaggaagtaaacgtaacgtaggtcgtagtaccgtgtacgggtaggacgggtcctaagtacccacgtacttcccagaaagaacaaacctaaacgtaacgttaactaaacgttctagtaactcgactaataacgtacgaactccgaccgtagacggtaccgacgggtacgacgtaccgtggttacgtaacgttacgttacggcggtaggtaccggaagagtcgggttaagggtccggagggttaacggngttaccggggtaacgggg

SEQ ID NO: 220898 - DNA, 898 bp, Homo sapiens
  misc_feature: GYAE6OF01BIRKV.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagacggactcaccatggaattggggctgagtcgttgggttttcctcgttgtacttagttttagaaggtgtccgagtggtgacgtgcgtagtcgtgggtggagtcggtggggagtcgttggtacccgtacggtcccggtcggggggtccctggtacgtaccttcgtccgtgtcggccgtacggtcccctggactacttcgtaactttaccgttttaagtacggtttaagttcgggaattcgggcctaaccgggttccggggtacccgacccggtacggggtacccgggtaccccgggggggaacgggggtccgggtacggggtttcgggggtaaccggaaccccgtaaacggtaacgtttaaaacggcggtaaccggtaaaggtaccggttaacggggaaccttaagggaaacggtaaaacgtaaccgttagggttacgggtacggtaccgtttacgggtaggtaccgggtaacgggggtacccttagtaaccccgacgtaacgttccgttaaccgaacggttaacaaccgtaaacctaacggttaaaccttaaccgtttacgttacgtaacttaccgtcggaaacctaaagtacccggtaaaccttaccgggacccttaaccggacggtaaccggtacccgggtaaccggaccggtaacggttacgttccggttaaagttacccggttacgtcggtaaaccggttacggaacggtaccggttacggtaacgggttcggtaccgggtaaacgggtccgggtaccggttaacgggg

SEQ ID NO: 220899 - DNA, 757 bp, Homo sapiens
  misc_feature: GYAE6OF01BBH3E.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagagactcaccagtggaagttggggctgagtcgttgggttttcctcgttagtcttattttagaggttgtaccaggtgtgacgtgacgagtctgggtggaggtcggtgggggagtcgttcggtccgaggtccggttcgggggtccctgacgtacttcgtccgtgtcgcgaccggtccctggacttattctaattactttagtagtttagttggatcgctaccggtcggcccgcgtacggccgggtacgggggacgggccgggtagggtcgggtacgaccgtaactagtaacgtcgaacgtaaagcgtaacggggaacttaggaaacggtaaacgtaacgtaggttacggtccgttaacgtaccggtagggtaaccgggaacgggtaccgttaacgttacccgtaacctacgttaccccgtacaaacgaaccgtaaacctaaccgaacgttaaacgtaacctttacgttacgttacgttacgtacgtaacgtaaacgtaccgaaccgtcgtacccgtaagacgggtaaccggaccgtaaccggaccggtacggtcgttaggttagttaccgttcgggtgtaccggtaaggacgagaccgggtagggtacggacggtggtaccgtaagggtccggg

SEQ ID NO: 220900 - DNA, 854 bp, Homo sapiens
  misc_feature: GYAE6OF01DD6AU.18.87.H10.1.454.CMB.1.raw
  modified_base (567)..(567): a, c, t, g, unknown or other
  misc_feature (567)..(567): n is a, c, g, or t
tcagtacgagtatgcacgaccggtgctcgatttagcagtactgcgttgggtttgggggaggcttggtccagccgtgggggtccctgagactctcctgtgcaggccctgcattcattcttttaatagttattggatgctacgtgggcccgccgaggccgtcgggggaagggccggaggtgggtcgaccaaacataagtgactaagagtggaaactgaacgaaagtaacttagtcggtaggtacctgttggtagggaaacgggcctattaccaacctatcctaccgaagaacgaacaaacgtaactaaagtaacctttacgtagttaactccgtagaaactaaaaagttacgaaaccgcgtcccttaagaaggaccggccggaaacggtaccgaacggtctttaggttagtttaaacgttcgtggtaccggaaacggaaaggtcgtaccgaaggggttcgggaccgttaaggggtacctaggggtttaccggggtaacccgtttccgggggacgggggaaaaccccgtaaacggggtaccccggtacgttcccccgtaaccgtttcccncccgtaacgacccggtcccgtaacccggtacccggacccggtacccgttacgttccccggtaccccgtttccccggcgtcccgtcccgtcggcccgtaaccggacgcccgtacccgtacccgtaccgacggaccgaccgaacggtcccgggcccgtccggacgggtcctacgggtacccgtacggtaaccgtaacgttacccgtacccttaccgtaaccgtacccgttacgggtcgtaccgggtacggacccgggtcgtaaccgggagtaaccgggctacggtaacg

SEQ ID NO: 220901 - DNA, 898 bp, Homo sapiens
  misc_feature: GYAE6OF01C3P7J.18.87.H10.1.454.CMB.1.raw
  modified_base (154)..(154): a, c, t, g, unknown or other
  misc_feature (154)..(154): n is a, c, g, or t
  modified_base (881)..(881): a, c, t, g, unknown or other
  misc_feature (881)..(881): n is a, c, g, or t
tcagtacgagtatgcacgaccggtgctcgatttagcagtactgcgtggagtcgtggggggaggcttggtccagccgtggggggtccctgagactctcctgtgcaggccctgctattcattctttaatagtttattggatgcacgtcgggtcccnccgagggcggtccggggggaaggggccgggtaggtcggggtcgacccaactataactgacgaaagagtagggaactaggaagaaaagtaacttagtggtaggtacttcgtaggtacgggaacgggtcctaattccaacctactaccgtaccaaggaacgaaccaaacctaaacgttaaacgtaacctttacgtagttactacgtaataaccaaaagtcaaacgtactcctagaaggaaccggtaccgaagggccgtacgggtcttgggttacttaaacgttgagggtacggaacgtaaggacgtacgtgggttacggaccgggtagggaactcggggttacgggaccggttacggggaacccgggggaaccgaaacggggtaccccgttaccgggtaaccccgtacccggtttccgtaccccgtccgtaacccgtacccgtaaccccgaaaccgggtaacccgggtaccccgtaaccggtttccccggttccccgttcccccgggtcgtacccccgttcccggtaccgtcccgtaccggtaaccggtacccgtaacccgtacccggtaaccggaacgtaaccggacccgtaccggtacccgggtcccgggtcccggttaccggggtcgtcccgggtaccgttaccgggaaaccgttaacccggtacccttacccgttaccccttaagttacccgttaacggtacggtcgggtacgggtaccgggtanaccgggtacgcggtacg

SEQ ID NO: 220902 - DNA, 794 bp, Homo sapiens
  misc_feature: GYAE6OF01A249J.18.87.H10.1.454.CMB.1.raw
tcagtacgagtatgcacgaccggtgctcgatttagcagtactgcgttgggtttggggaggtctcagagaggagccttagccctggactccaaggcctttcccacttggtgatcagcactgagcacagagactcaccataggaagttggggctgagcttgggttttcctcgttgcttattttagaaggtgtaccagtgtgacgtgcagtctggtgggagtcggtgggggtaggtcgttggtaccgaggtcccggtgggggtccctggagtacctcgtccgtggtcgcaccggccctaggctattactaactttacctttaaattagtttagttacgggtaacttcggaccgttaacggtcgggtccccggacccggtacggggaccggggttaacccggggggaccgggggtaaccggggtagggttacgggggtaccgtaacccgaaacgtaacgtaattaccggggaactaaaaggcgtaagggtaaacgtaagggaaacggtaaaaggtaaaccgttaggttacggtaaaccgggtgttaacgtacgggtaacggggaaaaccgggtcgttaacttccggtaaaccttacgtcctaacccgtaagaaaccgaacgaacgtaaactaaacgtttaactacttacgtaactacgttaaccgaataaacgacaaacgccgtacgtacgaaacgggaccgtaaccggaagaccggtacgtgtaagttacgttagttacgtagacggtaagtaacggacgtgaaggttccggtaacggcggtaaagtacgggtacgg

SEQ ID NO: 220903 - DNA, 876 bp, Homo sapiens
  misc_feature: GYAE6OF01BXH05.18.87.H10.1.454.CMB.1.raw
  modified_base (771)..(771): a, c, t, g, unknown or other
  misc_feature (771)..(771): n is a, c, g, or t
tcagtacgagtatgcacgaccggtgctcgatttagcagtactgcgttgggtttgggggaggcttggtccagcctggggggtccctgagactctcctgtgcaggccctgcattcattctttaatagttattggatgcactgggtccgccgaggcgtccgggggaaggggccggagtcgggtgaccaacataatgacaagagtaggaactggaagaaacgaacttatggtaggactcgtggtaggaacgggcctaacttcaacctatcctaccgaagacgaacaaacactaaaagtaacttactagtactcgtacgaactaaaagtcgaaacgacgtacctacgaacggaccgtacccggaaagggacccggtaacggtccgttagggtttacgtttaaacgtttacggtaggtaaccggaacggaaaaggcggtaccgtaagggttccgggaacggttggggaaaccttgggtaccggggtacccgggttacggggttacccgggggaaaacccggtaaaccggggcccgttaaccgggtaccccctacccgggttacctttacccgaacccgaacccgggttcccccctaaacccgggtaacccgggtaaaccccgggccccgttaaccggtttcccccggttacccccgttcccccggacgggccccctacccggtagtaccccgtaccgggaccgtacccgtacccctacccgggaaccggtacgccgtaaccgacccgtacggggccccgggtaccggtagggtcccncggtaccggtaaccggtaaccgaaccgttacctacccgttaacaccgtttaccgaacggttcggacggtaccgggtcgacgtcggaaccgaggtcccgaagtacg

SEQ ID NO: 220904 - DNA, 812 bp, Homo sapiens
  misc_feature: GYAE6OF01BXB7Z.18.87.H10.1.454.CMB.1.raw
  modified_base (235)..(235): a, c, t, g, unknown or other
  misc_feature (235)..(235): n is a, c, g, or t
  modified_base (751)..(751): a, c, t, g, unknown or other
  misc_feature (751)..(751): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagtcgttcgggtttttccctgttgtcttagttttagaaggttcgtccagttgtgacgtgcagcgtggtggagtcggtgggggngtcgttcggtccaggtccggtcgggggtccctaggacgacctcgtaccgtgtcgcgacggtccctgaccttattactatttaacttttaagtagtttatggtatcgaccgtacggttccgggtcccgacgtacgggtccgggtaccgggggacggggtaccggtagggtacgggtccggaaccctaaacgtaacgttaagtccggaaacgtaaggtacgttaacggaaacgttagggaaaacggtaaacgttaacgttagtacgggttacggttacctggttacggtaacgggacgggtttacccacgtttacccgaacgtacttcccgaaaccggtagaaacccgtaaacgaaaccgtaattaaaccggttaaaccttccgtaaggttacctacgaacgtaaacacgttacgaaccgtcgaaccccgtaggaaccgtacccgggaccggtaacggccgtacggtttaacgttggttaaacgttcgttacggtacgggttacaaacccggggttanaagggggttaccgacgggtttacggggtaacgaacggggttaccagggggtttaccccggg

SEQ ID NO: 220905 - DNA, 852 bp, Homo sapiens
  misc_feature: GYAE6OF01AD319.18.87.H10.1.454.CMB.1.raw
tcagtacgagtatgcacgaccggtgctcgatttagcagtactgcgttgggtttggggaggtctcagagaggagccttagccctggactccaaggtcctttccacttggtgatcagcactgagcacagaggactcaccatggaagttggggctgagtcgttgggttttcctcgttgcttagtttagaaggtgtccagtgtgacgtgcagcgtgggtggaggtcggtggggggaggtcgttcggtccgacggtccgggttcgggggggtcccctggacgtaccttccgtcccgtggtcgccgacgggcccctgacctatttctatttacttttaattagttagttggatgtcgacgttcgggtacccgccgacgggtccgggtaccgggggggaaggggcccgggtagggtcggggtaccggaccaacgaagttaagtcgacgaagtaggtaggaactaggaaaggtaaagtaacgttagtacggtacggtaaccgttcgttagggtaacgggaaccggggtcccttaagttaccccaaccgtacttacccgttaacccgaaaggaacccgtaaacctaaaaccgtaaaccgttaaaacggtaaacccttttacgttacgttaaccttacgtaacgtaaactaaacgttacgaaaccaaccggtacccctacggtaaacgggaacccggtaacccgggaacgggaacccgttaacccgggtcgttttaacgggttaacgttaaccggtttacggttaggggttaaccggaacgggtaaaacgggcggtacccgggttaaggggttaccgggtaacgggttaagggggtaaacccgtaggggttaacccgggggg

SEQ ID NO: 220906 - DNA, 879 bp, Homo sapiens
  misc_feature: GYAE6OF01CMF7I.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacgagaggacctccaaccatgggaagttgggggctggagtcgttcggggtttttccttcggttgtctttagtttttaaggaaggttgtccaggtgtggtacgtgcaggtcgtgggtaggaggtcggtggggggtaggtcgttcgggtccgaggtcccgggttcgggggggttcccctggacgtacctccgttccgtggtacgccgaccggtcccctgactacttacctatttaaccttttaaagttaggtttaagttaggtattgaccgtacggtccgggtaccgccggagggtccgtaccgggaggggaacgggggtccggtaagggttcggggtccggaacctaaaacgtaagttaaacgacggtaacgaaaaggtacgtaacgggtaacgttaaggaaaacggtaaaacggtaaacttaaggtcgggttaaccggtactttacggggtcgggttaaaaggggaaccggggttaaccttaacttacccgtaaccgtaaccgttacccttaaccggaacggtaaacgaaaccctaaaaccggtaaacgttaaaaccggtaaacctttacggttacgtacgttaactaacgaacttaaagaaccgaaactaccgtacctaacgtaaggacggtacccggaaggacccgtaacgtcgttattaacggtattacggcgttacggaacggtaaggtacgacggtgggtccgggtaaggcgggtaacgtacggttaacgggtccgggttacgggaccgggggtaaaccccggg

SEQ ID NO: 220907 - DNA, 837 bp, Homo sapiens
  misc_feature: GYAE6OF01DY9OP.18.87.H10.1.454.CMB.1.raw
  modified_base (421)..(421): a, c, t, g, unknown or other
  misc_feature (421)..(421): n is a, c, g, or t
  modified_base (739)..(739): a, c, t, g, unknown or other
  misc_feature (739)..(739): n is a, c, g, or t
tcagtacgagtatgcacgaccggtgctcgatttagcagtactgcgttgggtttgggaggagccttagccctggactccaaggcctttccacttggtgatcagcactgagcacagaggacctcaccatggaagttggggctggagtcttcgggtttttcctcgtttgtcttagtttttaaggaaggttgtccagttgtgacgtgcagcgtgggtggagtcggtggggggaggtcgttcgggtccgacggtcccggttcgggggggttcccctggacgtacctcgtccgtggtcgcgacggtccctgctacttcaattactttaatgtttagtggatgctacgtcgggtccgcgtcggccggtaccgggggaacggggccggtagggtcgggtacggaccaactaagtaacgtggacaaaggngtacgggaactaggaagtaaacgtaacgtagtcggtacggtaacttcggtaggtacgggtaacgggtaccgttaactacccgaaccgtacttacccgtaacccggaagtaaaccggaaacctaaaaccgtaaacgtttaaaacgtaaaaccgtttcgttacgttaactttacgtaaggaaaccgtaaaagttaaccggaacctacccggttaaccgtaacggaaacgggtaccggtaaccccggggtaaaagtccggtaccgggtaactttgggttaacgtttaacgttacggtggaacggaagggttaaacccgggnggtaacccgttagggggtccgtaacgggtcggggtaaacccttgggggttacccgggtaaccgttacgggggtacccgggaacccggttaaccggggg

SEQ ID NO: 220908 - DNA, 731 bp, Homo sapiens
  misc_feature: GYAE6OF01EYZTC.18.87.H10.1.454.CMB.1.raw
  modified_base (365)..(365): a, c, t, g, unknown or other
  misc_feature (365)..(365): n is a, c, g, or t
  modified_base (664)..(664): a, c, t, g, unknown or other
  misc_feature (664)..(664): n is a, c, g, or t
  modified_base (712)..(712): a, c, t, g, unknown or other
  misc_feature (712)..(712): n is a, c, g, or t
  modified_base (720)..(720): a, c, t, g, unknown or other
  misc_feature (720)..(720): n is a, c, g, or t
tcagtacgagtatgcacgaccggtgctcgatttagcagtactgcgttgggtttggggaggtctcagagaggagccttagccctggactcccaaggcctttccacttggtgatcagcactgagcacagaggactcaccatggaagttggggctgagtcgttgggttttcctcgttgctattttagaggtgtcagtgtgacgtgcagcgtgggtggagtcggtggggggacggtccgttcgggtccacggtcccggtcgggggggttcccctggacgtccttccttccgtggtcgcgaccggcccctggactattctattactttaagttagtttagtggatcgcgtaccggtcgggtccgaccggngggacccgggtccggggggaacgggggtccgggtagggtcggggtaccggaacccgaaacgtaagtaaactgaacgaaacgtagtaacggaacgtaggaaacggaaacgtaacgttaggttacggtacggtacttcggtacgggtacgggaacgggttccctaacgttacccacctacgtacctacccgaaggtaaccaaacctaaaccgtaaaccgttaaacgttaacctttagtaacgtacctacgtacgaactaagaccgaaacgcgtaccctagacggacgaccggtacgacggngtacgttgtattacgtagtggtacgaggagtaggcgtacgggtcgganacgggtcncgggttacggg

SEQ ID NO: 220909 - DNA, 672 bp, Homo sapiens
  misc_feature: GYAE6OF01EH40B.18.87.H10.1.454.CMB.1.raw
  modified_base (296)..(296): a, c, t, g, unknown or other
  misc_feature (296)..(296): n is a, c, g, or t
  modified_base (366)..(366): a, c, t, g, unknown or other
  misc_feature (366)..(366): n is a, c, g, or t
tcagtacgagtatgcacgaccggtgctcgatttagcagtactgcgttgggtttggggaggtctcagagaggagccttagccctggactcccaaggccctttccacttggtgatcagcactgagcacagagactccaaccatggaagttgggctgagtcgtttgggtttttcctggttgtactttaatttttaggaaggttcgtccgtagtgtgacgtgcagtcgtggtggaggtcgggtgggggagtcgttcggtccgacggtccggtcgggggtccctgacgtcctccgtcgtgngccacggccctgctattactatttacgtttaattagtttagtgatcgccgacggttcgggcccgaccggnggccgggacgggggaacgggcggaggtgggacgactaagatagacgagaagagtacgaagagaagaagtacgttagtcgtagtactggtagtaacgggtactacgttactaccacctatcctagaacgtaacaaactaaccgtaacttaaacgttaccttacgttagtactacgactaacgaacgtacgaaccgaccgacctacggaacggaccggaacggaccggaccggtaccgtagttaccgtatttacgtcgttagacggacgaacgcgtacggtagtcggagtcggtagtcggtaccgggg

SEQ ID NO: 220910 - DNA, 252 bp, Homo sapiens
  misc_feature: GYAE6OF02HZ6RZ.18.87.H10.1.454.CMB.1.raw
  modified_base (251)..(252): a, c, t, g, unknown or other
  misc_feature (251)..(252): n is a, c, g, or t
tcagtacgagtatgcacgaccggtgctcgatttagcagtactgcgttgggtctgggacagacttcactctcaccatcagcagactggagcccgaagatttgcagtgtattactgtcaacagtgtgctgaggtacctctcacgttcggcggagggaccagggtggacatcaagcgaactgtggctgcaccatctgtcttcatcttccgccatctgacatactcgtactgagcgggctggcaaggcgcatagnn

SEQ ID NO: 220911 - DNA, 252 bp, Homo sapiens; identical to SEQ ID NO: 220910
  misc_feature: GYAE6OF02ILGF6.18.87.H10.1.454.CMB.1.raw
  modified_base (251)..(252): a, c, t, g, unknown or other
  misc_feature (251)..(252): n is a, c, g, or t

SEQ ID NO: 220912 - DNA, 255 bp, Homo sapiens
  misc_feature: GYAE6OF02H5HBF.18.87.H10.1.454.CMB.1.raw
  modified_base (253)..(255): a, c, t, g, unknown or other
  misc_feature (253)..(255): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatagnnn

SEQ ID NO: 220913 - DNA, 466 bp, Homo sapiens
  misc_feature: GYAE6OF02IIATA.18.87.H10.1.454.CMB.1.raw
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
  modified_base (178)..(183): a, c, t, g, unknown or other
  misc_feature (178)..(183): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(194): a, c, t, g, unknown or other
  misc_feature (192)..(194): n is a, c, g, or t
  modified_base (198)..(198): a, c, t, g, unknown or other
  misc_feature (198)..(198): n is a, c, g, or t
  modified_base (204)..(205): a, c, t, g, unknown or other
  misc_feature (204)..(205): n is a, c, g, or t
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (305)..(307): a, c, t, g, unknown or other
  misc_feature (305)..(307): n is a, c, g, or t
  modified_base (310)..(311): a, c, t, g, unknown or other
  misc_feature (310)..(311): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (325)..(326): a, c, t, g, unknown or other
  misc_feature (325)..(326): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcggngttcgctaggcnttanagncnnnnnncngcngngnnngggngctgcnncnggggccnganctcnctgngcaggcctgcattcatcttaatagttattggatgcactgggtccnccaggctccggggagggccgagtggngcacntaannnagnngangaganactngnntngagacgcatcacatcacagacaacaacactaagtacttactagtatcanacaatacgaacacgacacacgacgacgacgacgacgacgtgtagtagttactagtacgacgagagacgagtggacgacggacgagtcgg

SEQ ID NO: 220914 - DNA, 517 bp, Homo sapiens
  misc_feature: GYAE6OF02HYB7Q.18.87.H10.1.454.CMB.1.raw
  modified_base (428)..(428): a, c, t, g, unknown or other
  misc_feature (428)..(428): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggtttcctcgttgctattttagaaggtgtccagtgtgacgtgcagctggtggagtctgggggaggcttggtccagcctggggggtccctggagactctcctgtgcaggccctgcattcatctttaatagttattggatgcactgggtccgccaggctccgggggaagggccggagtgggtggccaacataatgacaagatggaactgagaagaactatgtggactctgtgaagggccattcacatctccagagacaacactaagaacttacngtatctgacaaatgaacagcctacagacgccgaagacacggctagtagtattacgtgtgacgaagagcaggtggacgtgggacagtcgg

SEQ ID NO: 220915 - DNA, 625 bp, Homo sapiens
  misc_feature: GYAE6OF02H190I.18.87.H10.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagtacgagtatgcacgaccggtgctcgatttagcagtactgcgtgggtttggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccattcaccatctccagagacaacactaagaacttactgtatctgacaaaatgaacagcctcagagccgaggacacggctgtgtattacngtgcgaagngcagtggctgggacagtggacgtcgtggggaccaaaggggaccacgggtccaccgtctcctcacgcctaccaccgaacggcccacgtccggtccttccccgtcggccgcccgtcgccctccgacggacgcccacccgtccgacgacgaccgaaccgacggcccggcccgtcgggcctccggcccgtcgggtaccgaacgggtaccttacccgtttaccccgaacttaacccgttaccggttaaccgtacggaccggtccggggtaccgtacgggaccgtaacgggcccgtacgtaacgg

SEQ ID NO: 220916 - DNA, 252 bp, Homo sapiens
  misc_feature: GYAE6OF02F3VGP.18.87.H10.1.454.CMB.1.raw
  modified_base (252)..(252): a, c, t, g, unknown or other
  misc_feature (252)..(252): n is a, c, g, or t
tcagtacgagtatgcacgaccggtgctcgatttagcagtactgcgttgggtctgggacagacttcactctcaccatcagcagactggagcccgaagatttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatagn

SEQ ID NO: 220917 - DNA, 519 bp, Homo sapiens
  misc_feature: GYAE6OF02H4NG8.18.87.H10.1.454.CMB.1.raw
  modified_base (435)..(435): a, c, t, g, unknown or other
  misc_feature (435)..(435): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgtggtttccgtcgtagctattttagaaggtgtccagtgtgacgtgcagctggtggagtctgggggaggcttggtccagcctggggggtccctgagactctcctgtgcaggccctgcattcatctttaatagttattggatgcactgggtccgccaggctccggggaaggggccggagtgggtggccaacgataatgcaagatggaactgagaagaactatgtggactctgtgaagggccgattcaccatctccagaagtacaacacttaaagactttaacngtaatctagcaaatgaaacagcctcagagccgaggacctagctgtgtattactgtgcgaaggngcnggtggcgtggactagtgg

SEQ ID NO: 220918 - DNA, 537 bp, Homo sapiens
  misc_feature: GYAE6OF02JBMDZ.18.87.H10.1.454.CMB.1.raw
tcagtacgagtatgcacgaccggtgctcgatttagcagtactgcgtggagtctgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctggggacatggacgtctggggccaaggggccacggtcaccgtctcctcagcctccaccaacgggcccatccggtccttccccctggccgcccctgcctcccgacgggacgccaccctccgagacgcacacgccggccctgggcctgcctcggtcaacggactacttcccattacctcgtactgacgccgggctcggcaggcg

SEQ ID NO: 220919 - DNA, 256 bp, Homo sapiens
  misc_feature: GYAE6OF02GMT2W.18.87.H10.1.454.CMB.1.raw
  modified_base (252)..(256): a, c, t, g, unknown or other
  misc_feature (252)..(256): n is a, c, g, or t
tcagtacgagtatgcacgaccggtgctcgatttagcagtactgcgttgggtctgggacagacttcactctcaccatcagcagactggagcccgaagatttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatagnnnnn

SEQ ID NO: 220920 - DNA, 296 bp, Homo sapiens
  misc_feature: GYAE6OF02HU0XN.18.87.H10.1.454.CMB.1.raw
  modified_base (275)..(296): a, c, t, g, unknown or other
  misc_feature (275)..(296): n is a, c, g, or t
tcagtacgagtatgcacgaccggtgctcgatttagcagtactgcgttgggttcgtggggacagacttcacctcgtcaccatccagccagactggagcccgaagattttgcctagtgtatttacgtgtcaacagtgtgctgaggtaccgtcgtcacggttcggcggagggacccaagggtggacatcaagcgaactgtggctgcaccatctgtcttcgatcgttcccgctaatcctgacatactcgtactgacgcgggctggccaaggcgcatagnnnnnnnnnnnnnnnnnnnnnn

SEQ ID NO: 220921 - DNA, 515 bp, Homo sapiens
  misc_feature: GYAE6OF02F9E7A.18.87.H10.1.454.CMB.1.raw
  modified_base (451)..(451): a, c, t, g, unknown or other
  misc_feature (451)..(451): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccattcacatctccagagacaacactaagaacttactgtatctgacaaatgaaacagcctanagagccgaggacacggctgtagtattactgtcgacgaagagcaggtggcgtgggacagtacggg

SEQ ID NO: 220922 - DNA, 568 bp, Homo sapiens
  misc_feature: GYAE6OF02HMZTH.18.87.H10.1.454.CMB.1.raw
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (202)..(203): a, c, t, g, unknown or other
  misc_feature (202)..(203): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcggtgttcgcgtaggcgtnttagagngtcagtgnacgtgcagctgnganngggagctgcagcctggggtcctgagctntcctgtgcaggcctgcattcatnttaatagttattggatgcncgtcggtcgcgacggcggtacgggacgggcggaggtgggtcgacgaacgataagtagacgaagagtagaacgtagaagaagaacgtagtagtagtacgtacgtagtacggtacggtacgtacgtacgactactactacgacgaacgaacaactaacgtaaacgtaaacgttaactacgttactacgtacgaactaataagaacgacgacacgacgacgacgacgacgacgtacgtagtagtacgtacgtagtacgacgacgagacgacggtacggtacgtacggtacgagtacgg

SEQ ID NO: 220923 - DNA, 586 bp, Homo sapiens
  misc_feature: GYAE6OF02G56R7.18.87.H10.1.454.CMB.1.raw
  modified_base (262)..(262): a, c, t, g, unknown or other
  misc_feature (262)..(262): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (578)..(578): a, c, t, g, unknown or other
  misc_feature (578)..(578): n is a, c, g, or t
  modified_base (581)..(581): a, c, t, g, unknown or other
  misc_feature (581)..(581): n is a, c, g, or t
  modified_base (584)..(585): a, c, t, g, unknown or other
  misc_feature (584)..(585): n is a, c, g, or t
tcagtacgagtatgcacgaccggtgctcgatttagcagtactgcgttggggtttgggggaggcttggtccagcctggggggtccctgagactctcctgtgcagtctcgtgggttcgtcagtggccgacgtacatgagctgggtccgccaggctccagggaggcctggagtggatctcattatttataggtggtggtaccacatacgtacgacaggactccgtgaagggccattcaccatctcagaagacaattccaggaacncatgtatcttcaaatgaataacctgagagccgaggacacggccatcgtattactgtgtgggctatttactgacccgtggggccggggaaccctggtcaccgtcgtccccacctccaccaacgggcccagtccggtccttccccgtggcccaccctccgtccaacgtacgccaacctccgtcgggggcacgtacgccggcccgtcggccgttcgcccgtggtccaacggacctaccgttcccattacccgtcgtaccgtcgacgccgggtcgtcggacgaagggccgcgaacgttacggcncgagcncgtcgcgcgncgngcnnc

SEQ ID NO: 220924 - DNA, 507 bp, Homo sapiens
  misc_feature: GYAE6OF02I9E36.18.87.H10.1.454.CMB.1.raw
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
  modified_base (502)..(502): a, c, t, g, unknown or other
  misc_feature (502)..(502): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctgggggggtccctggagactctcctgtgcaggccctgcattcatctttaatagttattggatgcactgggtccgcaggctccggggaagggccggagtgggtgccaacataatgcaagntggaactgagaagaactatgtggactntggtgaagggccattcaccatctcagagacaacactaagaacttactgtatctgacaaatgaacagcctnagacgccgaggacacggctgtntattctgtgcgaagngcaggtggctggganagtgg

SEQ ID NO: 220925 - DNA, 514 bp, Homo sapiens
  misc_feature: GYAE6OF02FYL3K.18.87.H10.1.454.CMB.1.raw
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatctttaatagttattggatgcacgtgggtccgccaggcgtccggggaaggggccggagtgggtggccaacgataatgcaagatggaactgagaagaactatgtggactctgtgaaggcgatcacatctcagagacaacactaagaacttactagtatctagacaaatgaacagcctacagagccgaggaccacggctgtgtattacgngtgcgaagngcgagtggctaggacagtcggg

SEQ ID NO: 220926 - DNA, 565 bp, Homo sapiens
  misc_feature: GYAE6OF02HPCB4.18.87.H10.1.454.CMB.1.raw
tcagtacgagtatgcacgaccggtgctcgatttagcagtactgcgttgggtttggggaggcttggtccagcctgggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctggggacagtgggacgtcgtggggccaaaggggaccacgggtcaccgtctcctcacgcctccaccgaacgggcccagtccggtccttccccgtcggccgcccgtcgcctccgacggacgccacctccgagacgcacacgccggcccgtgggcctcgccgtcggtacgaacggtaccttccttcccgaacttaccttccgtactcgacggcgggcgtggacgaacggcgacacg

SEQ ID NO: 220927 - DNA, 524 bp, Homo sapiens
  misc_feature: GYAE6OF02GEMCT.18.87.H10.1.454.CMB.1.raw
  modified_base (522)..(522): a, c, t, g, unknown or other
  misc_feature (522)..(522): n is a, c, g, or t
tcagtacgagtatgcacgaccggtgctcgatttagcagtactgcgtgggtttgggggaggcttggtccagcctgggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctggggacatggacgtctggggccaaagggccacggtcaccgtctcctcagccctccaccaagggcccatcggtccttcccctggccgcccctgcctccaggacgccacctccgagacgcacagccggcccgtgggcctcgcctggtacaaggtctactcccatacctcgtactgagcggctggcaggcnag

SEQ ID NO: 220928 - DNA, 598 bp, Homo sapiens
  misc_feature: GYAE6OF02GS5YO.18.87.H10.1.454.CMB.1.raw
  modified_base (446)..(446): a, c, t, g, unknown or other
  misc_feature (446)..(446): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccggggaagggccggagtgggtggccaacataatgcaagatggaactgagaagaactatgtggactctgtgaagggccattcaccatctccagagacaacactaagaacttactgtatctgcaaatgaacagcctcagagccgaggacacggctgtgtattactgtgcgaagagcagtggctgggacagtgggacgtcgtgggggccaaaggggaccacggtcaccgtctcctcagcctccaccaacggcccagtccggtcttcccctggccgccctcgccttccgacggacnccacctccgagacgccacgacgccggcccgtcgggcctcggcccgttcgggtaccgaacggtaccttaacccgttaccccgtaagttaacccttccggttaaccgttcggacggccggggtacttcggggaccgaacgggtccgacgtaacg

SEQ ID NO: 220929 - DNA, 604 bp, Homo sapiens
  misc_feature: GYAE6OF02HRGVK.18.87.H10.1.454.CMB.1.raw
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtcccctgagactctcctgtgcaggccctgcattcatctttaatagttattggatgcactgggtccgcaggctccgggaaggggccggagtgggtggccaacgataaatgcaagatggaactgaagaagaactntgtgactctgtgaagggcatcaccatcncagagacaaacactaacgaaactttactgtaactctagactaaaatcgaaacagaccctcgaagacgacccggaaggaacctaacgggcttacgggttacgtttaacgtttaaacccgtgggtttacgggaccggaaaaaggtacggaccctaaaggggttcggggacccggtttagggggaacccctaggttaaccggggg

SEQ ID NO: 220930 - DNA, 548 bp, Homo sapiens
  misc_feature: GYAE6OF02HFJ7R.18.87.H10.1.454.CMB.1.raw
  modified_base (471)..(471): a, c, t, g, unknown or other
  misc_feature (471)..(471): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatctttaatagttattggatgcactgggtccgccaggcgtaccgggggaaggggccggaggtggggtggccaacgataatgacaaagatggaactgaagaagaactatgtggactgtgtaggaagggtccattcaccatcctaccagacgacaacactaaagaactttactagtatactgacaaatgaacagcctanagacgccgaaggaccacggctagttagttacgttactggtcgacgaagagtcgaggtggcgtggggactagtacggg

SEQ ID NO: 220931 - DNA, 552 bp, Homo sapiens
  misc_feature: GYAE6OF02GL5TR.18.87.H10.1.454.CMB.1.raw
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagccgtggggggtccctgagactctcctgtgcaggccctgcattcatctttaatagttattggatgcactgggtcccgccagggccgtccgggggaaggggccggaggtggggtggccaacgataatgcaagatggaactgagaagaactatgtgactctgtgaagggccgattcaccatctccagagacaacactaagaacttacngtatctagacaaatgaaacngcctcagacgccggagaccgacggtctgtagtacttacgtgtgacgaagtacgcaggtggaccgtgggactaggtcgggacggttcgtcgggggaccctaacggggg

SEQ ID NO: 220932 - DNA, 252 bp, Homo sapiens
  misc_feature: GYAE6OF02II8UH.18.87.H10.1.454.CMB.1.raw
  modified_base (245)..(245): a, c, t, g, unknown or other
  misc_feature (245)..(245): n is a, c, g, or t
  modified_base (251)..(252): a, c, t, g, unknown or other
  misc_feature (251)..(252): n is a, c, g, or t
tcagtacgagtatgcacgaccggtgctcgatttagcagtactgcgttgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctacatactcgtactgagcgggctggcaaggcncatagnn

SEQ ID NO: 220933 - DNA, 261 bp, Homo sapiens
  misc_feature: GYAE6OF02HBV80.18.87.H10.1.454.CMB.1.raw
  modified_base (252)..(261): a, c, t, g, unknown or other
  misc_feature (252)..(261): n is a, c, g, or t
tcagtacgagtatgcacgaccggtgctcgatttagcagtactgcgttgggtctgggacagacttcactctcaccatcagcagactggagcccgaagatttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatagnnnnnnnnnn

SEQ ID NO: 220934 - DNA, 608 bp, Homo sapiens
  misc_feature: GYAE6OF02IAV0W.18.87.H10.1.454.CMB.1.raw
  modified_base (330)..(330): a, c, t, g, unknown or other
  misc_feature (330)..(330): n is a, c, g, or t
tcagtacgagtatgcacgaccggtgctcgatttagcagtactgcgtggagtctgggggaggcttggtccagcctggggggtccctgagactctcctgtgcaggccctgcattcatctttaatagttattggatgcactgggtccgccaggctccgggggaaggggccggagtgggtggccaacataatgcaaagatggaactgagaagaactatgtggactctgtgaagggccattcaccatctcagagacaacactaagaacttactgtatctgacaaatgaaacagcctcagagccgaggacacggctgtgtattactgtgcgaaagngcagtggctgggacagtggacgtcgtggggaccaaggggaccacggtcacccgtctccctcacgccctacccaacccgaacgggccccagttccggtcccttccccccgtgggcccgcccgttcgccttccgacgggacgccacccgtccgacgacgccacgacggccggcccgtcgggctcggccgtggtaccgaaacgggtaccttaccttacccaattaccccgttccgttaaccgtcggaacggtccggggtaccgtcgggaccgaagggtccg

SEQ ID NO: 220935 - DNA, 609 bp, Homo sapiens
  misc_feature: GYAE6OF02FFCZV.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggtttcctcgttgctattttagaaggtgtccagtgtgacgtgcagctggtggagtctggggaggcttggtccagcctgggggtccctggagactctcctgtgcaggccctgcatcatcttaatgttatggatgcacgtggtccgccaggccgtccgggggaaggggcccggaggtgggtcggaccaacgtataacgtgactaagacgtaggaactggaagtaacgaactagtgtaggactcgtagtacggaacggggtccctaattccgaccgtacttccgtaccgaaggacgtaaccaacacgttaaagaacctttacgtgttaactcgtagacctaaaagtcgaacgacgtcccgtagacgtacgacccgaggtaccacgggtcttggtacgtacgttaacgtgtacggtacgtaagagccgtaggtcggacgtagggacctaggtacggg

SEQ ID NO: 220936 - DNA, 795 bp, Homo sapiens
  misc_feature: GYAE6OF02HPGGY.18.87.H10.1.454.CMB.1.raw
tcagtacgagtatgcacgaccggtgctcgatttagcagtactgcgttgggtttgggggaggcttggtccagcctggggggtccctgagactctcctgtgcagcctctggattcagtttcagtgcctactggatgcactggatccgccaagttccagggaagagactggtgtgggtctcacgtaattaaagatgagtgggggtgccacatcctacggcggactccgtggacggggccgcttcaccatcctcccgagaccaacaccaagaacacgctgtatctgacaaatgagcagtctgggagtcgaggacacggctgtctattactgtgacgaaggaggggtacctacgggtcgaccgttaacgggtagggggttcggtacccggaacccccgggttggggggaccccgaagggggtaaacccccgttgggtacccgtaaccccgggttccttaccccgtacgaaccggtcccctacccgaacccggaaaccgggacccctaacgtcccgggttccctttccccccgtacggtacccctacccccgtcccttaacccgaaacgtaccgacccgtacccgttaccgggtcgggggaaccctaaccgaccgggtaccccggggtccccggttacgggggtccctaccgggtccccggttcgggttaacccgaaaaccgggtaacccttacccgtttaccccgaacgtttacccggttaacggttaacccgtacgggtaaccgggcccgggtaaccggttcgggaccggaacggggccggtaaccgtacggttagacg

SEQ ID NO: 220937 - DNA, 252 bp, Homo sapiens
  misc_feature: GYAE6OF02GRFGC.18.87.H10.1.454.CMB.1.raw
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttcccgccatctgacatactcgtactgagcgggctggcaaggcgcatag

SEQ ID NO: 220938 - DNA, 619 bp, Homo sapiens
  misc_feature: GYAE6OF02GBK0R.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtccgccgaggccgtccgggggaaggggccggaggtgggtggaccaacataagtgacaagataggaactgaagaagaactagtgtaggactcgtggtaggaaggggcctaattccaacctatcctaccagaacgaaccaacaactaaacgtaaactttaccgtagttaactctagaacctaaaagtcgaaaccacgaccctacgaaggacgacccgtaaggaccgaccggcgttggtacgttaacgtttaacgtggtacggaacggtaaaggacgtacgaagggtccggacggtaggggtaaccaggtacgggg

SEQ ID NO: 220939 - DNA, 544 bp, Homo sapiens
  misc_feature: GYAE6OF02GXDEI.18.87.H10.1.454.CMB.1.raw
  modified_base (426)..(426): a, c, t, g, unknown or other
  misc_feature (426)..(426): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagccgtggggggtccctgagactctcctgtgcaggccctgcattcatctttaatagttattggatgcactgggtccgccagggctccgggggaaggggccggaggtgggtggccaacataatgcaagatggaactgaagaagaactagtgtggactcgtgtgaagggccgattccaccatcctccagagaacaacactaagaacttangtatctgacaaatgaacagcctacagacgccgagacncggctgtntattcngtacgacgaagngacgaggtcggcgtaggggactaggtacggaccggtcgtcggggacctaacgggg

SEQ ID NO: 220940 - DNA, 546 bp, Homo sapiens
  misc_feature: GYAE6OF02J2R1Y.18.87.H10.1.454.CMB.1.raw
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
  modified_base (493)..(493): a, c, t, g, unknown or other
  misc_feature (493)..(493): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatctttaatagttattggatgcactggtccgccaggcgtccggggaaggggccggaggtgggtggccaacataatgcaagatggaactgaagaagaactagtgtaggactcgtggtgaaggggccagttcaccatctccagacgacaacactaagaactttacngtatctgactaaatcgaaacngcctacgagacgcccgaggaccacggcttaggtntacgttactgtagacggtaagagcgaggttggcgttaggggactaggtacggg

SEQ ID NO: 220941 - DNA, 538 bp, Homo sapiens
  misc_feature: GYAE6OF02FXOTO.18.87.H10.1.454.CMB.1.raw
  modified_base (535)..(535): a, c, t, g, unknown or other
  misc_feature (535)..(535): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccggggaaggggccggagtgggtggccaacataatgcaagatggaactgagaagaactatgtggactctgtgaagggccattcaccatctccagagacaaacactaaagaacttactgtatctgcaaatgaacagcctcagagccgaggacacggctgtgtattactgtgcgaagagcagtggctggggacatggacgtcgtggggccaaggggaccacggtcaccggtctcctcacgcctccaccaacgggcccatcggtcttcccctcggccgccctcgcctccacggacgccacctccgagacgcacgacgccggccctgggcctcgcctggtcaaggactaccttcccatacctcgtactgagcggctggcacggcgnacg

SEQ ID NO: 220942 - DNA, 589 bp, Homo sapiens
  misc_feature: GYAE6OF02JSBYE.18.87.H10.1.454.CMB.1.raw
  modified_base (309)..(309): a, c, t, g, unknown or other
  misc_feature (309)..(309): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggtttcctcgttgctattttagaaggtgtccagtgtgacgtgcagctggtggagtcgtgggggaggcttggtccagccgtggggggtccccttaggacctcccctgtacagcctctggattcactttcagtaagcctggatgaactgggtccnccaggctccgagggaaggggctgggagtgggttggccgtaattaaaaccgaaactgagtggtaggacaacgagactacggctgcaccgtgaaaggcagatcaccatctacaaagagatgaattacgaaaaagcaacgcttagtactctagacaaagtagaacagacctagaacgtaaccgaggaacaacgacgaccgtataacgttacgtacgtaacccaacgtaacctcccgaagtaacgaccgtactaacctacctaacctacgtacgtacgtaccgg

SEQ ID NO: 220943 - DNA, 949 bp, Homo sapiens
  misc_feature: GYAE6OF02GXF0C.18.87.H10.1.454.CMB.1.raw
  modified_base (187)..(187): a, c, t, g, unknown or other
  misc_feature (187)..(187): n is a, c, g, or t
tcagtacgagtatgcacgaccggtgctcgatttagcagtactgcgttgggtttggggagcttggtccgagccgtgggggtcccctgacgtacgtcttccctagtgttcaggtccctagcattcagtctttaatacgttattggagtgcactgggtccgctaggctcgggaggccgagtggttcgcanataattagcagatggactgagagactagtgtgacgtcgtggtgtaacgggtccgacttcggaaccgtactacgtaccagtacgtacaacgacgttaaagttaaccttacgtagttaccttcgtagtactaaaagtcgaacgagtcccgttaacgagggtaccggaccccggaaagggtaccctaaccggggcggtttaacgggttacgtttaacggtttaaccggtttggggttaccggacccggtaaaaggtaaggttaaccggtaaggttacgggttccgtagggggtaaccgtaacgggttaccgggtaaccggttacggtaccggggggtaaccccgaaaacgggggttacccctaaacccgggggttttccaaacccgggggttttccctaacccggttacccgtaaccgggtacccccgtttaccccgaaaccccggtaaacgggggtacccctaagtttaccccgggtttacccctttacccccggtagggtcccgtaacccggttcgtacccgttaccggtaccgggtaccgtaccctaaacccgttaccggaaacggaccggtacccgaaccggtaaccggaccccgggtacccggtacgggacccttaccgggtacccgtttaacgggtaaccgtaaccgggttacccttaacccgttacccgtaacgttaaccgttacccggtaaccgttacgggtaccggtaccgggttaccgttacggaaccggtaacggtaccggttacggtaacggg

SEQ ID NO: 220944 - DNA, 547 bp, Homo sapiens
  misc_feature: GYAE6OF02FLQHB.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctgggacagtgggacgtcgtgggggccaaaggggaccacggtcaccgtctccctcacgccctccaccaacgggccccaagtccggtccttccccgtcggccgccctgcctccaggacgccaccctccgagacgcaccgagccggccctgggcctgccctggtccaaggtacctacttcccgatacctcgtactgagcgggctggcaggcgcag

SEQ ID NO: 220945 - DNA, 516 bp, Homo sapiens
  misc_feature: GYAE6OF02HW4R8.18.87.H10.1.454.CMB.1.raw
  modified_base (430)..(430): a, c, t, g, unknown or other
  misc_feature (430)..(430): n is a, c, g, or t
  modified_base (454)..(454): a, c, t, g, unknown or other
  misc_feature (454)..(454): n is a, c, g, or t
  modified_base (492)..(492): a, c, t, g, unknown or other
  misc_feature (492)..(492): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagccgtggggggtccctgagactctcctgtgcaggccctgcattcattctttaatagttattggatgcactgggtccgccaggctccggggaaggggccggagtgggtggccaacataatgacaagatggaactgaagaagaactatgtgactctgtgaagggcattcaccatctcagagacaacactaaagaacttacngtatctgacaaatgaacagcctanagacgccgaggacacggctgtgtactctgtgacgaagngcgaggtggctgggacagtacggg

SEQ ID NO: 220946 - DNA, 603 bp, Homo sapiens
  misc_feature: GYAE6OF02G4KLK.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtccgccaggccgtccgggggaaggggccggaggtggggtggccaaacgataagtgacaaagagtgggaactggaagaagaactagtgtggactcgtgtaggaacgggccattccacctatcctacaagacgaacaacaactaaagtaacctttacgagttaatctagacaaagttcgaaacacgccctacgaggacgcccggaaaggaccgacgggcttaggttagttaacgtttaccgtggtacggaacggaaaggacgacgtagggtcggacggtaggggacctaggtaccgggg

SEQ ID NO: 220947 - DNA, 570 bp, Homo sapiens
  misc_feature: GYAE6OF02HITNS.18.87.H10.1.454.CMB.1.raw
  modified_base (325)..(325): a, c, t, g, unknown or other
  misc_feature (325)..(325): n is a, c, g, or t
tcagtacgagtatgcacgaccggtgctcgatttagcagtactgcgtgggtttgggggaggcttggtccagcctgggggtccctgagactctcctgtgcaggccctgcattcatctttaatagttattggatgcactgggtccgccaggctccggggaagggccggagtgggtggccaacataatgcaagatggaactgagaagaactatgtggactctgtgaaggccgattcaccatctccagagacaacactaagaacttactgtatctgacaaaatgaacagcctcagagccgaggacacggctgtgtattactgtgcgaagngcagtggctgggacagtggacgtcgtggggccaaggggccacggtcacccgtctcctcacgcctccaccgaacggcccacgtccggtccttccccgtcggccgccctcgcctccgacggacgccaccctccggacgacgaccgaccacggccggcccgtcgggcctcggcccgtggtaccaaggaccttaccgttacccgtaataccgtcgtacgtcggacgcgggcgtggacgaacggcgctag

SEQ ID NO: 220948 - DNA, 547 bp, Homo sapiens
  misc_feature: GYAE6OF02J2IWR.18.87.H10.1.454.CMB.1.raw
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccaggccgtggggggtccctgagactctcctgtgcaggccctgcattcatctttaatagttattggatgcacgtggtccgccaggcgtccgggggaaggggccggagtgggtggccaacataatgcaagatggaactgagaagaactagtgtggactctgtgaagggccattcacntctcagacgaacaacactaagaacttacagtanctagaccaaatcgaacagcctagaggacgccgaagacacggtcttgagttacgttcgtaggtcgaacggaagtagcgtacgggtggtccgtaggggaccaggttacggg

SEQ ID NO: 220949 - DNA, 655 bp, Homo sapiens
  misc_feature: GYAE6OF02IOFXN.18.87.H10.1.454.CMB.1.raw
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagccgtggggggtcccctgagactctcctgtgcaggccctgcattcatctttaatagttattggatgcactggggtccgccgaggcgtccgggggaaggggccggaggtggggngccaacataaangacaagataggaactgaagaagaactagtggtggactcgtggtagaacgggtccggtactttaccgaacctattcctaccgaggtaacgaaccaaacgtaacctaaacgtaaactttaaccttaggttaacttccgtaggaactaaacgttacggaaaacctacggtaccttacgaacggtaacggacccggaaacggaaccgacgggtcttagttacgtttaaacgtttacgttaggtacggaaccggtaagaacggcgtaaggggttcggaccggtaggggaacctacggtacgggg

SEQ ID NO: 220950 - DNA, 655 bp, Homo sapiens
  misc_feature: GYAE6OF02IJPM2.18.87.H10.1.454.CMB.1.raw
  modified_base (359)..(359): a, c, t, g, unknown or other
  misc_feature (359)..(359): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtccgccaggccgtccgggggaacgggccggaggtggggtcggaccaacataangacaaagataggaactagaagaagaactagtgtaggacttcgtaggtaggaacggggcccgtaatttcccaacctaattcccttacccgaagaacgaaaccaaacgaaaccttaaaggaaaccttttaactaggttaacttccgtagaacctaaaatcgaaaaccacgtccctacaacggaacggacccggaaagggaacccacgggtacgttggttacggttaactttaccggtaggttacggaaccggaaaggacgcgtaagggttcgggacgtagggggacctaggtacgggg

SEQ ID NO: 220951 - DNA, 548 bp, Homo sapiens
  misc_feature: GYAE6OF02GQWLR.18.87.H10.1.454.CMB.1.raw
  modified_base (359)..(359): a, c, t, g, unknown or other
  misc_feature (359)..(359): n is a, c, g, or t
  modified_base (461)..(461): a, c, t, g, unknown or other
  misc_feature (461)..(461): n is a, c, g, or t
  modified_base (503)..(503): a, c, t, g, unknown or other
  misc_feature (503)..(503): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcactgggtccgccgaggccgtccgggggaaggggcccgggaggtcggggtggccaacataangacaagatggaactggaagaagaactatgtggactctgtgaagggccattccacatctcagagacaacactaagaacttactgtatctagacaaatgaaacngacctcagacgaccggaggacacgggctggtagtatttacgngttcggacgaaggagcgtaggtgggacctaggggaccagtacggg

SEQ ID NO: 220952 - DNA, 551 bp, Homo sapiens
  misc_feature: GYAE6OF02GE8JQ.18.87.H10.1.454.CMB.1.raw
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (511)..(511): a, c, t, g, unknown or other
  misc_feature (511)..(511): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcacgtgggtccgccgaggccgtccgggggaaggggccgggaggtggggtggccaacataatgacaagataggaactgaagaagaactatgtggactcgtgtaggaacggggccgtattccaaccatcctaccagacgaacaacactaaagtaacttactgtatctgactaaatgaacngcctanagacgccgaggacacggctgtgtattacgngtagacgaagacgcgtaggtcggcgtagggactagtcggg

SEQ ID NO: 220953 - DNA, 698 bp, Homo sapiens
  misc_feature: GYAE6OF02I7AJH.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagctgggttttcctcgttgctattttagaaggtgtccagtgtgacgtgcagctggtggagtcgtgggggaggcttggtccagccgtggggggtccctgagactctcctgtgcacggccctgcattcattctttaatagttattggatgacacgtcgggtccgccgagggccggtaccgggggaaggggcccgggaggtcggggtggaccaacgagttaatgacaagtagtagggaactaggaagaaagtaaactagtaggtaggtaattagtgggtagggaacggggtcccgtaatttcccaacctagttacctacccgaaggaaccgaaaccaaaccgtaaacgttaaaacgtaaccttttaacgtaggttaacttaccgtagaaactaaagtacgaaacccacggtaccccgtagaacggaaccgggacccggtaaacggaccgaacccgggtctaggtttacgtttaactttaccgtagggtacggaacggaagtacggtaccggtagggttacgggaccgggtaggggactagggttcccgggg

SEQ ID NO: 220954 - DNA, 513 bp, Homo sapiens
  misc_feature: GYAE6OF02IGYOR.18.87.H10.1.454.CMB.1.raw
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (470)..(470): a, c, t, g, unknown or other
  misc_feature (470)..(470): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatcttaatagttattggatgcactgggtccgccaggctccggggaagggccggagtgggtggcaacataangcaagatggaactgaagaagaactatgnggactctgtgaaggccgattcaccatctcagacgacaacactaaagtaacttactagttatctagacaaatgaaacagcctcagagccgagacacgntgtgtatctgtgcgtaagagcgagtcgggctgggacagtcggg

SEQ ID NO: 220955 - DNA, 532 bp, Homo sapiens
  misc_feature: GYAE6OF02HJ4LN.18.87.H10.1.454.CMB.1.raw
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcacgtgggtccgccgaggcgtccgggggaagggccggaggtgggtggccaacgataatgacaagatggaactgagaagaactatgtgactcgtgtgaacgggcctattcaccatcctacagacgacaacactaagacttactgtatctgactaatgaacngcctanagacgcgagacncggntgtattactcgngtagacgtaagcgcgaggtcggacgtaggggactagtcggg

SEQ ID NO: 220956 - DNA, 255 bp, Homo sapiens
  misc_feature: GYAE6OF02GZMVH.18.87.H10.1.454.CMB.1.raw
  modified_base (251)..(255): a, c, t, g, unknown or other
  misc_feature (251)..(255): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttcccgcatctgacatactcgtactgagcggctggcaaggcgcatagnnnnn

SEQ ID NO: 220957 - DNA, 626 bp, Homo sapiens
  misc_feature: GYAE6OF02GPTVK.18.87.H10.1.454.CMB.1.raw
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggggtcccctggagactctcctgtgcaggccctgcattcattctttaatagttattggatgcacgtcgggtccgccgaggccgtccggggggaaggggcccgggagggtcggggtcggaccaaacacgtaagtcgacaaggatagggaactggaagaaagaactagtggtaggactcgtgtaggaacggggccctattccgaacctactcctaccgagacaaccaacaactaaagtaacttactagtactctagaacaaatgaaaccngtaccctanaacggacgaccggaacggacaacgggtcttacggtgtttaacgttcgtaggtacgaaccgtaaaggcggaactaggggtacggccggttagggaaccgtaggtccgggg

SEQ ID NO: 220958 - DNA, 606 bp, Homo sapiens
  misc_feature: GYAE6OF02HNQ9B.18.87.H10.1.454.CMB.1.raw
tcagtacgagtatgcacgaccggtgctcgatttagcagtactgcgtggagtctgggggaggcttggtccagcctggggggtccctgagactctcctgtgcaggccctgcattcatctttaatagttattggatgcactgggtccgccaggctccgggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctgggacagtggacgtcgtggggaccaaagggaccacggtcaccggtctcccgtcacgcctaccaccaaacgggcccaatccggtaccttcccccgtggcccgccctgcctccgacggacgccacccgtcgaagacgaccaacgacgccggcccgtggggcctcggcccgttgggtacccaaacgggtaccgttaacccttaccccaagttaacccgtaccggttaacgttcggaacgggccggggtccgttagggacccgaagggacccg

SEQ ID NO: 220959 - DNA, 588 bp, Homo sapiens
  misc_feature: GYAE6OF02HY2Y2.18.87.H10.1.454.CMB.1.raw
  modified_base (192)..(192): a, c, t, g, unknown or other
  misc_feature (192)..(192): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtggccaacataatgcaagntggaactgagaagaactatgtggactctgtgaagggccgattcaccatctccagagacaacactaagaacttactgtatctgcaaaatgaacagcctcagagccgaggacacggctgtagtattacngtgcgaagngcagtggctgggacagtggacgtctggggaccaagggaccacgggtccaccgtctcctcgacgccctccgaccgaacgggccccagtccggtccttccccgtggccgtccctgcctccgaggacgccacctccgacgagccacgacgccggcccgtgggccttcggcccgtggtacgaacggtaccttaccgttacccaagttacccgtcggttaacgtcggacggtccggggtctcgggaccgaacgggccgacgtaag

SEQ ID NO: 220960 - DNA, 590 bp, Homo sapiens
  misc_feature: GYAE6OF02FHTPC.18.87.H10.1.454.CMB.1.raw
  modified_base (499)..(499): a, c, t, g, unknown or other
  misc_feature (499)..(499): n is a, c, g, or t
tcagtacgagtatgcacgaccggtgctcgatttagcagtactgcgttgggtttggggaggtctcagagaggagccttagccctggactccaaggccttttcacttggtgatcagcactgagcacagaggactcaccatggaattggggctgagctgggttttcctcgttgcttattttagaaggtgtccagtgtgacgtgcagctggtggagtctgggggaggcgttgggtccaggcccgtgggggggtccctgagactcctcctgtgcaggccctgcattcatctttaatagttattggatgcacgtgggtccgccgaggccgtccgggggaaggggcccggaggtggggtggcccgaacaataactgacaagagtggaactggaagaagaactagtggtaggactcgtggtaggaaggggccgtaattccgaaccatcctaccaagtacgaaccaacaactaaagaactttactgttatctagactaaatgaaaccngaccctagaggacgaccgaggaccgacgcgtagtacgtatttacgtgtacggacgtaagagtcgagggtcggcggtagggacctagtcggg

SEQ ID NO: 220961 - DNA, 559 bp, Homo sapiens
  misc_feature: GYAE6OF02F135B.18.87.H10.1.454.CMB.1.raw
  modified_base (444)..(444): a, c, t, g, unknown or other
  misc_feature (444)..(444): n is a, c, g, or t
  modified_base (477)..(477): a, c, t, g, unknown or other
  misc_feature (477)..(477): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttaaaaggtgtccagtgtgacgtgcagctggtggagtcgtggggggaggcttggtccagcctggggggtccctgagactctcctgtgcaggccctgcattcattctttaatagttattggatgcacgtgggtccgccgagggccgtccgggggaaggggccggaggtggggtggccaacataatgacaagatggaactgagaagaactagtgtgactcgtgtgaagggcattcaccatctaccgagacgaacaacactaaagaacttanagttatcctagacccaaagtcgaacagccctanaggacgaccgaggacaacggtctgtagttacttacgtggtacgacgaagcgacgaggtcggacgtagggactagtcggacgg

SEQ ID NO: 220962 - DNA, 560 bp, Homo sapiens
  misc_feature: GYAE6OF02I7BGZ.18.87.H10.1.454.CMB.1.raw
  modified_base (467)..(467): a, c, t, g, unknown or other
  misc_feature (467)..(467): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatctttaatagttattggatgcacgtgggtccgccagggccgtccgggggaaggggcccggagtggggtggccaacgataatgacaagatggaactgagaagaactatgtaggactcgtggtagaagggccgaatttccaccatctaccagagacaacactaaagaacttactgtactctgacaaatgaaacngcctagagacgccgaggaaccacggctgtagttaacttacgtggtacgacgaaggagaccgtaaggtcgggacgttagggggacagtacgggg

SEQ ID NO: 220963 - DNA, 587 bp, Homo sapiens
  misc_feature: GYAE6OF02I3UIW.18.87.H10.1.454.CMB.1.raw
  modified_base (323)..(323): a, c, t, g, unknown or other
  misc_feature (323)..(323): n is a, c, g, or t
  modified_base (416)..(416): a, c, t, g, unknown or other
  misc_feature (416)..(416): n is a, c, g, or t
tcagtacgagtatgcacgaccggtgctcgatttagcagtactgcgttgggtttgggggaggcttggtccagcctgggggtccctgagactctcctgtgcaggccctgcattcatctttaatagttattggatgcactgggtccgccaggctccggggaagggccggagtgggtggccaacataatgcaagatggaactgagaagaactatgtgactctgtgaaggccattcaccatctccagagacaacactaagacttactgtatctgcaaatgaacagcctcagacgccgaaggacacggctgtgtattactgtgcgaagngcagtggctgggacagtggactcgtggggccaaagggccacggtcaccgtctcctcacgccctccaccgacggcccatccggtccttccccgnggcccgccctgccttcccgaggacgcctaccctccggacgacgccgaccgcggccggcccgtcgggcctcggccgtcggtacgaacggtactacccgtttacccgaattacccgtcggttaacctcggtaacggccggggtaccgttcggaccgaacggtccgactaacgg

SEQ ID NO: 220964 - DNA, 593 bp, Homo sapiens
  misc_feature: GYAE6OF02HA2ZT.18.87.H10.1.454.CMB.1.raw
  modified_base (493)..(493): a, c, t, g, unknown or other
  misc_feature (493)..(493): n is a, c, g, or t
  modified_base (524)..(524): a, c, t, g, unknown or other
  misc_feature (524)..(524): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccaggcctggggggtccctgagactctcctgtgcaggccctgcattcattctttaatagttattggatgcactgggtccgccgaggccgtccgggggaaggggccgggaggtcggggtggccaacgataagtgacaagataggaactgaagaagaactatgtaggacttcgtggtaggaacggggtcccgatttaccaacctagtcctaccaagacgaaccaaacaactaaagtaaactttactgtatctagacaaatgaaacngccctacgaagacgccggaagaccgacggtnttacggtagttacttcgtaggtggaccgaaaggcgacgtaggtcggacgttaggggacctaggtcgggg

SEQ ID NO: 220965 - DNA, 573 bp, Homo sapiens
  misc_feature: GYAE6OF02GGF41.18.87.H10.1.454.CMB.1.raw
  modified_base (481)..(481): a, c, t, g, unknown or other
  misc_feature (481)..(481): n is a, c, g, or t
  modified_base (506)..(506): a, c, t, g, unknown or other
  misc_feature (506)..(506): n is a, c, g, or t
  modified_base (542)..(542): a, c, t, g, unknown or other
  misc_feature (542)..(542): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcggtggtttcgcgtaggcgtatttagtaaggtgtccagtgtgacgtgcagctggtggagtcgtgggggaggcttggtccagccgtggggggtccctgagactctcctgtgcaggccctgcattcatctttaatagttattggatgcacgtgggtccgccgaggccgtaccgggggaaggggccggaggtggggtcggcccaacgagttaatggacaaaggatagggaaactggaagaagaactagtgtggactcgtgtggaagggccgtattccacatctacagacgacaacactaagtaacttactgtatcgtagacaaatgaaacncgcctagacgacgaccgaggaaccncggtcttagtacgtagttcgtggtacggacgaaggngtacgtaggtcggacgtagggactaggtcgg

SEQ ID NO: 220966 - DNA, 575 bp, Homo sapiens
  misc_feature: GYAE6OF02FQNOL.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctggggacatggacgtcgtggggccaagggaccacgggtcacccgtctcctcagccctccaccgaacgggcccatcggtccttcccccgtcggccgcccctgcctcccgacggacgccgaccctccggacgacgccacgacgccggcccgtagggcctcggcccgtgggtccaacgggtcctaccttcccgaattacctcgttaccgtgaggccgggctgggccgaacggccggactaacg

SEQ ID NO: 220967 - DNA, 760 bp, Homo sapiens
  misc_feature: GYAE6OF02G7BMP.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggtccctgagactctcctgtgcaggccctgcattcatctttaatagttattggatgcacgtgggtccgccgaggccgtccgggggaaggggcccggaggtggggtcggaccaaacgtaataatggacgaaagagtagggaactaggaagaaacgaaaccttagtaggttacgggaacttccgttagggtacggaaacggggtcccgtaatttacccgaacccgtaacgttcccgttaacccgaaaggtaaaccgaaaccctaaaaccgtaaaccgttaaaaagtaaacccttttacgttaaggttaacgttaccgttagggaaactaaaagttcggaaaacctacggtacccttacgaaacggtaccgggaccccgggaaagggaacccgtaaccggggtcttaggggtttaacgtttaaacgtttaccgtagggttacggaaccggtaaaggcggtacgtaagggtcgggaccgttacggggaactagggttccgggaccggttccgggtacgggggaccctaaaccgggg

SEQ ID NO: 220968 - DNA, 569 bp, Homo sapiens
  misc_feature: GYAE6OF02GZPDF.18.87.H10.1.454.CMB.1.raw
  modified_base (564)..(564): a, c, t, g, unknown or other
  misc_feature (564)..(564): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaacttactgtatctgcaaatgaacagcctcagagccgaggacacggctgtgtattactgtgcgaagagcagtggctggggacagtggacgtcgtggggccaagggccacgggtcaccgtctcctcacgcctccaccgacgggccccagtccggtccttccccgtcggccgcccctcgcctcccgacggacgccacccgtccgagacgccaccacggccggccctgggctcgcccgtggtaccaacggaccttaccttcccgaattacctcgtactggacggccgggtcgtggaccgaaggccgntaacg

SEQ ID NO: 220969 - DNA, 765 bp, Homo sapiens
  misc_feature: GYAE6OF02HAIRM.18.87.H10.1.454.CMB.1.raw
tcagtacgagtatgcacgaccggtgctcgatttagcagtactgcgttgggtttgggggaggattggtccagcctggggggtccctgagactctcctgtgcaggccctgcattcatctttaatagttattggatgcactgggtccgccaggctccggggaaggggccggagtgggtggccaaacataatgcaagatggaactgagaagaactatgtggactctgtgaagggccgattcaccatctccagagacaacactaaagaacttactgtatctgacaaatgaacagcctcagagccgaggacacggctgtgtattactgtgcgaaagcgcagtggctggggaactagtgggacgtcgtagggggacccaaaggggaccctacggggtcaacccggttctacccgtcgaacggtcccctacccgaaacccgtaaccggggacccctaacgttcccgggttcccgtttaccccccgttcgggcccgtccccgttcggtacccttcccgaacgggtaccggaccctaaccccgttacccggaacggtaaccggacccgaaaccgtaaccgggcccgggaccccccgttacgggggtccgttccgggtaccccgttaccggggttaacccgaaaccggggttacccgttaaccccgtttaaccccggtaaccgtttaacccgttaccggttaacccgttacgggaaccgggtcccggggtaccgttaccgggacccggtaaaaccgggttccggtaaccgtaacgg

SEQ ID NO: 220970 - DNA, 607 bp, Homo sapiens
  misc_feature: GYAE6OF02FZHG2.18.87.H10.1.454.CMB.1.raw
  modified_base (473)..(473): a, c, t, g, unknown or other
  misc_feature (473)..(473): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggggtccctggagactctcctgtgcaggccctgcattcatctttaatagttattggatgcacgtgggtccgccaggccgtccgggggaaggggccggaggtgggtcggccaacataatgacaagataggaactggagaagaactagtgtggactcgtggtgagggccattcaccatcctccagacgaacaacaactaacgaacttactagtaactctagactaaatcgaaacncgccctacgaagacgaccgaaggaccacgggtctagggttagttaactttaaccgtgggttaccgaacgggaaacggacggtaccgtaaggggttcggggaccgttacgggggtaaccctaggttacccggggg

SEQ ID NO: 220971 - DNA, 599 bp, Homo sapiens
  misc_feature: GYAE6OF02J2IP7.18.87.H10.1.454.CMB.1.raw
  modified_base (559)..(559): a, c, t, g, unknown or other
  misc_feature (559)..(559): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggtttcctcgttgctattttagaaggtgtccagtgtgacgtgcagctggtgagtctggggaggctggtccagcctgggggccctgagactctcctgtgcaggccctgcattcatctttaatagttattggatgcacgtgggtccgccaggcctccgggggaagggcccggaggtggggtcggccaacgataagtgacgagactggaactgaacggaagaactagtgtcggtaactctaggtcgaaggggtcccattccgacagtctccgagacgaactaacaacgtaagaacttacgtagtatccgtagacctaaagttggaaacctgtacctacgaacggacggaccggaaaggaactacgggtactgggttacgttaacgttaacgttggacgagaacggngaaccgtagggtccggaccgtaggggacctaggttccggg

SEQ ID NO: 220972 - DNA, 1039 bp, Homo sapiens
  misc_feature: GYAE6OF02GLVRF.18.87.H10.1.454.CMB.1.raw
tcagtacgagtatgcacgaccggtgctcgattttagcagtactgcgtttggggttttgggggaggtctccagagaggagaccttaggcccgtggactccaaggtccgtttccacttggtgatcagacactgagcacacgagtacgtctacgatggaagttggggtcgtttcgtacggtcgttcgggtttttccctttacggtttaggtctttaacgtttttaaggtaagggttcgtaccgtaggttgtggacgttggtcgaggtcgttgggggtgggtacggttcggttcgggggagggtccgtttcggggtacccgtaccggtccggttacgggggggttaccccttcggtacgtaccgttccgtcccgttacggttcggtccgtacggggtaccccttcggtacccttaacgttttaccttaacgttttccgttttaaaacgttaacggttttaacgtttacggggttaacggtttccggacccgtaaccgggtttccgggggttacccccggacccgggtaacggggtacccgggttacccgggggggtaaacgggggtcccggggtaggggtttacgggggttacgggtttaacccggtaaacggtaacgttaaacgttcggaaccgtaaagggtaacggtttaagggtaaccgttaagggaaaacggtaaacggttaaacgttaaggttacggttaacggggtaaccgtttaccggttacgggttaaacgggtaacccgggggttacccgtttaaccgttttaccccgaaaccgtttaaccgtttaccccgtaaacccgaaacggtaaacccggaaaccctaaaacccgtaaaaccgttaaaacggttaaacccttttaccgttaacgttaacttaacgttacgaaactaaacgttacggaaaccgtaccgaccgtacgaacggaccgtaccggaaggtacgtacgtcgttaggtacgttacgttacggtgtacggtaacggaaggtacggacgtacgggtacgggtcggtacgggtacgtacggttaccgggg

SEQ ID NO: 220973 - DNA, 623 bp, Homo sapiens
  misc_feature: GYAE6OF02I6HIQ.18.87.H10.1.454.CMB.1.raw
  modified_base (322)..(322): a, c, t, g, unknown or other
  misc_feature (322)..(322): n is a, c, g, or t
  modified_base (443)..(443): a, c, t, g, unknown or other
  misc_feature (443)..(443): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtggccaacataatgcaagatggaactgagaagaactatgtggactctgtgaagggccattcaccatcctccagagacaacactaagaacttactgtatctgacaaatgaacagcctcagagccgaggacacggctgtagtattactgtncgaagagcagtggctggggacagtggacgtcgtagggggccaaaggggccctacggtccaccggttctccctcgacgccctcccgaccgaacgggccccacgtccggtacccttcccccgngggtcccgccccgtcgcccttacccgagggaccgcccaacccgttccggaacgacggtccaacgacggcccggtcccgtagggctcggccttgggccaacggtcctaccttaccccgaattacccgtaccgtacgttacggacggtcccgggtcgtaccggcgaacgggcctacgtaacg

SEQ ID NO: 220974 - DNA, 585 bp, Homo sapiens
  misc_feature: GYAE6OF02G91QB.18.87.H10.1.454.CMB.1.raw
  modified_base (308)..(308): a, c, t, g, unknown or other
  misc_feature (308)..(308): n is a, c, g, or t
  modified_base (460)..(460): a, c, t, g, unknown or other
  misc_feature (460)..(460): n is a, c, g, or t
  modified_base (480)..(480): a, c, t, g, unknown or other
  misc_feature (480)..(480): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggcctgcatcatctttaatagttattggatgcacgtggggtccnccgagggccgtaccggggggaacggggccgggaggtggggtggccaaacgagtaatgacaaggataggaactggaagaagaactagtgtgactctggtgaaggggcctattcacctatcctcgaagagaaccaacactaaagactttacgtntaactctgacaaatcgaacngcctacgaagacggaccgaaggaccaacgggtcttaggtacgttacttaacgtcgtaggaccggaagtacgtcgaagggtcggacgttacgggactaggtacggg

SEQ ID NO: 220975 - DNA, 700 bp, Homo sapiens
  misc_feature: GYAE6OF02GVGQS.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcgttggtccagccgtggggggtccctgagacctctcctgtgcgaggccctgctattcattctttaatagttattggatgcacgtgggtcccgccgagggccgtaccggggggaaggggcccggagggtcggggtacggccaaacaagtaagtcgacaagataggaactggaagaaagaactagtaggtcgtacgtcgtaggtaggaacggggcccgtaatttccgaacccgtattcccgtaccgaaaggtaaccggaacctaaacccgtaacgtaaacgtaaaccttttaccgttagtaacttcgtagtaacctaaagttacgaaacctacgcccttaacgacggtaaccgaaccgggtaacggaaccgtacgggacgtttaggttacggtttaacttacggttagggtccggaaccggtaaaggacggtaccggtaagggttccgggtacgtagggggtacctagggttacccgggg

SEQ ID NO: 220976 - DNA, 546 bp, Homo sapiens
  misc_feature: GYAE6OF02JADUI.18.87.H10.1.454.CMB.1.raw
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgccattcatctttaatgttattggatgcacgtgggtccgccaggctccgggggaagggccggagtgggtggccaacgataagtgacaagatggaactggagaagaactagtgtgactcgtgtagagggccattccacatctcaganacaacactaanaacttacagtanctgacaaagtgaaccagcctacagtacgccgaaggtaccacgggtctaggttagtaacttcgtgtaggacgaaggcgcgttaggtcggaccgtgggactagtcgggg

SEQ ID NO: 220977 - DNA, 595 bp, Homo sapiens
  misc_feature: GYAE6OF02FN2PL.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggtcttggtccaggccgtggggggtccctggagactctcctgtgcaggccctgcattcattcttaatagttattggatgcacgtgggtccgcaggcgtccgggggaagggccggaggtgggtggccaacgataagtgacaaggataggaactggaagaagaactagtgtggactcgtgtaggaacgggcctatcacctatcctcaagacgaacaaaccaactaaagtaacttactgtaactctagacctaaagtgaaactcgacctacgaaggacgaccggaaggaacaccgggtcttaggtgttaacgttacgtaggtacgggaaccgtaagaacggactagggtcgggaccgtaggggtaccaggttcgggg

SEQ ID NO: 220978 - DNA, 763 bp, Homo sapiens
  misc_feature: GYAE6OF02JSH6S.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggtccctgagactctcctgtgcaggccctgcattcatctttaataggttattggatgcacgtgggtccgccaggcgtccggggaagggccggaggtggggtcgccaacagtaatcgacaagatggaactggaagaagtaactatcggtggactcgtggtgaacgggccgtaagttccaccgtatccgtaccaaggacggtaaccaaaacaccgttaaaaggaaacctttaacgacggttaaataccgtaacgtacaaaagttaccgaaaaccgtacggttaaccctacgaaacggtaaccggtaccccgggtaaacgggtaaccgtaacccgggttccggttagggttaacggtttaaaacgttttaaccggggtcggtttaacggggaaccggttaaaaacggggtcggggttaacccgtaaaggggggtttcgggaaccggtttaaggggggaaaacccttcggggttaaaccggggttaccccggggtttccgggttaaacccggggggggaccccgtaaaaacccgggggg

SEQ ID NO: 220979 - DNA, 639 bp, Homo sapiens
  misc_feature: GYAE6OF02I9GS6.18.87.H10.1.454.CMB.1.raw
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtgccaacataatgcaagatggaactgagaagaactatgtggactctgtgaagggccattcaccatctccagagacaacactaagaacttactgtatctgcaaaatgaaacagcctcagacgccgaggacacggctgtgtattactggtgacgaagagcaggtggctgggacagtggacgtcgtggggaccaaaggggtccacggtcgacccgttctccgtcacgccctcccgaaccgaacgggcccctagtccggttccttcccccgtggcccgtacccctgccgttacccgagggacctaccgacccgtcccggaacgacgacccgaccgaccggccgggtccccgtacggggtccgtccggtcccgtcgggtaccgaaacggtacccttaaccttaccccgtaacgttacctaccggtacgtcggacggtcccgggcgtacggaccggaacgggccgcgtaacg

SEQ ID NO: 220980 - DNA, 523 bp, Homo sapiens
  misc_feature: GYAE6OF02FQWZS.18.87.H10.1.454.CMB.1.raw
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (499)..(499): a, c, t, g, unknown or other
  misc_feature (499)..(499): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagccgtggggggtccctgagactctcctgtgcaggccctgcattcatctttaatagttattggatgcactgggtccgccaggcgtccgggggaaggggccggaggtggggtggccaacataatgacaagatggaactgaagaagaactatgtggactctgtggaagggccattcaccatctccagagacaacactaagaacttactgtatctagacaaatgaacngcctnagagccgagacacggctgtagtattcgtggtgacgaagngcaggtggcgtagggacagtcggg

SEQ ID NO: 220981 - DNA, 612 bp, Homo sapiens
  misc_feature: GYAE6OF02HYQIV.18.87.H10.1.454.CMB.1.raw
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccgggggaagggccggagtgggtggccaacataatgcaagatggaactgagaagaactatgtggactctgtgaagggccattcacatctccagagacaacactaaagaacttactgtatctgacaaatgaacngcctcaagagccgaggacacggctgngtattacngtcgacgaagngcaggtggctggggacagtggacgtcgtgggggacccaaggggacccagggtccaccgtcctcctcgacgccctaccgaaccgaacgggcccctagtccggtcccttccccgtcggcccgcccgtcgcctaccgaggacgaccacccgtaccgacggacgaccacggacgccggcccggtgggcctcgccgtcggtacaacggtaccttaccttacccgaacgttacctaccggtacgtcggacggtccgggtacgtcggaccgaacgggccgacgtaacg

SEQ ID NO: 220982 - DNA, 580 bp, Homo sapiens
  misc_feature: GYAE6OF02GGDTA.18.87.H10.1.454.CMB.1.raw
  modified_base (307)..(307): a, c, t, g, unknown or other
  misc_feature (307)..(307): n is a, c, g, or t
  modified_base (475)..(475): a, c, t, g, unknown or other
  misc_feature (475)..(475): n is a, c, g, or t
  modified_base (541)..(541): a, c, t, g, unknown or other
  misc_feature (541)..(541): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttgggtccagccgtggggggtccctgagactctcctgtgcaggccctgcattcatctttaatagttatggatgcactgggtccnccaggcgtccgggggaaggggcccggaggtggggtcggccaacagtaatgacaagataggaactgaagaagaactatgtggactcgtgtaggaacgggccattccaactatcctaccagacgaaccaactaactaagaacctttactgtactctgacaaatcgaaacncgcctagagacgccgaggaccacgggtcttaggtagttaacgttcgtaggttacggacgtaaaggngaccgtagggttcgggacgttaggggacctaggtcgggg

SEQ ID NO: 220983 - DNA, 673 bp, Homo sapiens
  misc_feature: GYAE6OF02HKDQ1.18.87.H10.1.454.CMB.1.raw
  modified_base (315)..(315): a, c, t, g, unknown or other
  misc_feature (315)..(315): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcttgggttttcctcgttgtctattttagaaggtgtccagtgtgacgtgcagctggtggagtcggtgggggagtcgttcggtccgaggtccggtgggggtcccctggacgactctccgtgtcgcgacggcctgctattcattactttaatagttatgatgacncgtcggtccgacgacggccggtaccgggggaacgggccggaggtcggggtacgaccgtaaactagtaacgtcgacgtaaggagtaggaacgtaggaagtaaagtaacttaggtcgtagtactggtaggtacggaacggtccctaattcccgaaacctacgtccctaacgaagggaaacctaaacctaaaccgtaaacgttaaaacgttaaccttttaccgtagtttaacctacgttacgaaacctaaagtccgaaacctccggtacctaacgagaccggaaccgaggaacccgtgtcgtagttagttacgtcgtgacgaacgagacgacgtaggttccgacggtagacgtaggtacgg

SEQ ID NO: 220984 - DNA, 581 bp, Homo sapiens
  misc_feature: GYAE6OF02GRFOE.18.87.H10.1.454.CMB.1.raw
  modified_base (331)..(331): a, c, t, g, unknown or other
  misc_feature (331)..(331): n is a, c, g, or t
  modified_base (431)..(431): a, c, t, g, unknown or other
  misc_feature (431)..(431): n is a, c, g, or t
  modified_base (576)..(576): a, c, t, g, unknown or other
  misc_feature (576)..(576): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctccagagacaacactaagaaccttactgtatctgcaaaatgaacagcctcagagccgaggacacggctgtgtattactgtgacgaaagngcaggtggctggggacagtgggacgtcgtggggaccaaggggccacggtcaccgtctcctcacgccctaccacgacggcccagtccggtcccttccccgnggcccgcccctgcctaccgacggacgccaccgtccgagacgcacgaccggccggcccgtgggcctcgccgtggaccgaacggtaccttacgtacccgtactaccttaccgtacgtcggacggcgggtcgtcggaccgaacggccncgtag

SEQ ID NO: 220985 - DNA, 529 bp, Homo sapiens
  misc_feature: GYAE6OF02F5E2D.18.87.H10.1.454.CMB.1.raw
  modified_base (342)..(342): a, c, t, g, unknown or other
  misc_feature (342)..(342): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (480)..(480): a, c, t, g, unknown or other
  misc_feature (480)..(480): n is a, c, g, or t
  modified_base (500)..(500): a, c, t, g, unknown or other
  misc_feature (500)..(500): n is a, c, g, or t
tcagtacgagtatgcacgaccggtgctcgatttagcagtactgcgttgggtttgggggaggtcgtcagagaggagccttagccctggactccaaggcctttccacttggtgatcagcactgagcacacgaggactcaccatggaattgggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcactgggtccgccgaggcctccgggggaagggccggagtgggngccaacataatgcaagagtggaactgagaacgactaagtgtgactctgtgagggcatcaccgatctccagacaaaacnctaaanacttactgtatctgacaaatgaacagcctacgagacgccgaggacacgtctgtntatacgtgcgacgaagacgngtaggtcggcgtagggactagcgtaacgg

SEQ ID NO: 220986 - DNA, 740 bp, Homo sapiens
  misc_feature: GYAE6OF02IKU8A.18.87.H10.1.454.CMB.1.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggcgtccggggaaggggccggagtgggtggccaacataatgcaagatggaactgagaagaactatgtggactctgtagaacgggccattcaccatctccagagacaacactaagaacttacngtatctgacaaatgaacngacctnagagccgaggacacggctagtgtattacngtgacgaagagcaggtggctaggggacagtcgggacgttcggcgggggacccaaaggggacccaacgggtccaacccggtcctaccctacgaccggtccctaccaaccggaaaccggggccccctaaggtttcccgggttccctttaccccccgggtcgggtaccccggtccccgttcggtcccgttacccgacgggaaccgcccgtaacccgttaccccggaagacccggaccgaacccgacccgggcccgggtccccgttcgggggcccgtttccggacccggttacgggtacccgaaccggttacccgttaaccccgttacccccgtaaggttaaccccgttccggttaacccgtagtaccggggccgggttacccgtacgggaacccggtaacggggacccgtaccgtaacgg

SEQ ID NO: 220987 - DNA, 572 bp, Homo sapiens
  misc_feature: GYAE6OF02GYJP0.18.87.H10.1.454.CMB.1.raw
  modified_base (287)..(287): a, c, t, g, unknown or other
  misc_feature (287)..(287): n is a, c, g, or t
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaagggccggagtgggtgccaacataatgcaagatggaactgagaagaactatgtgactctgtgaagggccattcaccatctccagagacaacactaagaacttactgtatctgacaaatgaacagcctnagagccgaggacacggctgtgtattactgtgcgaagagcaggtggcgtgggacagtggacgtcgtggggaccaaggggaccacggtcaccgtctccgtcacgcctccaccgacgggccccagtcccggtccttccccgnggcccgccctgcctccgagggacncctaccgtccgacgcgcacgcgccggccgtcgggcctcggcctgggtaccaacggtacccttaccgtaccctataccctcgtaccgtggacgccgggtcgtcgggacaacgggccgactaag

SEQ ID NO: 220988 - DNA, 617 bp, Homo sapiens
  misc_feature: GYAE6OF02HZYY4.18.87.H10.1.454.CMB.1.raw
  modified_base (255)..(255): a, c, t, g, unknown or other
  misc_feature (255)..(255): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (501)..(501): a, c, t, g, unknown or other
  misc_feature (501)..(501): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggtttcctcgttgctattttagaaggtgtccagtgtgacgtgcagctggtggagtcgtgggggagcttgggtccagccgtggggggtccctagagactntcctgtgcaggcctgcattcatctttaatagttattggatgcactgggtccgccaggcgtccggggaaggggcccggaggtggggtcggccaaacgataaagtggactaagatagggactgagaaagaaactntagnggactntaggtgaacgggcgacttcgaacccgtaatctaccaagacgaaccaaacacttaaaagaaaccgtttacagttaattccagaaccaaaagttacggaaacccngtaccctagaacggtacggacccgaaaggaacctacgggtctaggttagttaactaacgttcggtaggaacggaaagagaccgtagggtacgggtccggtaagggtacaagtcggg

SEQ ID NO: 220989 - DNA, 699 bp, Homo sapiens
  misc_feature: GYAE6OF02I3LP6.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcgttggtccagccgtcgggggggtccctggagactcctcctgtgcacggccctgctattcattctttaatagttattggatgcacgttcggggtccgccgagggccggtaccggggggaacgggggtccgggagggtcgggggtggacccgaaacgaagttaaagtcggaacgaaaggagtacggtaaacgtggaaacgtaaagaaacgttaagtggtaggtaccttcgtggtaggaacggggtccgtacgtttaccaacctactctacccgaagaacgaaccaaactaacgtaaagtaactttacgtagtaactcgtaagactaaagtacgaaacacgtaccctacgaacggaccgaccggaacggaccgaccggtcttacggttagtttaacgtttacggtaggttacggaccggtaaaggacgtacccggtaagggttcgggtaaccgttacggggaccttagggtaaccgggg

SEQ ID NO: 220990 - DNA, 816 bp, Homo sapiens
  misc_feature: GYAE6OF02JM8Z5.18.87.H10.1.454.CMB.1.raw
  modified_base (358)..(358): a, c, t, g, unknown or other
  misc_feature (358)..(358): n is a, c, g, or t
  modified_base (541)..(541): a, c, t, g, unknown or other
  misc_feature (541)..(541): n is a, c, g, or t
  modified_base (808)..(808): a, c, t, g, unknown or other
  misc_feature (808)..(808): n is a, c, g, or t
tcagtacgagtatgcacgaccggtgctcgatttagcagtactgcgttgggtaggtcgtggggaggcttggtccagccgtgggggtccctgagactcgtcctgtgcgacggccctgacattccagttccttttaatagttattggatcgcgaccttcgggtaccgccaacggacgtccgggggaagggccggtagtcgggtaggacctaacgactaatcgccaagactggaactgaagaagtactagtgaggactcgtgagaagggtcctattcaccgatccgaccgaagagtaactaaaccgaacgttaaacggtaactttaccgtagttatccgtaggacctaaaagtacgaaaccnggaacccctccgtaaagcggccggaaggacctaggcgttagtcgtaacttcgtttagggcaacggaaggtccgctaggttacggggaacgtggaaacgtggtacggtaacgggtttccggaaggggggccctaaaaacggggtcccgttaaccgggtaccgtttaccccggtcctttaacccnccgtaaccgtaccccgtaccggaacccggaaccgggtaccccgttcgttcccggttccccgttacccgggtccgtcccggtacccgttaggtaccccgttaccgtaaccggtaccgttacccctaccggtaccggaacgaaccgacgtaacccggccggtacccgtccggtcgggtacccgttcggacccgggttagtacggtaaccgtccgttacctaccgtaaccgtaccttacggtacgtcggtacggccggtacgtccggacnccgggtac

SEQ ID NO: 220991 - DNA, 611 bp, Homo sapiens
  misc_feature: GYAE6OF02HJBJ1.18.87.H10.1.454.CMB.1.raw
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgacgactctcctgtgcaggccctgctattcattctttaatagttattggattgctacgtgggtcccgccgaggccgtccgggggaagggccggaggtgggtcggaccaacagtaatgacaagataggaactgaagaagaactagtgtaggactcgtaggtaggaacgggtccatttccacctactctaccagaanaccaaacactaaagtaaccttactagtactcagactaaagngaacncgccctagaacggacgacccggaagaccgaccggtgtacggttacgtttaagttaccgttaggtacgggaacgaaacggtcggacgtagggttcgggacgtacggggactaggtaaccgggg

SEQ ID NO: 220992 - DNA, 691 bp, Homo sapiens
  misc_feature: GYAE6OF02IYVMR.18.87.H10.1.454.CMB.1.raw
  modified_base (201)..(201): a, c, t, g, unknown or other
  misc_feature (201)..(201): n is a, c, g, or t
  modified_base (483)..(483): a, c, t, g, unknown or other
  misc_feature (483)..(483): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcggtggtttcgtcgtaggcgtactttagaaggtgtcagtgtgagtgcngctggtggagtcgtgggggagcttggccgagccgtgggggtccctagacgactctctgtgcgacggcctgcctattacctattctttaatagtttagttggtatcggctacgtcgggtccaccggtacgggccggtaccggggggaaggggtccggaagggtcggggtacggaccctaagtaacgtagtacgacgaaggtaagtacgggaactagaaacggaaagtaacgttagtcggtagtaacgtcgtaggtaggaacgggtcctaagttacccgaaccngttacccacgtaaggaacctaacgtaaaacgacgttaaacgtaaccgtttccgtagttacgttaaccataactaaacggttacgaaaccttcgaacccgcgaaaggttccgaacggtaacgtaccggagttctagggttacttacggtaacgttcgggcgaaatacgggatccggtagacggggtacctacggggtatcgtaacgggg

SEQ ID NO: 220993 - DNA, 711 bp, Homo sapiens
  misc_feature: GYAE6OF02GKD2E.18.87.H10.1.454.CMB.1.raw
  modified_base (365)..(365): a, c, t, g, unknown or other
  misc_feature (365)..(365): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctggagactctcctgtgcaggccctgcattcatctttaatagttattggatgacacgtgggtcccgccgaggccgtccgggggaaggggccggaggtcggggtcggaccgaacataagngacgaagagtaggaacgtgaagaaagaactagtggtaggactacgtggtacggaacggggtccatttaccaccgtatccctaccgaaggaacgaaaccaaaccaaacgttaaacggtaaacctttacgttagttaacttaccgtacgaaacctaaaagttacggaaaaccctaggtaccccctaagtaagggaaacccgtacccggggaaacggtaaacccggtaccgggtcgtttacgggtttaacgttaagttttaacccggttaggttacgggaacccggtaaaagggccgtaacggtaggggttcgggtacccggtttagggggaacctaggttaccggggg

SEQ ID NO: 220994 - DNA, 625 bp, Homo sapiens
  misc_feature: GYAE6OF02ILD9Y.18.87.H10.1.454.CMB.1.raw
  modified_base (145)..(145): a, c, t, g, unknown or other
  misc_feature (145)..(145): n is a, c, g, or t
  modified_base (175)..(175): a, c, t, g, unknown or other
  misc_feature (175)..(175): n is a, c, g, or t
  modified_base (325)..(325): a, c, t, g, unknown or other
  misc_feature (325)..(325): n is a, c, g, or t
  modified_base (409)..(409): a, c, t, g, unknown or other
  misc_feature (409)..(409): n is a, c, g, or t
  modified_base (466)..(466): a, c, t, g, unknown or other
  misc_feature (466)..(466): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccnccaggctccggggaaggggccggagtgggnggccaacataatgcaagatggaactgaagaagaactatgtagactctgtgaagggcattcaccatctacgagagacaaacactaaagaactttatgtatctagactaaaatcgaacagcctagaagacgaccgtagacacggtctaggtnttaacttacgtgtacgacgaaagagcaaggttcggctagggaacagtcggacgtcgaggggaccaaagggcacggtccacgtcncctgacgtccctaccacgaacggccctactccggtcctcccgtcgcccgtcccgtcnccgtacgaggtacgcccaccgtaccgacgaccgacaaccgcggacccgtcccgacgggtccgtcggccgttacggacgtaaccggtaccctaccttacccgtaactaccgtaccgtaacgtcggacggtcgggccgtaggacgaacggccgtacgtaag

SEQ ID NO: 220995 - DNA, 582 bp, Homo sapiens
  misc_feature: GYAE6OF02GI57H.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcatctttaatagttattggatgcacgtgggtccgccaggcgtccggggaagggcccggaggtgggtggccaacataatgcaagatggaacgtgagaaagaactatgtggactctagtgaacgggccattccgactatcctcagagacaacaactaaacgtaacttactgtatcgtagacaaagttgaaacacgaccctacaacggaccgaccggaacggaaccgtacggccgttaggttacgttaagttccggtggtacgacggaaaggacgacgtagggtcgggtacgtcggggacaggttaccgggg

SEQ ID NO: 220996 - DNA, 738 bp, Homo sapiens
  misc_feature: GYAE6OF02H07V4.18.87.H10.1.454.CMB.1.raw
  modified_base (145)..(145): a, c, t, g, unknown or other
  misc_feature (145)..(145): n is a, c, g, or t
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (331)..(331): a, c, t, g, unknown or other
  misc_feature (331)..(331): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccnccaggctccgggggaaggggccgagtgggtgccaanataatgcaagntggaactgagaagaactatgtggactctgtgaagggccattcaccatctccagagacaaacactaagaactttactgtatctagacaaaatgaaacagcctacaaggacgccgaggacacggcttagtgttatttacgngtagacgtaagagcaggtggctggggacagtgggacgtcgcggggaccaaaggggacccacgggtcccaaccggttcctaccctcgaaccgtcccgtacccaaccggtaaccgggcccctaacgttccccgggttaccctttccccccgtacggggtccccgtccccgttcggacccgttacccggaacgggaccgtcccctaaacccggtccgaacggaacgacccgaaccgaccgggtccccgggtccccggtgggggtcctccgggtaccgtacggggttaaccaaccgggttaccctttacccctttccccgaaacgtttacccgttaccggtaacccggttacgggaccgggccggggttaccgtacgggttaacccgggaacgggtcccgtaacgtaacgg

SEQ ID NO: 220997 - DNA, 665 bp, Homo sapiens
  misc_feature: GYAE6OF02IWRBM.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggggtcccctgagactctcctgtgcaggccctgcattcatctttaatagttattggatgcacgtgggtccgccagggctccggggggaaggggccggaggtggggtggccaactataatgcaagatggaactggagaaagtaactagtagtacggactcgtagtaggaacggggccgtaatttccaactacgttacgtaccgaagtaacgaaacccaaaccaaaccgttaaaggtaaacctttacgttacgtaacttcgtagaaccgtaaatacgaaaccagtaccctactaacggaaccgaccggaagggaaccgaaccggggtcgttaggtttaggttacgtttaaccggtaggttacggaaccggtaaagggacgtacggtacgggttagggccggtaacggggtactacggttaacggggg

SEQ ID NO: 220998 - DNA, 704 bp, Homo sapiens
  misc_feature: GYAE6OF02IQQYM.18.87.H10.1.454.CMB.1.raw
  modified_base (296)..(296): a, c, t, g, unknown or other
  misc_feature (296)..(296): n is a, c, g, or t
  modified_base (347)..(347): a, c, t, g, unknown or other
  misc_feature (347)..(347): n is a, c, g, or t
  modified_base (515)..(515): a, c, t, g, unknown or other
  misc_feature (515)..(515): n is a, c, g, or t
tcagtacgagtatgcacgaccggtgctcgatttagcagtactgcgtgggtttgggggaggcttggtccagcctggggggtccctgagactctcctgtgcaggccctgcattcatctttaatagttattggatgcactgggtccgccaggcgtccgggggaaggggccggaggtgggtggcccaaacataatggacaagatggaactgaagaagaactatgtggactctgtgaaggccgattcaccatcacagacacaacactaagacttactgtactctagacgaaaatcgaaacngaccctacaaggacgacccgaagggaccacgggcttagtagtactttacgngtggacgaagagacgtaggtggcgtagggactaggtacggaccggttcggtacggggaacccgaaacgggacctaccgggtacccaacccggttccgtacccgtcgaacgccccgtacccgaaccgtaaccgggcccaacgttcccggtacccttccccgtggtcccncccgttacgcccgtaccgacggaccgccctacccgtccgaacgtcgaccgaaccgacggtacccggcccggtacggccgttccggccgttacggtaccgaacgtacccttaccgttaccctaagttacccgttacggtaacctcgggacggtacccgggtacgtacggtaccggaacggtcgacctaag

SEQ ID NO: 220999 - DNA, 646 bp, Homo sapiens
  misc_feature: GYAE6OF02GTI9T.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtcgggtccgccgaggccgtccgggggaaggggccgggaggtcggggtcggaccaacgataagtgacaagagtaggaactaggaagaagaactagtgtaggactcgtggtaggaacgggtcctaattccgaacctatccgtaccaaggaacgaaccaaaccaactaaagtaacctttactagttaactctagaacctaaatcggaaaccacgaccctacgaaggaccgacccggaaggaaccgacgggtcttaggttacgttaacgtttaccgtggttacggaaccggtaaaggacggtaccgtaaggggttcgggaccggtagggggtaacctaggttacgggg

SEQ ID NO: 221000 - DNA, 599 bp, Homo sapiens
  misc_feature: GYAE6OF02G26L5.18.87.H10.1.454.CMB.1.raw
  modified_base (546)..(546): a, c, t, g, unknown or other
  misc_feature (546)..(546): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtccgccgagggccgtaccgggggaaggggccggtaggtcggggtcggccaacgataatgacaagataggaactgaagaagaactatgtgactcgtagtaggaaggggtccaatttccaccgtagtcctaccgaaggtacgaacaaaccgaaccttaaagaaacctttactagtactctagactaaatggaaaccagccctacgagacgaccgaggaccaggtcctgtgttatttaccgnggttacggacgtaaaggcgacgtagggtcggacgttagggactaggttacggg

SEQ ID NO: 221001 - DNA, 554 bp, Homo sapiens
  misc_feature: GYAE6OF02GJAJU.18.87.H10.1.454.CMB.1.raw
  modified_base (479)..(479): a, c, t, g, unknown or other
  misc_feature (479)..(479): n is a, c, g, or t
  modified_base (512)..(512): a, c, t, g, unknown or other
  misc_feature (512)..(512): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcacgtggtccgcaggcgtccgggggaagggccggaggtgggtggaccaacgataagtgacaaagatagggaactgaagaaagaactatggtggactcgtgtgaagggccgattccacctatcctaccagacgaaccaacactaaagaaccttactgtaatctagacaaatgaaacagcctanagacgaccgagacgacggctgtagtatttacgnggtcgaacggaagagcgaggtggcgtaggggactaggtcggg

SEQ ID NO: 221002 - DNA, 666 bp, Homo sapiens
  misc_feature: GYAE6OF02I52ED.18.87.H10.1.454.CMB.1.raw
  modified_base (182)..(182): a, c, t, g, unknown or other
  misc_feature (182)..(182): n is a, c, g, or t
  modified_base (246)..(246): a, c, t, g, unknown or other
  misc_feature (246)..(246): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
tcagtacgagtatgcacgaccggtgctcgatttagcagtactgcgttgggtttggggaggcttggtccagcctggggggtccctgagactctcctgtgcaggccctgcattcatctttaatagttattggatgcactgggtccgccaggctccgggggaaggggccggagtgggtggccaanataatgcaagatggaactgagaagaactagtgtggactctgtgaagggccgaattcaccatccnccagagacaacactaagaacttactgtaatcgtagacaaatgaacacgcctcagacgccgaggaccgacggcttgtagtattacgtggtagacgaagngcgagtggcngggacaggtcggacgtcgnggggaccaagggccacggtcaccgtctccgtcgacgtccctaccgacccgaacgggcccgtacgtccggttcccgttcccccgtcggcccgtcccgtcgtccgttaccgacgggtaccgacccgtaaccgtacccggaaggaccgaccgaacgaccgcccgggtaccccggtcgggccgtccggtccggtacggtaccgtaacgggtaccttaacctacccgtaacgttaccgtacgttaaccgtacggacgggtacgggcggtacgggaccggtaacggaccgtacgtaacg

SEQ ID NO: 221003 - DNA, 729 bp, Homo sapiens
  misc_feature: GYAE6OF02HRKX7.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctggagactctcctgtgcaggccctgcattcattctttaatagttattggatgcacgtgggtccgccgagggccgtccgggggaacggggccggaggtggggtcggaccgaaacagtaatggacaaggagtaggaactaggaagaaagaactagtagtacggactcgtaggtaggaacggggtccgtaactttaccaaccgtacttcctacccgtaaggaaccgaaacaaaccgaaaccgttaaaacggtaaaccttttacgtacgtttaacttacgtagtaacctaaaagttaacggaaaccgaaggtacccctaacgaacggtaaccggaacccggggaacggaaccgtaacccggggtacgttacgggttttaacgttaacgttttaacggttcgggtaacgggaaccggtaaacgggtacggtaccggtaaggggttccgggaccgggttaacgggggtaactacggggttaccggggg

SEQ ID NO: 221004 - DNA, 689 bp, Homo sapiens
  misc_feature: GYAE6OF02GS860.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccaggccgtggggggtccctgacgactctctgtgcacggcctgcattcatctttaatagttagttggtatgctaccggtgggtcccgccgagggccggtaccggggggaacggggccgggaggtggggtcggaccaagagtaagtcgacaagacgtaggaacgtagaagaagtaacgttagtggtacggtacttacggtggtaacgggtaacggggtaccctagtttacccaacccgttactcccgtaccgaaggaaccgaaactaaaccaaaccgttaaagtaaccgtttaacgttacgttacttacgttacgaaactaaacgttacggaaacctaccgaccttacggaagtaccggaaccgacggaaccgaccggtcgtagttcgtacttacggtagtacggaaccgtaagtcgacggttagggtaccggtacggttacgggactaggttacccgggg

SEQ ID NO: 221005 - DNA, 576 bp, Homo sapiens
  misc_feature: GYAE6OF02GZVSR.18.87.H10.1.454.CMB.1.raw
  modified_base (465)..(465): a, c, t, g, unknown or other
  misc_feature (465)..(465): n is a, c, g, or t
tcagtacgagtatgcacgaccggtgctcgatttagcagtactgcgttgggtttggggaggtctcagagaggagccttagcccctggactccaaggcctttccacttggtgatcagcactgagcacagaggactcaccatggaattggggctgagctgggttttcctcgttgctattttagaaggtgtccagtgtgacgtgcagctggtggagtctgggggaggcttggtccagcctggggggtccctgagactctcctgtgcaggccctgcattcattctttaatagttattggatgcactgggtccgcaggcgtccggggaaggggccggaggtgggtggccaacataagtgacaagataggactgaagaagaactagtgtggactcgtgtagacggggccattcactatctaccagacgacaacactaagaactttactagttatactaggacaaagtgaacncgacctgaacgacgaccgaggaccgacggtcgtagtgttaacgttacgtggttcgaacgggaagtacggaccgtagggttcgggacggttacggggaccaggttccggggg

SEQ ID NO: 221006 - DNA, 664 bp, Homo sapiens
  misc_feature: GYAE6OF02FN7JI.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtctgggggaggcgttggtccagccgtggggggtccctgagactctcctgtgcaggccctgcattcatctttaatagttattggatgcacgtgggtccgccgacggcggtccgggggaacgggggtcccgggaagggtggggtcgggaccaaacataaactggacaaaggatagggaactggaagaaagaactataggtggacttctggtaggaaggggccgtattccaccattcctaccagaacgaaccaaacgaaccttaaagtaaactttacgtacgttaatcgtagacctaaatacgaaacgtacgacctacgaagtaacggacccggtaagggaacccgtacgggcgtttaggttaggtttaacgtttaacgttagggttaccgggaacggaaaggtacggacggtaacgggttggggacggtttagggggaactagggttaaccgggg

SEQ ID NO: 221007 - DNA, 579 bp, Homo sapiens
  misc_feature: GYAE6OF02FS4I8.18.87.H10.1.454.CMB.1.raw
  modified_base (537)..(537): a, c, t, g, unknown or other
  misc_feature (537)..(537): n is a, c, g, or t
  modified_base (551)..(551): a, c, t, g, unknown or other
  misc_feature (551)..(551): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggggtccctgagactctcctgtgcaggccctgcattcattctttaatagttattaggatgcacgtgggtccgccaggcgtaccgggggaaggggccggtaggtggggtcggccaaacaataatgacaaagagtaggaactggaagaagaactatgtaggactctagtagaacgggccagttccaccatcctcagacgaccaaacactaaagaacttactagttactctagactaaaatgaaacgcgtaccctacgaagtacgacccgaagggaccacggtcttgtcgtaagtttacnggtacgacgtaagngcgtaggtcggcgtagggactagtcggg

SEQ ID NO: 221008 - DNA, 574 bp, Homo sapiens
  misc_feature: GYAE6OF02JE68I.18.87.H10.1.454.CMB.1.raw
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggcccctgccattcattctttaatagttattggatgcacgtgggtccgccaggccgtccgggggaaggggccggaggtggggtggaccaacataatgcaagatggaactgagaagaactatgtaggactcgtgtgaaggggcctaattccaacctatccgtaccagacaacaacactaaagaactttanagtatctagacaaactgaaacacgcctanaggacgaccgaaggaccgacggtccttagtacgttacgttagtcgtaggaaccgaagacgtacgaggtcggacgtggggtactagtacgggg

SEQ ID NO: 221009 - DNA, 772 bp, Homo sapiens
  misc_feature: GYAE6OF02GTH3T.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaattggggctgagcttgggttttcctcgttgctattttagaaggtgtccagtgtgacgtgcagctggtggagtcgtgggggagcttggtccagccgtgggggtccctgagactctcctgtgcgacggccctgcctattcattactttaattagttattggatgcctacgtcgggtcccgccgacggggccggtaccggggggaaggggcccgggtagggtcgggggtcgggacccaaacgtaagtaagtcgacgtaaaggtagtagggtaaactggaacggaaagtaacttagttacggtacgggtaccttcgttagggtaggggaacggggtcccggtaactttcccgaaacccgtacgtttacccgtaccccgtaaagggaaccgaaaccctaaaacccgtaaacgttaaaacggtaaacctttacgtagtttaaccttaccgtaagaacctaaaagttacgaaaccgtacgtaccctagaacggaaccggtcccggaaacgggacccgacggtccgtttaggttacgtttaacgtttacgtgggtacggacggttaaaggacggtaccggttaagggcggtaccggtaggggacctagggttcgggtaaccggtcgggaccgggggaacctaacccggggg

SEQ ID NO: 221010 - DNA, 845 bp, Homo sapiens
  misc_feature: GYAE6OF02GLE41.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagcgttgggttttcctcgttgcttattttagaaggtgtccagtgtgacgtgcagcgtgggtggagtcggtgggggaggtcgttcggtccgaggcccggttcgggggggtcccctggacggtaccttccttcccgttggtcggaccgaccgggtcccctggcctatttcctaatttaccttttaaagttaggttttaagttgggtacttcgaccgtaccggttcggggtccccgaccggtacggggtccgggtacccgggggggaacggggtccgggtagggttcggggtacggaccaaagtataaacgtgaacgtaaaggtacgtacgggaaacgtaggaaaggtaaaacgtaaacgttagttacgggtacggtaccgttacggtagggtaacggggtaaacggggtccccgttaatttaccccgaaccgttaacgttccccgtaacccgaaagggtaaaccgaaaacccgtaaaaccgtaaaccgttaaaaaggttaaacccttttaacgtaagggtttaacctacgtaacgtaaactaaacgttacgaaacctacgtacccgtagaacgggaccgacccgggaaagaacccggtacggtgtttacggtaacgttacgtttacggtagtacggtaaccggaaggacgtacggttaaggtcgggtaaccgtcggggtacctagggttaccggg

SEQ ID NO: 221011 - DNA, 652 bp, Homo sapiens
  misc_feature: GYAE6OF02GVD0F.18.87.H10.1.454.CMB.1.raw
  modified_base (566)..(566): a, c, t, g, unknown or other
  misc_feature (566)..(566): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgctattcattactttaatagttattggatgacacgtcgggtccgccgagggccgtaccgggggaaggggccggtaggtcggggtacggaccaacagtaagtcgacaagataggaactaggaagaaagaactagtaggtacggactcgtaggtaggaacggggtaccctaatttccaacctacgtccgtaaccgagaacgaaaccaaaccctaacgtaaaacgttaacctttacgtagtaactctagaactaaagtacgaaacctcgaccctagaggaaccgacccggaggaacccncgggtacgttagttgttaaacgttcggtaggtacggaacggtaagacggacgtagggtcggacggtacgggactaggttaccgggg

SEQ ID NO: 221012 - DNA, 610 bp, Homo sapiens
  misc_feature: GYAE6OF02GXQO6.18.87.H10.1.454.CMB.1.raw
  modified_base (359)..(359): a, c, t, g, unknown or other
  misc_feature (359)..(359): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagtttattggatgcacgtgggtccgccgagggccgtaccgggggaaggggccgggaggtggggtggacccaaanataagtgacaagataggaactaggaagaagtaactataggtggacttcgtgtaggaacgggcctattaccaacctatcccgtacagacgaacaacctaacgtaaagtaaccttacttgtaactcgtacgaactaaagngaaaccgngtaccctagaagacggtacccgaagggaaccacgggattacggttagttacttaacgtggtagacggaagagacgagggtggaccggtagggtacaggtaccggg

SEQ ID NO: 221013 - DNA, 537 bp, Homo sapiens
  misc_feature: GYAE6OF02GOJQE.18.87.H10.1.454.CMB.1.raw
  modified_base (294)..(294): a, c, t, g, unknown or other
  misc_feature (294)..(294): n is a, c, g, or t
  modified_base (534)..(534): a, c, t, g, unknown or other
  misc_feature (534)..(534): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccattcaccatctccagagacaacactaaagaacttactgtatctgcaaatgaacagcctcaganccgaggacacggctgtgtattactgtgcgaaagagcagtggctggggacatggacgtctgggggcccaaaggggccaacgggtcaaccgtctcctcagcctcaaccaagggccccaatcggtccttcccccgtggccgacccctgccttccaggacgccacctccgagagcacagcggccctgggcctgcctggtacaaggactacttcccaatactcgtactgagcggctggcaaggcncaa

SEQ ID NO: 221014 - DNA, 598 bp, Homo sapiens
  misc_feature: GYAE6OF02G62OL.18.87.H10.1.454.CMB.1.raw
  modified_base (547)..(547): a, c, t, g, unknown or other
  misc_feature (547)..(547): n is a, c, g, or t
  modified_base (569)..(569): a, c, t, g, unknown or other
  misc_feature (569)..(569): n is a, c, g, or t
  modified_base (590)..(590): a, c, t, g, unknown or other
  misc_feature (590)..(590): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcgttggtccaggccgtgggggggtccctggacgactctcctgtgcacggccctgcattcattctttaatgttattggatgcacgtcgggtccgccgagggccgtaccgggggaacggggccgggaggtcggggtggacccaaacagtaatggacaaaggatagggaactaggaagaaaagaacttagtaggtacggtactcgtggtacggaacggggcctattcccaacacgttccaccgagacgaaccaaacaccgtaaacgtaaccttactagttatactgaacctaaatcgaaactcgcctagagacgaccgagacgacgntgtgtatacgtgtagacgaagngagaggtcggacgacggtacngggtacgg

SEQ ID NO: 221015 - DNA, 725 bp, Homo sapiens
  misc_feature: GYAE6OF02JL1PW.18.87.H10.1.454.CMB.1.raw
  modified_base (699)..(699): a, c, t, g, unknown or other
  misc_feature (699)..(699): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagcgttgggttttcctcgttgtcttattttagaaggtgtcctagtgtgacgtgcagctggtggagtcgtgggggagcttcggtccaggccgtcgggggtccctggagcctctccgtgtgcacggccctgctacttctattacctttaatagtttattggacttgtcctacgtcggggttcccgaccgagggtccggtaccggggggaggggacccgggtgggtggggtccggacccctaacgaagttaacgcggacgaaaggtacgtacgggaacgtacggaaaggaaaacgtaactacgttaggtaggtaccttccggttgggtaacggacggggtacctagtaaccgacctaacgtcccgtaccgaaggactaacgtaaaccaaccgttaaacgtaacctttacgtattataccgtagaacctaaaagtcgtaacgacgtccctaacggtagaaaccggccggtaaacggaaccggtacgtaccgtttagtaacgtacgtttaccgtaggtaccggaacgtaacggtagtacgacggttccgggnggttaacgggtacgtaaggtccgggg

SEQ ID NO: 221016 - DNA, 790 bp, Homo sapiens
  misc_feature: GYAE6OF02FKD4S.18.87.H10.1.454.CMB.1.raw
tcagtacgagtatgcacgaccggtgctcgatttagcagtactgcgttgggtttgggggaggtctcagagaggagccttagccctggactccaaggcctttccacttggtgatcagcactgagcacagaggactcaccatggaattggggctgagcgtggtttcgtcgtgctatttagaaggtgtcagtgtgacgtgcagctggtggagtcggtgggggaggtcttgggtccaggcccggttcgggggggtcccctggacgtacctcctccgtgtcgcgacggccctgctattctattctttaattagttagttgatgctacggtcgggtcccgccgaggccgggtaccggggggaacgggggccggtagggtcggggtacgggacctaaacgtaagtaacgtcggacgtaaaggtacgtaagggtaacgtaggaagtaaaacggtaacttaagtacgggtacggtaccgttcggttacgggtagggaacggggtaccgttaactttacccgaaaccttacgttacccctaaccggtaaaggaaacccgtaaacctaaaaccgtaaaccgttaaaacgttaaaccttttaacggttacgttaaacttaccgaacgtaactaaacgtacggaaaaccttaccgggtcctaaacgggaacgtaccgggaccggaaacggtaccgaacggggttcttagggttaccgttaaggtttaccgtgggtacgtaaccggtaaaggtcggtacggtaacggttccgggtacggtaggggtaactcggggtttaaccggg

SEQ ID NO: 221017 - DNA, 754 bp, Homo sapiens
  misc_feature: GYAE6OF02HCJEW.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagctgggtttcctcgttgctatttagaaggtgtccagtgtgacgtgcagctggtggagtcgtgggggaggcgttggtccaggtccgtcggggggtccctggacgcctctccgtgtagcgacggccctgcctattcattactttaagtagtttagtagtattgacctacgttcgggtccgccgagggtccgtaccgggggaacgggggcccggtaagggtcgggggtcgggacccctaaaacgtaagttaaacgtacggaaccgtaaaggtaacgttaacggggtaaaccgtaggggaaaacggtaaaaggtaaaaccgttaagggtcggtaacggggtaaccgtttcgttagggtaacgggtaaacggggtacccgtaacgtttacccgaaacctacgttacctaccggaagtaaaccggaacaaacctaacgtaaacgtaaactttactacgttaactcgtagaaacctaaagtacgaaactcgaaccctaagaaccgtacggaccggaagaccgacggtactacgttagttaaccgttcgtacggtagtaacgaaggtacgtaggacgggtttcggacggttacgggacctaggttacgggg

SEQ ID NO: 221018 - DNA, 610 bp, Homo sapiens
  misc_feature: GYAE6OF02FHBZB.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttgggtccaggtcccgtggggggtccctgacgactccgtcctggtgcaggccctgctattctattctttaatagttattggtatgcacgtggtccgcaggcgtccgggggaaggggccggaggtgggtcggccaaacgtataaagtgacctaaaggatagggaactaggaagaagaactagtgtcgactcgtgaggaacggggcctatcaccatcctcagacgaacaacaactaacgaacttcgtatactctagactaaagtcgaaccgacgtaccctagaacgaccggtaccgaacggacgtacgtcgtagttagttacgttaacgtggtacggaccggtaagacgccggtaaggttcgggacgaggggtactcggttaacgggg

SEQ ID NO: 221019 - DNA, 683 bp, Homo sapiens
  misc_feature: GYAE6OF02I5QKQ.18.87.H10.1.454.CMB.1.raw
tcagtacgagtatgcacgaccggtgctcgatttagcagtactgcgttgggtttgggggaggcttggtccagccctggggggtccctgagactctcctgtgcaggccctgcattcatctttaatagttattggatgcactgggtccgccaggcgtccggggaaggggccggagtgggtggccaacataatgcaagatggaactgagaagactatgtggactctgtgaaggccattcaccatcctccagagacaacactaaagacttactgtatctagcaaaatgaacacgcctacagacgccgaaggtaccacgggctgtcgtattactgtagcgaagagcaggttggcgtagggacagtcgggacgtcgtggggaccaaacgggacccaggtccacccgtctccgtccaacggtcccctacccgaacccgaacgggccccaacgttcccggttaccctttacccccgtcgggcccgtcccccgtcgtcccttaccgaacgggaccgacccaaccccgtccggaacgacgaccgaaccgaccgggacccggtccccggtaggggcccgttaccggtcccgttacgggtaccaacgggtaccttacccttacccgaacgtttaccgttaccgtaaccgttaggacggcccgggtacgtccggaccgaacgggccgtacgtaacgg

SEQ ID NO: 221020 - DNA, 900 bp, Homo sapiens
  misc_feature: GYAE6OF02F7EJJ.18.87.H10.1.454.CMB.1.raw
  modified_base (254)..(254): a, c, t, g, unknown or other
  misc_feature (254)..(254): n is a, c, g, or t
tcagtacgagtatgcacgaccggtgctcgatttagcagtactgcgtttcgggtttggggtaccggtaacctacgagacgaggagccttagccctcggacctccaagggcctttccacttggtcgagtcgaggctactgacgcaacacgaggactcaacctataggaagttggggctggacgtcgtggggttttcctcgttagacttagttttacgaaggtgtaaccgacgtgggtaggacggtcgacgacgacngggtcggaacggttccggttggggggaacgggtccgttagggtcccgtacgtcccgtaccgggggggttccccttggacgaccgtaccgtcctggtcgtacgaacggggccccgtggtaccgtaggtttacctacttactttttaaaattaggttaagtttggggtaacttggtacgtaacggttcggggtaccccgaccgtaacgggtaccggtacccggggggaaaagggggccccgggtaagggttacgggggttacggggaccctaaacgaaccgtaaaattcggaaccgaaaagaataagggtaacctaaggaaacggaaaacgtaacttagttaagttacggaaactccgttaaggagggaaaccgggtcggtaaacttacggaaccctaacgtacccgttaaccggaacggtaactaaaccgtaaaaccgtaaccgttaaaaggttaaaccgtttaaacgtaagttaaccgttactaaccggtactaaaaccgtccggtaaaacgacgttcccgttaaggtacggaacgttaccgggaacggacggaaccggtaccgtaggttagtacttacgttacggtcgtaaccggaacgtacggacacgggttaccggacggtcggggtacctacggttaccggg

SEQ ID NO: 221021 - DNA, 700 bp, Homo sapiens
  misc_feature: GYAE6OF02JANWX.18.87.H10.1.454.CMB.1.raw
  modified_base (363)..(363): a, c, t, g, unknown or other
  misc_feature (363)..(363): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagctgggtttcctcgttgcttattttagaaggtgtccagtgtgacgtgcagctggtggagtcgtgggggaggctttgggtccctaggcccgtgggggggtccctgacgacgttctcctgtgcacggccctgcattcattctttaatagttattggatgcacgtcggtccgccaggcgtccgggggaagggccgggaggtgggtcggaccgaanaagtatgacaaagacgtaggaactaggaagaagaactagtgtaggtaactcgtaggtggaacggggtcctaacttaccgaaccgaagttcctaccgaaggtacaacgtaaacctaaacgtaaacgttaaaccttagtacgttaactaccgtaggtaaccaaaaacgttcggaaaacctacccggtacccttagaacgggtaaccgtacccggaaacggtaccggaccgggttacttagggttcgttaacggtttacccgttaggtaaccgtaacgggaacggtaaggtaccggccgggttaagggtcccggtaaggggacccttaaggtacccgggg

SEQ ID NO: 221022 - DNA, 708 bp, Homo sapiens
  misc_feature: GYAE6OF02JGCOR.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccaggccgtgggggggtccctggacgtactcctcctggtgcacggccctgctattcattctttaatagttattggattgctacgtcgggtccgccgagggtccgtccggggggaacggggccgggtaggtcgggggtacggccgaaacgagttaacgtcgaacaaggaagtacgggaacttaggaaagaaacgtaaactagtcggtaggtacctgtaggtaggaacggggtacctattacccaacgtactccctaccgaagaccgaaactaaaccgaactaaacggttaaacctttacgtagttactctacgaaacgtaaatacggaaaccacgtaccctacgaacggtaacggacccggaaacggtaacccggacgggtcttagggtttactaacgtttaaccggtggttaccggaacggtaaaggtacgcggtaaacgggttcgggacggtttaacgggacctagggttaaccgggg

SEQ ID NO: 221023 - DNA, 804 bp, Homo sapiens
  misc_feature: GYAE6OF02JC6DX.18.87.H10.1.454.CMB.1.raw
  modified_base (758)..(758): a, c, t, g, unknown or other
  misc_feature (758)..(758): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctatttagaaggtgtccagtgtgacgtgcagctggtggagtcgtgggggagtcgttggccaggtcccggtcggggggtccctgacgactctccgtgtgcgacggccctgctacgttctagttactttaaagttagtttagttcggattcgaccgtacgtccggggtcccgaccggtacgggtcccgggtaccgggggggaacgggggtcccgggtaagggttcgggggtaccggaacccgtaaacgtaagttaaagtcggaaccgtaaaggtaagtacgggaaacgttagggaacgtaaaaagtaacgtagttaggtacggtacgttacgtagggtacgggaaaccggggtcccttaagtttaccccaaccgttaacgttcccgttaaccggaaaggtaaaccgaaacccgtaaaacctaaaccgtttaaacgttaaaaccctttcgttaacgttaacttcccgtaaggaaacttaaaacggcgaaacctaccgtaccctaagaacggtaccggtaccgggaagaacccgtagggtccttaggttaacgtttacgttaaccggtggtaccgggtaacgaacgggtacncggtaacgggttcggtaacggtacgggtaatacccgggtttagggg

SEQ ID NO: 221024 - DNA, 660 bp, Homo sapiens
  misc_feature: GYAE6OF02G4UH7.18.87.H10.1.454.CMB.1.raw
  modified_base (185)..(185): a, c, t, g, unknown or other
  misc_feature (185)..(185): n is a, c, g, or t
  modified_base (360)..(360): a, c, t, g, unknown or other
  misc_feature (360)..(360): n is a, c, g, or t
  modified_base (537)..(537): a, c, t, g, unknown or other
  misc_feature (537)..(537): n is a, c, g, or t
  modified_base (572)..(572): a, c, t, g, unknown or other
  misc_feature (572)..(572): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtntccagtgtgacgtgcagctggtggagtcgtgggggaggcttggtcccagccgtgggggtcccctgacgacctctccgtgtgcacggccctgctattcattactttaatagttattggatgtacacgtggtccgcgaggccggtacggggaagggccggaggtcgggtggaccaanaagtatcgacaagacgttaggaactggaaagtaaagtaaacgtagtaggtacggtactcgtagtagggaacgggtccgaatttccaaaccctgtaccctaccgaaagtacgaaaccaaaccgtaactaaaggtaaacctttagtaggtaccttacgagaacctaaagtacggaaacnccgtacctagaaggacgacccgggtaaaggaccgnggttacttgtaacggtttaacgttacgtccggagaacccgaaagtcggtaccggtaggttcggaccggtacggggaacttggtacggg

SEQ ID NO: 221025 - DNA, 587 bp, Homo sapiens
  misc_feature: GYAE6OF02H5KT1.18.87.H10.1.454.CMB.1.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (397)..(397): a, c, t, g, unknown or other
  misc_feature (397)..(397): n is a, c, g, or t
  modified_base (442)..(442): a, c, t, g, unknown or other
  misc_feature (442)..(442): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccgccaggctccgggggaaggggccggagtgggtggccaacataatgcaagatggaactgagaagaactatgtggactctgtgaagggccattcaccatctccagagacaacactaagaactttacngtatctgactaaaatgaaacagcctnaagacgccgaggaccacggctagtgtattacnggtcgacgaagngcagtggctagggacagtggacgtcgtaggggaccaagggccacggtcaccgtctcncacgccctccaccgacggcccagtccggtccttccccgtcggccnccctcgcctccgagacgaccacctcgacgacgcacgcggccgccgtcgggcctcggccgtacgtacgaacggtaccttaccgtacccgtaacttaccgtacgtacgtacggacgcgggtccgtacggacgaacggccgagtaacg

SEQ ID NO: 221026 - DNA, 667 bp, Homo sapiens
  misc_feature: GYAE6OF02FFMYO.18.87.H10.1.454.CMB.1.raw
  modified_base (143)..(143): a, c, t, g, unknown or other
  misc_feature (143)..(143): n is a, c, g, or t
  modified_base (186)..(186): a, c, t, g, unknown or other
  misc_feature (186)..(186): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
tcagtacgagtatgcacgaccggtgctcgatttagcagtactgcgttggggtttgggggaggcttggtccagcctgggggtccctgagactctcctgtgcaggcctgcattcatctttaatagttatggatgcactgggtccncaggctccggggaagggccgagtggtgccaatataatgcaagntggaactgagaagtactatggtggactcgtggnggaacgggcctattcaccntccncagagacaacgactaagactttcngtatctagcaaatgaacnggcctagagagcccggaagaccacggtnttcggtnttaactactggtcgacgaaagtgctaaggtggacttggggactagcgggtactcggtacggggaccaacggggcccacgggttcgacccgttcttcccgagacgtccctaccgaaccgacgggtccaacgttcccggttacccttccccgtacgggtcccgacccgtacgtcctaccgaggacgacctacccgtcgtaacgcggacccacggacggtcccggtacccgttgggacctcgtaccggttacggtaccggaacggttacccgtaccttaccgtaacgtacccgttacggtaaccgtcggtacggcgggaccggttacgggaccgtaacggcgttaccgacg

SEQ ID NO: 221027 - DNA, 676 bp, Homo sapiens
  misc_feature: GYAE6OF02IMJ2A.18.87.H10.1.454.CMB.1.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttattttagaggtgtccagtgtgacgtgcagcgtggtggagtcgtgggggaggcgttggtccaggcccggtgggggggtccctggacgacctctcctgtcgcacggccctgctattcattactttaatagttagttggatgctacgtcggtccgcgacggcgtcggggaaggggccggnggtgggngaccaacagtaagtgacaagagtaggaactaggaagaaagtaaactagttaggtacggtacgttcgtagggtacgggaacggggtaccgtacgtttaccaccgttaacttacccgtaaccgaaggaacgaaacctaaacgtaaaccgttaaaacgttaaaccttttaacgtaggtttaaccttacgtacgtaactaaagtaaccgaaacgtacgcctaacgaggaccgaccggaacggtaccgacgtgtacggttatacgtttcggtggtacggaacgaaggacgacgtagggtcgacgggtaggacgtacgtacgggg

SEQ ID NO: 221028 - DNA, 930 bp, Homo sapiens
  misc_feature: GYAE6OF02I0RV7.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctgggtggagttcgtgggggaggcttggtccagcccgtgggggggtccctggagtactcgtcctgtgccgacggccctgcattcattctttaatagttagttggattgctacggtcgggtcccgcgacggccggtaccggggggaacggggcccgggagggttcggggtacggaccccgtaaaacgtaacgtaagtcggaccgtaaaggtagtacggggaaacttagggaaacggtaaaacggtaaaccttaagttacgggttagggtaaccgtttaccggttagggtaacggggaaacggggtaccccggtaacttttaaccccggaaacccgttaacgtttaccccgttaacccgaaaagggaaacccgggtaaacccaaaaacccgttaaaccgttaaaaaccgggttaaaaacccctttttacgttaacggtttaaaccttaaccgttaagggtaaaccctaaaaaggtttaaccggaaaacccgttaaccggtaacccccttaaacgggtaaccgggaaacccgggtaaaccccgggaaaccggggtaaaccccggtaacccggggttcgttttaaccgggtttaacgggtttttaaaaccgttacccggttaggggtttaaccgggtaaaccggaaaacgggtaccgggttaacccgtaagggggtttcccggggtaaccgggtaacgggggtaacccgttaagggtttaaccccggggggg

SEQ ID NO: 221029 - DNA, 647 bp, Homo sapiens
  misc_feature: GYAE6OF02IAZR7.18.87.H10.1.454.CMB.1.raw
tcagtacgagtatgcacgaccggtgctcgatttagcagtactgcgttggggttttgggggaggtctcagagaggagccttagccctggacctccaaggccctttccacttggtgatcagcactgagcacagaggactcaccatggaattggggctgagctgggttttcctcgttgcttattttagaggtgtccagtgtgacgtgcagctggtggagtcgtgggggaggcttggtccaggccgtggggggtcccctggagactctcctgtgcacggccctgcattcattctttaatagttattggatgctacgtcgggtccgccaggccgtaccgggggaaggggccggaggtcggggcgccaacataatgacaagataggaactgaagaagaactagtgtggtactcgtaggtaggaacgggcctaacttccaacctactcctaccgaagacgaaaccaactaacgtaaaacgaacctttacgtagtaactactacgaactaaagtacgaaacgacgacctaccgaaggtaaccgacccgggaaggaaccgaccgggtcttacggttagtttaacgttccgtaggtacggaacggtaaacgacgtcgtaagggttcgggtaccgtaggggtaaccctggtaccgggg

SEQ ID NO: 221030 - DNA, 301 bp, Homo sapiens
  misc_feature: GYAE6OF02GOO0U.18.87.H10.1.454.CMB.1.raw
  modified_base (257)..(257): a, c, t, g, unknown or other
  misc_feature (257)..(257): n is a, c, g, or t
  modified_base (259)..(301): a, c, t, g, unknown or other
  misc_feature (259)..(301): n is a, c, g, or t
tcagtacgagtatgcacgaccggtgctcgatttagcagtactgcgttgggtctgggacagacttcactctcaccatcagcagactggagcccgaagattttgcagtgtattactgtcaacagtgtgctgaggtacctctcacgttcggcggagggaccagggtggacatcaagcgaactgtggctgcaccatctgtcttcatcttcccgctatctgacatactcgtactgagcgggctggacaaggccgcaatagcntnnnnnnnnnnnnnnnnnnnnnnnnnnnnnnnnnnnnnnnnnnn

SEQ ID NO: 221031 - DNA, 669 bp, Homo sapiens
  misc_feature: GYAE6OF02FWBNK.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcattctttaatagttattggatgcacgtgggtccgcaggcgtccgggggaaggggccggaggtggggtcggaccaacgataatgacaagatggaactgaagaagaactagtgtagactcgtgtacggaagggccgtattccactatcctacgaagacaacaacaaccgtaaagtaaccttacgtagtaacttacgtacgaactaaagttacgaaacctacgtaccctaacgaacgggaccgtaacccgggaagggtaacccgaaccggggtacctttacgggtttacgttaaacgttttaccgtagggttaacggaaccgggttaaacgggaccggtacggttacgggtaacggggtaccggttacgggggtaaactagggtttaacccggggg

SEQ ID NO: 221032 - DNA, 796 bp, Homo sapiens
  misc_feature: GYAE6OF02I521P.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccaggccgtggggggtccctggacgtactctcctgtgcgacggccctgctattcattactttaatagtttatggatgcacgttcgggtcccgccgacgggccggtaccggggggaacgggggcccgggtagggtcgggggtcggaccctaaacgaacgttaagtcggaactaaaggagtaacgggtaactagggaagtaaaagtaaaccgttagttaggtacggaaccttcggttacgggtaacgggtaacggggtccgtaaacttttcccgaaaccttacttcccgtaccgtaaacggaacgtaaacccgaaacctaaaccgttaaaacgttaacttttaaccgtacgtttaaccttacgttaccgaaaccgttaaacgtaacggtaaaccaccggtaccctaacggaaaccgggacccgggtaaccgggaaaccgggtaccgaccggggttcttaggtttaacgttaacggtttaccggtttaggacggaaaccggtaaggaacccgggtcggtagggttaaccggggccggttaacggggtaacccggttaggggtacccggggg

SEQ ID NO: 221033 - DNA, 661 bp, Homo sapiens
  misc_feature: GYAE6OF02HT193.18.87.H10.1.454.CMB.1.raw
  modified_base (623)..(623): a, c, t, g, unknown or other
  misc_feature (623)..(623): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggttgagcttgggtttcctcgttgctattttagaaggtgtccagtgtgacgtgcagctggtggagtcgtgggggaggcttggtccaggccgtgggggtcctgagctctctgtgcaggccctgcattcatcgtttaactagttattggattgctacgtgggtccgccgagggtccgtccgggggaagggcccgggaggtgggtcggacccaacgataaagtgacgaaaggagtacggaactggaagtaaagaacttaagtggtacggaccttgttcggtaggaacgggtccgtactttaccgaacctatcctaccgagaacgaaccaaacctaacgttaaaacgtaacctttaccgtagttaacttaccgtagaaactaaaagtggtaaaaccctcgtaccctagacggtaaccggaccgggtacgggaacacggggtctaggttacgttactttacggtgttacgacggtaaagcgngtaaggtcgggacgtacgggacttaggtgggtaaccgg

SEQ ID NO: 221034 - DNA, 587 bp, Homo sapiens
  misc_feature: GYAE6OF02HCIUH.18.87.H10.1.454.CMB.1.raw
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
tcagtacgagtatgcacgaccggtgctcgatttagcagtactgcgtggagtctgggggaggcttggtccagcctggggggtccctgagactctcctgtgcaggccctgcattcatctttaatagttattggatgcactgggtccgccaggctccgggggaagggccggagtgggtgccaacataatgcaagatggaactgagaagaactatgtggactctgtgaagggccattcaccatctccagagacaacactaaagaacttactgtatctgacaaatgaacngcctnagagccgagacacggctgtgtattactgngacgaagngcaggtggcgtgggacagtcggacgtcgtggggaccaagggcccacggtcacgtctcctcacgccctaccaccgaacgggccctacgtccggttcccttccccgtcggcccgtccctcgcctcgacggacgaccaccgtaccgagacgcaacgcgccggtcccgtacgggcctcgtccgtacggacgtaacggtaccgttacccttaccctacttaccgtaccgttacgtcggacggcgggtccgtcgggacgacggtcg

SEQ ID NO: 221035 - DNA, 713 bp, Homo sapiens
  misc_feature: GYAE6OF02IEJ60.18.87.H10.1.454.CMB.1.raw
  modified_base (292)..(292): a, c, t, g, unknown or other
  misc_feature (292)..(292): n is a, c, g, or t
  modified_base (544)..(544): a, c, t, g, unknown or other
  misc_feature (544)..(544): n is a, c, g, or t
tcagtacgagtatgcacgaccggtgctcgatttagcagtactgcgttgggtttggggaggtctcagagaggagccttagccctggactccaaggcctttccacttggtgatcagcactgagcacaggaggactcaccagtggaattggggctgagtcgttgggttttcctcgttgcttattttagaggtgtccagtgtgacgtgcagctggtggagtcggtgggggagtcttgggtccagccggtggggggttccctggagccgtctccgtggtcgccgacggccctgactnttcattacttttaagtagtttagtgatgctacgtcgggtcccgacgacggtcggtaccgggggagggcccggtgggtgggcgaccaacgtagtaagtcgacgtaagagtacggaactaggaacgaaaggtaacttgtaggtacgtacgtcgtagggtacgggaacgggtcctattaccgaaaccctgtacctacgaagaactaaacctaaaccgtaacgtaaacgttaaaccttattacgtattaccgtaanacctaaagttacgaaactccgtaccctaaaggaccgtacgacgggaacgaccggtacggtacgtttggtaaccgttttacgttaacggtcggttacggaaaccggaaggtacccggttagtaaggggttcccgggtacgggtaaggggttaccctagggtacccggggg

SEQ ID NO: 221036 - DNA, 644 bp, Homo sapiens
  misc_feature: GYAE6OF02G8Q4S.18.87.H10.1.454.CMB.1.raw
  modified_base (318)..(318): a, c, t, g, unknown or other
  misc_feature (318)..(318): n is a, c, g, or t
  modified_base (502)..(502): a, c, t, g, unknown or other
  misc_feature (502)..(502): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccaggtccgtgggggggtcccctggacgactctccgtgtgcaggccctgcattcattctttaatagttattggatgctacgtcgggtccncgaggccgtccggggggaagggccggaggtggggtcggaccaacagtaatggaccaaaggtataggaacctggaacgaaagtaactagtggtagaccttgtgggtaggaacggggtccctaatttcccgaacccgtataccctccgtaaagggacaacaaaccaactaaagttaactttacgtnttaatcgtagtaccgtaaaatcgaaacgtacgtccgttacgaaggtacccggcggaaacggacgtacccgggtattgttacgtacttacggtgtacgggacgaaggcgacgaaggttcggacggtgggaccgtagtaccggg

SEQ ID NO: 221037 - DNA, 713 bp, Homo sapiens
  misc_feature: GYAE6OF02G0E89.18.87.H10.1.454.CMB.1.raw
  modified_base (569)..(569): a, c, t, g, unknown or other
  misc_feature (569)..(569): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgcttatttagaggtgtccagtgtgacgtgcagctggtggagtcgtgggggagtcgttggtccagccggtggggggtccctggagtacctctccgtgtcgcgacggccctgctattcattctttaatagttagttggatgacctacggtcgggtcccgccgtacgggtccggtaccggggggaacggggccgggtaggtcggggtacggaccgaaacgtaagttaaggtcgaaccgtaaggtagttaacgggtaaaccgtaggaagaaacggtaaacgttagttacgggtacggtacttcggtaggtacggaaacgggtccgtacgttaccgactacgtcctaccgaagtacgaacctaaacaaacgttaaacgtaactttacgtagtactcttaagactaaagtagaaaccncgtacctacgacgaccggacccggtaagggaccgtacggtacgttacgtagttaacttcggttagggacgtacggaacggcgtccgagggttcggacggtagggtacagggttcggaacggtcgggtaccgggacctaacgggg

SEQ ID NO: 221038 - DNA, 796 bp, Homo sapiens
  misc_feature: GYAE6OF02IDJPL.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcacagtaggtaagttggggctgagtcgtttcgggttttcctcgttgtacttaagttttaaggaggtcgtacctagttgtgacgtgcagcgtgggtggtagtcggtgggggagtcgttggtccgacggtcggtcggggggtccctggacgtacctctcgtgtgccgacgcctgctatcatttactttaatagttagtggtatcgactcgtacgggtcccgacgtaccgggtaccgggtaccggggggggaaacggggtcccggggtaagggttcgggggtaaccgggaccgtaaaactaacgttaaacgggtgttaaaccggaaggtaacggttaaacgggaaaccgttaagggaaaaggaaacggttaaacgtaggttaggtaccgggttaacttacgggttacgggtaaacggggacggggtaccccgtagttaaccccgtaacttaccgttaccgtacggaacggtaaacgaaacccgtaaacctaaacgttaaaaccgtaaactttacgacgtttaacgtacgtaacgtacgtaaaactacgaaacccgtcacctggtaaacgccggggtacgaacgggacctcggtagtttacgtagttaacctagtcggtagacgaagtagtcgaggttgcggtaggctggtacggtcgtggtacccgggaagtacccggg

SEQ ID NO: 221039 - DNA, 670 bp, Homo sapiens
  misc_feature: GYAE6OF02IYSKH.18.87.H10.1.454.CMB.1.raw
  modified_base (268)..(268): a, c, t, g, unknown or other
  misc_feature (268)..(268): n is a, c, g, or t
  modified_base (543)..(543): a, c, t, g, unknown or other
  misc_feature (543)..(543): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctgggtggagtcgtgggggaggtcttggtccagccggtggggggtccctgacgctctcctgtgcncggccctgcattcattctttaatagttatggatgactacgtcgggtcccgcgacgggcggtaccggggggaacgggggccgggtagggtcggggtcggaccgaaacgtagtaacgtggacaagtagtaggaactggaaagaagaactagtggtgactcgtgggtaggaacggggtccctaagtccaacctacttcctaccgaagacgaacctaaacgaaccttaaacggtaactttacgtagttacgtactacgtaaacctaaatacggaaaccncggtacctaggaacggaaccgaacccgggaggtaaccgaccggggttctggttaacgtttaagtttccggtggttaaccggaacggaagcggtcgaagggtcgggaccgtagggacctggtacgggg

SEQ ID NO: 221040 - DNA, 836 bp, Homo sapiens
  misc_feature: GYAE6OF02JW23H.18.87.H10.1.454.CMB.1.raw
  modified_base (147)..(147): a, c, t, g, unknown or other
  misc_feature (147)..(147): n is a, c, g, or t
  modified_base (238)..(238): a, c, t, g, unknown or other
  misc_feature (238)..(238): n is a, c, g, or t
  modified_base (407)..(407): a, c, t, g, unknown or other
  misc_feature (407)..(407): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactggggtcccnccaggccgtccgggggaaggggcccggagtggggtcggccaaacagtaatgcaagataggaactgaagaagaactagtgtaggactcgtgnggaacgggccgtattccacctatctccgaagtacgaacaacgtaactaaacgaactttactagtaactctacgaacaaatacggaaccagtccctacgaaggacgcccggaaaggactaaccgggtcttaggtagttaactttaaccggtgtacggaaccgtaaaaggngaccgtaagggtacgggtcgtacggggaaaccttaggttacggggaccgtttacgggaaggggggaacccccgaaaaaggggtcccctacggggtaccctaacccgttccgtccctaccgacgtccccgtaccgaacccggaaacggtcccctacggttcccggttcccgttaccccgcggtacccgtacccgtccgtccgtacccggtaacggaccgtacccgacccgtaccggtaacgggaacctaccgtaccggaccggtccccgggtacccggtccgggtaaccgtcccggttacccggtacgggttaacccgtaaccggttaacccgttcccgttttaaccccgaacgtttaacccggttcgttaacccggacggttaccgggccggtaccgggtacggtaaccggaaccggtccgactaacgg

SEQ ID NO: 221041 - DNA, 798 bp, Homo sapiens
  misc_feature: GYAE6OF02GNRQN.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccaggccgtggggggtccctggagactctcctgtgcaggccctgctattcattctttaatagttattggatgctacgtcgggtcccgaccgagggccggtccggggggaacggggtccgggaggtggggtacggaccaaacgtagttaaagtgaccgtaaaggtacgtagggaaaccgtaggaaaggaaaacgtaaaccttagttaggtacggtaaccttcgttagggttaacggaaacgggggtccgtaacgtttacccgaacccgtacttacccgttaccgaaaggtaaccggaaacccaaaacgtaaaccttaaaacgggtaaaccctttacggtagttaacttccgttaaggaaacctaaaagttcgaaaaccctcggaccctaggaaacggaccggacccggtaaagggacccgtaccgggttcttacggttagttaaacgtttaccggtaggttacggaacggtaaacggagggttaccggtaacggggttacggggaccggttagggggaaccttacggggttcgggggtaaacccgttccggggtaacggggggaaccccgtaaacccggggg

SEQ ID NO: 221042 - DNA, 674 bp, Homo sapiens
  misc_feature: GYAE6OF02IJA4V.18.87.H10.1.454.CMB.1.raw
  modified_base (378)..(378): a, c, t, g, unknown or other
  misc_feature (378)..(378): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
  modified_base (581)..(581): a, c, t, g, unknown or other
  misc_feature (581)..(581): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgttgggttttcctcgttgtcttattttagaaggtgtccagtgtgacgtgcagcgtggtggagtcggtgggggaggtcgttcggtccacggccggtcggggggtccctggacgcctctcctgtcgcgacggccctgctattctacttactttaaattagtttagttggatgcctacgttcgggtcccggaccgacgggtccggtaccggggggacggggccgggngggtcggggcggaccgaacgtagtaacgtgacgaaagtagtacggaacgtaggaaagtaaacgtaactagtacggtaggtaccgttacgtaggtaacgggaacggggtaccctaattacccgaacctactacccgacgaagaaacgaaccctaaactaacgtaaactaacctttactgttaactcganaactaanacgtaacncgtaccacgaacgacgaccggaagccgacggtctaggttattacgtcgtggacgacgaagcgacgtaggccggacggtaggccgtaggtcggg

SEQ ID NO: 221043 - DNA, 797 bp, Homo sapiens
  misc_feature: GYAE6OF02I3FL3.18.87.H10.1.454.CMB.1.raw
tcagtacgagtatgcacgaccggtgctcgatttagcagtactgcgttgggtttgggggaggtctcagagaggagccttagccctggactccaaggcctttccacttggtgatcagcactgagcacagaggactcaaccatggaagttggggctgagtcgttgggttttccttcgttgtcttattttaggaaggtgtccgagtgtgacggtgcagcgtgggtggagtcgtgggggaggtcgttggtccgagccggttcggggggtccctggacgacctccttccgtggtcgccgacggccctgctacttctatttactttaaagttagtttagttgggtattggtcctaccggtcgggtcccggaccgtacggggccgggtaccgggggggaacggggtccgggagggtcggggtacggacctaacgtaagttaacgtggacgaaagtaggtaagggtaacgtaggaaaggtaaaacgtaacgttaagttcggtacggtacgttcgttagggtaacggaaccgggtaccgtatttacccaacgttcctacgttacccggaagtaaaaccgtaacctaaacctaaacgtttaaaacggttaacctttaacgttacgtttaacttcccgtaactaaaccgtaaagtaaccggaaacctaaccgggtccctaaaggtacgacccggacgggtaaacgggaacccgacggttaggtttagtaggttttaccgtttggacggtacggtaacgaagggtacgtcgtagggttaccgggacgggttacggaacggtcgtacgggg

SEQ ID NO: 221044 - DNA, 660 bp, Homo sapiens
  misc_feature: GYAE6OF02GA3E8.18.87.H10.1.454.CMB.1.raw
  modified_base (277)..(277): a, c, t, g, unknown or other
  misc_feature (277)..(277): n is a, c, g, or t
  modified_base (469)..(469): a, c, t, g, unknown or other
  misc_feature (469)..(469): n is a, c, g, or t
  modified_base (558)..(558): a, c, t, g, unknown or other
  misc_feature (558)..(558): n is a, c, g, or t
  modified_base (642)..(642): a, c, t, g, unknown or other
  misc_feature (642)..(642): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctgggtggagtcgtgggggaggtcttggtccagccgtggggggtccctgagacctctcctgtgcaggccctgccnttcattctttaatgttattggatgctacgtcggtccgccgaggcggtaccgggggaggggcccgggtagggtcggggtcggaccctaaacgagttaaagtcgacgaagagtacgggaactaggaagaacgtaaacgtagtggtacggaccttcgtagggtacggaacggggtcctaacgttccgaaaccctnttacccgtaccgaaaggaacgaaccctaaaccgaaccgtaaaacgttaacctttacgtagtacttcggtactaacaaaatcggaaaccncggtacctaccaaggacgacccgagacccgagccgttagtcgttagttacgtcggtaggaaccgtaaggcgacgtggtacgggngtacgggacgtagtcggg

SEQ ID NO: 221045 - DNA, 591 bp, Homo sapiens
  misc_feature: GYAE6OF02H7LRD.18.87.H10.1.454.CMB.1.raw
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
  modified_base (553)..(553): a, c, t, g, unknown or other
  misc_feature (553)..(553): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcacgtgggtcccgccaggcgtccgggggaaggggccggaggtgggtggccaacataatgacaagatggaactgagaagaactatggtggactcgtgtagaacggccattccacatccaccagacgacaacactaagtaacttacgtagtatctgaactaaaagtgaaaccacgccctacgaaggacgaccggaaggaccacggtcttgtagttacttacgngtagacgaagngctaggtggcgtggacaaggtggacgtcggnggggaaccaacgggtaccacggtccnccgttccncctacgcgtcccaccgacgacgccacgtccgtccctcccgnggcccncccgtgcctcgagacgccacgcgagcncacgacgccgccgtggctcgccgtgtacgacgtacttacctacccgntccttacgtccgtaggcgcgggctggaccgaggccaga

SEQ ID NO: 221046 - DNA, 618 bp, Homo sapiens
  misc_feature: GYAE6OF02HLJGD.18.87.H10.1.454.CMB.1.raw
  modified_base (146)..(146): a, c, t, g, unknown or other
  misc_feature (146)..(146): n is a, c, g, or t
  modified_base (183)..(183): a, c, t, g, unknown or other
  misc_feature (183)..(183): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (614)..(614): a, c, t, g, unknown or other
  misc_feature (614)..(614): n is a, c, g, or t
tcagtacgagtatgcacgaccggtgctcgatttagcagtactgcgttgggtttgggggaggcttggtccagcctggggggtccctgagactctcctgtgcaggccctgcattcatcttttaatagttattggatgcactgggtccnccaggctccgggggaagggccggagtgggtgccaacntaatgcaagatggaactgagaagactatggnggactctggtgaagggccgattcaccntctaccaganacaacactaaagaacttactgtactctgacaaatgaacncgctagagcgcgaggacaggctgtntatactgacgacgtaagntgaggtgcgtaggactagtcgggtaactcggacggggtaaccaaggggaccctacggtcccgacgtcctccgactcgccctaccaccgacggtacctacgtcccgtccgttccccgcggtcccgcccgtacgtccgtaccgacggaccgtccgacccgtacgacgacgaccgacgcgacccgggtccgtgggaccgtcgcccgttaggtaccgacgtaccgtaccgttaccctagtacccgttcgtacgtcggacgcggttcgacggtacgacggtaccgntacg

SEQ ID NO: 221047 - DNA, 861 bp, Homo sapiens
  misc_feature: GYAE6OF02HYVS3.18.87.H10.1.454.CMB.1.raw
  modified_base (735)..(735): a, c, t, g, unknown or other
  misc_feature (735)..(735): n is a, c, g, or t
tcagtacgagtatgcacgaccggtgctcgatttagcagtactgcgttgggtttggggaggtctcagagaggagccttagccctggactccaaggccctttccacttggtgatcagcactgagcacagaggactcaccatggaattgggggctgagcgttgggttttcctcgttgtcttattttagaggtgtcctagtgtgacgtgcagcgtggtggtagtcggtgggggaggtcgttcgggtccgacggtcccggttcgggggggttccccctggacggtaccttccttcccgttggtcggccgacgggtccccgtgcctactttcctaactttaccttttaaagttaacgttttagttagggtattacggtcccgtaccggttccgggggtccccggacccggaacggggtcccggggttaacccggggggggaaccgggggggtacccgggtaagggttcgggggtaccgggacccgaaaacgtaacgttaaagtcggtaacgtaaagggtaacggtaacgggtaaacctagggaaaggtaaaacggtaaaacgttaaggttacggtacgggtaccgtttacggttacgggtaacggggtaaaccggggtcccgttaacgtttacccgaaccccttactaccccgtaccgaaagtaacccgaaacctaaaccgtaaacctaaaacgttaacctttaacgtcgttaactacgtacgaactaaacgtagaaaccncggtaccctaggaacgggaccgaaccggaacgaccggtacggtctttaggttagttaaccggtgtttcggtaaacggtacggaaagccggtagtcggtacgggttacgacggtacgtaggtcgggg

SEQ ID NO: 221048 - DNA, 708 bp, Homo sapiens
  misc_feature: GYAE6OF02JHSYH.18.87.H10.1.454.CMB.1.raw
  modified_base (185)..(185): a, c, t, g, unknown or other
  misc_feature (185)..(185): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttatttagaaggtntccagtgtgacgtgcagctggtggaggtccgggggagcgtggtccaggccgtggggggtccctgagactctcctgtgcgaggcctgcagttcattctttaatagttaattggatgacacgtcggtccgaccaggccgtccgggggaagggccggtagtcgggtcggaccaaacgtagtaaagtggacaacgagtaggaacgtgaagaacgaactagtgtagacgttcgacggtaggaacgggtaccgtaattcccgaactacgtaccgtacccgaagtaaccgaaaccgtaaacaaaccggttaaaccgtaacgtttaaccgttaggtaccttaacgtacgtaaactaaaacgttcgggaaaaccttacggtaccccgttaaaccgaaggaacccgggttaccccgaaaagggtaaacccgaacccggtacgttagttaccggttaactttacggtcggttaaccggacggtaaagacgtaccggtacgtgggtaccgtagggaaccttggtacgggtaccgg

SEQ ID NO: 221049 - DNA, 831 bp, Homo sapiens
  misc_feature: GYAE6OF02FFDSG.18.87.H10.1.454.CMB.1.raw
  modified_base (145)..(145): a, c, t, g, unknown or other
  misc_feature (145)..(145): n is a, c, g, or t
  modified_base (656)..(656): a, c, t, g, unknown or other
  misc_feature (656)..(656): n is a, c, g, or t
  modified_base (826)..(826): a, c, t, g, unknown or other
  misc_feature (826)..(826): n is a, c, g, or t
tcagtacgagtatgcacgaccggtgctcgatttagcagtactgcgttgggtttgggggagcttggtccagcctggggggtccctgagactctcctgtgcaggccctgcattcatcttttaatagttatggatgcacgtgggtccncaggcgtaccgggggaagggccgaggtgggtcgaccaaacgataatgacaagactaggaactgaagaacgtaactagtgtacggactcgtaggtaggaaccgggtcctaacttaccaaccctacgttcccaccgaaggtaacaacctaaaaccgtaacgttaaacggtaaccttttacgtagtaacttcgtaacgaaactaaagtaccggaacctacggtacccctaggaaccggacggacccgggaacggtaaccgtacggttctttaggttaacgttaacgttacggttagggtaccggaaacggtaaagggtccgtaccggttaaggggttcggacggttaacgggacttacggggtacggggtacccggttacgggaccgggggaaaccgaaacggggtccctaccgggtaccctaccccggtttcacccgtacgacccgtaccctaaccccgaacgggacccggtccctaccggtttacccggttcccctacccggtcggtacccnccgtaccgtccgaaccgacgggaccacccgtacccggtacacggacgaccgtacggaccggtcccgcggttaggaccctcgtaccgttggaaacccgtacgttaccctacccgtacgttaacctacggtaaccggtacgtcgggacggtccggtacgaacggactccggntagag

SEQ ID NO: 221050 - DNA, 708 bp, Homo sapiens
  misc_feature: GYAE6OF02GTJN6.18.87.H10.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
tcagtacgagtatgcacgaccggtgctcgatttagcagtactgcgttgggtttgggggaggcttggtccagccgtggggggtccctgagactctcctgtgcaggccctgcattcatctttaatagttattggatgcactgggtcccgcaggcgtccgggggaaggggccggaggtgggtggccaacataatgcaagatggaactgagaagactatgngactntgtgaggcattcacatcncagagacaacaataagaacttactgtanctgactaaatgaaaccncgcctacgagacgaccgaggacgacggtntaggtgttaacttcgtggtagacgaaagcgtacgaggtcggtcgtacggactaggtcggtacgtcggtacgggaccgaacggggacctacgggtaccctacccgttctcccgtacgaccgtccctacccgaacccggaaccggaccctacgttcccggttccccttccccgcggtcccgtccccgtcgacccgtaccggacggaccgacccgtaccgtaccggacggaccgaccaccggaccggcccggtcccggtcgggtcccgtcggtacccggttacggtaaccgtaaccggttacccttaacccgttacccgtaaccgttacccgttaccggttaacggtacgggtaccggtccgggttacggtacgggaaccggacggtaccgaatacg

SEQ ID NO: 221051 - DNA, 746 bp, Homo sapiens
  misc_feature: GYAE6OF02GPZDX.18.87.H10.1.454.CMB.1.raw
  modified_base (184)..(184): a, c, t, g, unknown or other
  misc_feature (184)..(184): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaggtntccagtgtgacgtgcagcgtgggtggagtcggtgggggaggtcgttggtccaggtccgtcggggggtcccctggacgtacttcctccgtgtcgcgacggccctgcctattctattactttaatagttattggatgcacgtcgggtccgccgacggccggtaccgggggaacggggccgggtagggtcggggtcggaccaaacgtaagtaacgtcggactaaaggagtacgggtaacgtaggaaacggaaacgtaaacgttagtacggttacggacctttcggtaggtaacggggtaacggggccctaacgtttaccccgaaacccttatacccctacggaaagtaacgaaacccaaactaacttaaaacggtaacctttacgttacgtaacgttcctacgtaaacctaaagtaccgtaaccgacgtacctaacgacggaccggaaaccggacggaaaccgtacggtacgtttggtaacgtttaacgttacgcgggttaaggaaccgtaaaggtcgtaccggtagggtccgggtacggtacggggtacctagggtacccgggg

SEQ ID NO: 221052 - DNA, 610 bp, Homo sapiens
  misc_feature: GYAE6OF02FM1Y1.18.87.H10.1.454.CMB.1.raw
  modified_base (543)..(543): a, c, t, g, unknown or other
  misc_feature (543)..(543): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtgggggggtccctgagactctcctgtgcaggccctgcattcattctttaatagttattggatgcacgtgggtccgccgaggccgtccgggggaaggggcccgggaggtggggtcggaccaacgataatgacaaagatagggaactggaagaaagtaactatggtcggactcgtggtagaacgggggccctaatttccaccgtaatccctacccgaaggaacgaaccaaaccaactaaagtaaactttacgtagtactctgaacaaatcgaaacacgacctacgagacgcccggaaggaccgaccggnttcggtagtaacttagtggtacggacgaaagtacgcgtaggtcggtacggtagggactaggtacggg

SEQ ID NO: 221053 - DNA, 789 bp, Homo sapiens
  misc_feature: GYAE6OF02HDH79.18.87.H10.1.454.CMB.1.raw
  modified_base (777)..(777): a, c, t, g, unknown or other
  misc_feature (777)..(777): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccagtggaagttggggctgaggcgttgggttttcctcgttgtcttattttaggaaggtgtccagtgtgacgtgcagcgtggtgggagtcggtgggggaggtcgttggtccgaggtcccggttcgggggggtccctggacgtacctccgtcctggtcgcgacggccctgcctattctattactttaagttagttagttaggattgctacgtcgggtccgccgaggccggtaccgggggaagggggcccgggtagggtggggtcggacccgaaacgtattaaagtcggacaaaggtaagtacgggtaaacgtagggaaaggtaaaacgtaaacgttagtagggtacggtaaccgttggtagggtacgggtaaaccgggggtcccttaacgtttacccaaacccggttcttcccgtaaccggaagaaacggaaaccctaaaaccgtaaactttaaaaacggtaacttttaaccggtgtttaacttacccgtaagtaaccgtaaaaagttccggaaaaccctccggtccccttaaacggaaggttaacccggaccgggaaacggaaccgggtaccgtccgttagggtttactttacgtacgtttggcgaaccggtaaggacgcgtagggttcgggaacggtggtacngggttacccggg

SEQ ID NO: 221054 - DNA, 715 bp, Homo sapiens
  misc_feature: GYAE6OF02IFX6L.18.87.H10.1.454.CMB.1.raw
  modified_base (341)..(341): a, c, t, g, unknown or other
  misc_feature (341)..(341): n is a, c, g, or t
  modified_base (546)..(546): a, c, t, g, unknown or other
  misc_feature (546)..(546): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcacatggaattgggctgagcttgggtttcctcgtgtcttaatttaaaggtgtccagtgtgaggtgcagtcgtgggtggagtcggtgggggaggtcgttagggtaaacgggccgggggggttcccgttaggacctccccgtaggtaccacgtccgtcgtggtacttcgtaactttcgagtaacgccgttaggatacgtaacgtcgggtcncgacgcgtccggacggaacgggtcgtcggtaggtaggggtcggtaccgtaacgtttaaaaaccgaaaaccggttaggtaacgtagggtaggaaccgtaaacgaacgtacgttacgacgtcgaccgtaacggtacggaaagcgaagtacgttacacgacgtctacgaacgagtatacgtaagttaacaaaagtccgacagtaagtntaccttagaacaaagttcgaaaactcgacgtaccgaaagaaccccgagacgaaccgtccgaacgttacgtttaaaggacttacggtacctacccgtacgtacccctaaggaaaccttcgaactaaccttactaaccgtacgtacgtacggtacgtccttacgtaccggg

SEQ ID NO: 221055 - DNA, 603 bp, Homo sapiens
  misc_feature: GYAE6OF02J0HV6.18.87.H10.1.454.CMB.1.raw
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (501)..(501): a, c, t, g, unknown or other
  misc_feature (501)..(501): n is a, c, g, or t
  modified_base (526)..(526): a, c, t, g, unknown or other
  misc_feature (526)..(526): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctgagcgtgggtttcctcgtgctatttagaggtntcngtgtgacgtgcngctggtgagtgtgggggagtnttggtcngtccgtggggggtccctgacgctccgtctgtgcacggtccctgctattcctattacgtttaatagtttattggctgcgacgttcggccgacgtacggcggtaccgggggagggccggtggtgggcggaccaagtatagtgacaagnaggactaggaagagatagtgagtacctgtagnggaacgggtcagtacactcttacgaccgtaggaacaataaaccataagaacctttacgatttcgtactagaaccttaaagacgtacactacgaccgngacgtaccggacgaacggtaccgtnaggttattaacggttcgaggttagaacggaccgtagccttaaggggccgtacggtacgggaactggttaacccgggg

SEQ ID NO: 221056 - DNA, 969 bp, Homo sapiens
  misc_feature: GYAE6OF02H8F1V.18.87.H10.1.454.CMB.1.raw
  modified_base (149)..(149): a, c, t, g, unknown or other
  misc_feature (149)..(149): n is a, c, g, or t
tcagtacgagtatgcacgaccggtgctcgatttagcagtactgcgttgggtttgggggaggcttggtccagccgtggggggtccctgagactctcctgtgcaggccctgcattcattctttaatagttatggatgcacgtcgggtcccnccgagggccgtaccggggggaacggggccggaggtggggtcggacccaaacgattaaagtggacaaagagttaggaaactgaagaaagtaactagttcggtacggacttcgtaggtagggaacggggcccgtaattaccaacctacttcctaccgaacgacgaaccaaacgtaactaaacgttaactttaacgtgttaactccgtagaacctaaaagtcgaaacacgtcctaacgacggacgacggaacggaccgacgggtcttaggttacgttactttacgtggtacggacggtaaaggacgtacgtaggggttcggacggtacggggaactacgggttacgggggtaccgtaccgggggaccggggaacccggaaaaccggggtacccgtaccggggtaccctaaccccgggtttccctacccccggtacgtaaccccgggtcccccgtaacccggtaaaccccgggtaacccggggtacccccgtaaccggtttaccccgggtttccccccgtttccccgggtcccgggtacccccggttcccgttaccggacccggttacccggaacgggtaacccgtacccgttaaccccggtaccggaaccggtaccggaacccggtaaccgcccgggtacccggggtccccgggtcggggttacccgtaccgggtacccggttaacggtacccggtaaaccgttaccccgttttacccgtaaacccccggttacgttaaccccggttaacggttacgtaccggggtaccgggtccggggtaccggttaaccgggaccgggtaaaccggtccggtaacggtacg

SEQ ID NO: 221057 - DNA, 758 bp, Homo sapiens
  misc_feature: GYAE6OF02H9X53.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggaggtcgtgggggagcttggtccagccgtgggggtccctgagctctcctgtgcacggccctagcattcattctttaatagttattggatgacgtactggggtcccgccgaggccggtcccgggggaaggggcccggtaaggttcgggggtcgaccgtaaacgagttaaactggaccgtaaaggtagttacgggaaaccttggaaaacggaaacgtaaaaccttaggtacggttacgggaacctttcgtcgggttaacgggaaaccgggggtacccgtaacttttaccgaaaccccttgttaccctacccgaaacgtaacgggaaacctaaacctaaacgttaaaacgaaacccttttaacgtgttaacctcgttaacgactaaaagtaccggtaaacctagtacccctagaacggtacggcccggaacggtaacccgaccgggtaccttgggttacgttaacgtttaccggtaggtacggaaccggttaaccggaacgttacggttacgggtttccgggggacctaaccgttaggttacccgttaacccg

SEQ ID NO: 221058 - DNA, 644 bp, Homo sapiens
  misc_feature: GYAE6OF02H9SNB.18.87.H10.1.454.CMB.1.raw
  modified_base (148)..(148): a, c, t, g, unknown or other
  misc_feature (148)..(148): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
  modified_base (412)..(412): a, c, t, g, unknown or other
  misc_feature (412)..(412): n is a, c, g, or t
tcagtacgagtatgcacgaccggtgctcgatttagcagtactgcgtttggggtttgggggaggcttggtccagcctggggggtccctgagactctcctgtgcaggccctgcattcattctttaatagttattggatgcactgggtccnccaggcgtccgggggaagggccggagtgggtggccaacataatgcaagatggaactgagaagaactatgtgactcgtgtgaacgggccattccaccatcnccaganacaacactaagaactttactgtattcnacaaatcgaacncgcctacgagacgaccgaggacacggntgtagtacttacgtgtagacgaagagcgagtggcgtagggactaggtggtacgtcggtcggggacaaacgggccacggtccaccgtctaccncacgtccctaccaccgaacggcccacgtccggttcccttcccgtcggcccgtccccgtcgtcccgttaccgacggtaccgaccgacccgtaccgaacggtaccgaccgtaccgacggtcccgggtccgtcgggccgttccggccggttacggaccgtaaccggtacccttaccttacccgtactaaccgtccgtacgtcggaacggtcggcgtcggacgacggccgagtacg

SEQ ID NO: 221059 - DNA, 582 bp, Homo sapiens
  misc_feature: GYAE6OF02I33Z2.18.87.H10.1.454.CMB.1.raw
  modified_base (145)..(145): a, c, t, g, unknown or other
  misc_feature (145)..(145): n is a, c, g, or t
  modified_base (392)..(392): a, c, t, g, unknown or other
  misc_feature (392)..(392): n is a, c, g, or t
  modified_base (438)..(438): a, c, t, g, unknown or other
  misc_feature (438)..(438): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccnccaggctccggggaaggggccggagtgggtggccaacataatgcaagatggaactgagaagaactatgtggactctggtgaagggccgattcaccatcctccagagacaacataagaacttactgtactctagcaaatgaacagcctcagagccgaaggcacggctgtgtacttatgtgacgaagagctaggcggcgtgggacagtggacgtcgtcggggaccaaagggccacggtcaccgtctccncacgccaccgaccgacggacccacgtcgtccttccccgcggtcccnccctcgcctccgagacgcctaccgtcgacgacgccacgcggccgcccgtcggcgtccgcgtcggtacgtaacgaccttaccgttacccaattacctccggtaccgtcggacggccgggtcgtacggacgacgggtccgctaacg

SEQ ID NO: 221060 - DNA, 713 bp, Homo sapiens
  misc_feature: GYAE6OF02IP4ZK.18.87.H10.1.454.CMB.1.raw
  modified_base (204)..(204): a, c, t, g, unknown or other
  misc_feature (204)..(204): n is a, c, g, or t
  modified_base (341)..(341): a, c, t, g, unknown or other
  misc_feature (341)..(341): n is a, c, g, or t
  modified_base (468)..(468): a, c, t, g, unknown or other
  misc_feature (468)..(468): n is a, c, g, or t
  modified_base (653)..(653): a, c, t, g, unknown or other
  misc_feature (653)..(653): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaagttgggctgagctggtttcctcgtgctagtttagaagtgtcagtgtgacgtgcagctggtggagtcgtgggggngtcgttcggtccgaggtccggtggggggttcccctaggacgtaccttccgtccgtggtcgccgtacgggcccctggcctacgttacctatttaccttttaagtagtttaagttgggaattgcgtacgtcgggtcccnccgagggcccggtacggggggaacgggcggtacggtgggtcgacccgtaacgaagttaacgcgacgaagtaggtacggaaaccgttaggaaaggaaacaaccgttaagtggtacgaacttcggtagngggtaaacgggtccgtagtttaccaactacgtacccgtaccgaaagaacgaacctaaactaacgtaaaacggttaacctttagtcggtaatcgttaacgaacctaaagtacgaacctcgaccgttacgaacgtacgccggaaacgcgaccggtattcgtacgttataccggtgtccgaagggtanaaggtcgtagcccgggtagcggtacagggtcggtacgttccgggacggaaccggtaacgg

SEQ ID NO: 221061 - DNA, 727 bp, Homo sapiens
  misc_feature: GYAE6OF02GU4QW.18.87.H10.1.454.CMB.1.raw
tcagtacgagtatgcacgaccggtgctcgatttagcagtactgcgttgggtttggggaggtctcagacgaggagcccttagccctggactccaaggcctttccacttggtgatcagcactgagcacagaggactcaccatggaattggggctgagctgggttttcctcgttgctattttagaaggtgtccagtgtgaggtgcagcgtggtggaatccgggggaggcttaggttcgagccgtggggggtccctgacgtactctcctgtgcagtcctctggattctaagtttccagttcgccgtacgtggatcgcaacgtggactccggaccaaggttaccgaagggtagagtacgtgggtggtgggtctacgtaacgttaattaaacgataggaggttgggggtacaccacgacttacccgtacggacgtaccgtaccggtggacggggtccctcgtttaccacccgtactcccgtacccggtaagaaaccctaaacccaacccgaaaacgaaccgtaaccgtacgttaacggtacttacctagtaccgaaacgttgaacgtaccgtaggttacgaggggtaacgtaccggaacgggtaaccgaccgggtactttacggttaactttacggttacgttagggtacgtaacgggaaacgggtacggggtaaccgttacgggtaccgggacccggtttaacggggacgggggtttcgggtaacccccggg

SEQ ID NO: 221062 - DNA, 696 bp, Homo sapiens
  misc_feature: GYAE6OF02HJBJB.18.87.H10.1.454.CMB.1.raw
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
tcagtacgagtatgcacgaccggtgctcgatttagcagtactgcgtggagtctgggggaggcttggtccagcctggggggtccctgagactctcctgtgcaggccctgcattcatctttaatagttattggatgcactgggtccgccaggctccgggggaagggggcccggagtggggtggccaacagtaaatgcaagatgggaactgagaaagaactatgtggactctgtgaagggccattcaccatctccagagacaacactaaagaacttactgtactctancaaaatgaaacagccctacaggacgccggaaggaccgacggctgtgtatttactggtgacgaagancgaggtggcgtgggaactgtggacgttcgtacggggaccaaggggaccaacgggtcaccccggttactcccgctaaccgtccctacccgaaaccggtaaacggcccccttagttacccgggtcccctttccccccggtagggccccgtacccttcggtcccgttaccggaccgggtaaccgcccgtacccgtaccgagaccgtcccgaacgtaccgggcccggttaacccgttggggacccgttaccgccgtttagggaccctaagggtacccccttcgttaacccgtattaacccggtcgtaccgtacggtaccgggcgggtaccgtcggacggtaacggccgg

SEQ ID NO: 221063 - DNA, 642 bp, Homo sapiens
  misc_feature: GYAE6OF02GUSG7.18.87.H10.1.454.CMB.1.raw
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
  modified_base (572)..(572): a, c, t, g, unknown or other
  misc_feature (572)..(572): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagaggactcaccatggaattggggctgagctgggtttcctcgttgctatttagaaggtgtccagtgtgacgtgcagctggtggagtcgtgggggaggcgttggtccaggccgtgggggggtcccctggacgtactcctcctggtcgcacgggcccctgctattccattctttaatagttattggatgcacgtcgggtccnccgaggcgtccgggggaggggccggagggtgggtgaccaacagtaangacaagataggaactaggaagaagaactagtgtcgggtacttcgtggtacggagggacctattaccacctatccctccgaaggaacgtaaaccaactaaacgtaaacgttaacctttaagtacgttaatacgtcgaaactaaacgtacgtaaacccacgtacccaacgtaacggaccggtacggaacggacctaccgggngttacgtagttacgttacgtggtaccgacgaagagtaccggtggtccggacgttagggactgtaaccggg

SEQ ID NO: 221064 - DNA, 953 bp, Homo sapiens
  misc_feature: GYAE6OF02I14IP.18.87.H10.1.454.CMB.1.raw
  modified_base (693)..(693): a, c, t, g, unknown or other
  misc_feature (693)..(693): n is a, c, g, or t
tcagtacgagtatgcacgaccggtgctcgatttagcagtactgcgttggggtttggggaggtctcagagaggagccttagccctgactccaaggcctttccacttggtgatcagcactgagcacagaggactcaccatggaagttggggctgagtcgttcgggttttccttcgttgcttagtttttagaacggttgtcctagtgttgacgtgcagcttggtacggagtcggtgggggtacggtcgttcggtccacggtccggttcggggggtcccctggacgtacttaccgtcccggtcgccgacggtcccctgccgtacttccgtaactttaccgttttaaattacggtttagtttaggtagttctcgtaacgttcggggcccgtaccgacgggttcccgggtaacccggggggaaggggtccgggtacgggtgggtaccggaaccaacgtaagtaacgtagaacggaaacgtacgtacggaaacgtaggtaaaacgtaaacgtaacgttaaacgtcgggttaacggtattcggtaacggggttacgggtaaacccggggggtctttaaaaccctttaacccggaaccgttaacgttaccccgtaaccgggtaaaggtaaacccggtaaacccaaaccggttaaaacccgttaaaacggttaaaacccttttaacggttacgtttttaaacncccggtttaaaacgtaccgttaaaaacggacggttaaaacccgtacccggttcctaaacccgggaggtaaaaccccgggccgggtaaaccgggaaacccggttaccgggttacgtttaaaccgggttacgtttaaccgggttttagtacccggggtttaaggaaaccccgggttaaagaacccgggtttaaaggccgggggttaacccttacgggggggtaaccgttacccggttacgggttacggggttaaccccgggg

SEQ ID NO: 221065 - DNA, 723 bp, Homo sapiens
  misc_feature: GYAE6OF02GF5DS.18.87.H10.1.454.CMB.1.raw
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (568)..(568): a, c, t, g, unknown or other
  misc_feature (568)..(568): n is a, c, g, or t
  modified_base (592)..(592): a, c, t, g, unknown or other
  misc_feature (592)..(592): n is a, c, g, or t
  modified_base (665)..(665): a, c, t, g, unknown or other
  misc_feature (665)..(665): n is a, c, g, or t
  modified_base (688)..(688): a, c, t, g, unknown or other
  misc_feature (688)..(688): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaagttggggctgagcttgggttttcctcgttgcttattttagaggtgtccagtgtgacgtgccagcgtggtggagtcgtgggggagtcgttggtccagcccggtcggggggttaccctggacgaccttcctccgtgtgcgacggccctgctattcattacttatagttattgntnctcgtcggtccgccgaggccggtaccgggggaagggtcccggaggtcggggtacgaccaaactagtagtcgacgagtagttacgaacgtaggaagaaacgtaagtagttacggtgtaccgttcgtagggtacgggtaaaccgggccgttaagttacccgaaccgttacgtcccttaaacccgggagggtaaacccgtaacccaaaacgttaaaccgttaaactaaacccttttcggaatttacgtcgtaccgaaacttaaaccgngtaaacccgcggtaccccgttaanaacgggtaacccggtccgaacgggaacccgtacggcgttacgttacggttactacgtggtacgaagtaccggntcgacggtcggtatagggtaccngggtccggacgggtcggacggggacctaacccggg

SEQ ID NO: 221066 - DNA, 786 bp, Homo sapiens
  misc_feature: GYAE6OF02GIK15.18.87.H10.1.454.CMB.1.raw
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagagactcaccagtggaattgggctgagctgggttttcctcgttgcttatttagaaggtgtccagtgtgagtgcagcgtggtggagtcgtgggggaggtcttggtccagccgtgggggtccctgacgtactctcctgtgcgagccctgcattcatcttaagtagttatggtangtcacgtggtccncgacggtcgccggggtaagggccggtaggtcgggtcgacctactaatagacgacgaagacgttaggaacttaggaagtaaaacggtaaacgtacggttaacggtacggtaaccttcggtacggttacgggtaaaccggggtcccgttaacgttaacccgtaaccctcgttaccccggtccgaaaccggtaaacggtaaacccctaaaccggtaaacccgttaaacggttaaaaccctttacggtaccgtttaaaccgtacgtttaaccggaaaccgttaaaacgttaacggaaaccgtacggaccccccgttaaggaacccggtaaccgggacccggaacgtaacccggtaccggttaccgttacgttacgttaaccgtttcggggttaacaccggggtaacgtaaacgggtcgttaaccggttaacggggttccggttaacgggtacgggttaccggtaacggggttaacccggg

SEQ ID NO: 221067 - DNA, 898 bp, Homo sapiens
  misc_feature: GYAE6OF02JN9T2.18.87.H10.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
tcagtacgagtatgcacgaccggtgctcgatttagcagtactgcgttgggtttggggtagggtctcagagaggagccttagccctggactccaaggcctttccacttggtgatcgagcactgagcacagaggactcaccatggattgggctggagcttgggttttcctcgttgcttatttagtaaggtgtccagtgtgacgtgtcagctggtggagtcgtggggagcttggtccagtccgtcgggggtcctgagactctccgtgtgcacgcctgcattcnttacttagtattgtagtagttcgacnctcggtcgacctacggcggttaccccggggaaggggcccgggtaggtcggggttcggaccggtaaccaagttaaacgcggtaccgaagtaagtaacgggtaacctggaaacgaaaggtaaaccgttacgtagggtacggttaaaccgtccgtttaagggttaacggtaaacgggggacccgttaaacgttaccccgtaaccgtaaccggtaccgtttaccgaacgggtaaaccgaaaccttaaaccggaaaacccttaacgggttaaaaccttttaaaccttacggggttaaaccttttaacccggttacggtaaacccttaaaacggttaaccgtaaaaccgttaaacccggttcccgttaaaacccggtaaccgtaaaccgggggtaaacccccggaaacgggtaaacccggtttaaaccccgggtacccggttttaggtaaccggtttttaaacggtttacccgggtttaacggttttaacccgggggaaacgtttaaaaccgggggaagttttaacccggggaaccggggttaacccgggtacggggtttaaccgggggtaccgttaaccgggtttaacccggggggg

SEQ ID NO: 221068 - DNA, 664 bp, Homo sapiens
  misc_feature: GYAE6OF02HAAC0.18.87.H10.1.454.CMB.1.raw
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (626)..(626): a, c, t, g, unknown or other
  misc_feature (626)..(626): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgtgggtttccgtcgttagtcgtatttaggaaggtgtccgagtgtgacgtgcagcgtggtggagtcgtggggagtcttcggccaggccgtgggggtccctgacgtctctccgtgtcgtcgcggtccctgctnttcagttacttaagtagttgtaggntacgcgtacggtcggtccgccgtagggccggtaccgggggaagggtccggtaggtcggggtcgtaaccaaagtagtagtgaacgaagacgtaggaactggaagtaacgtaacgtagtaggtacgtacgttgtaggtacgggtaacgggccttaccgtacgaaccttcgtacctacgtaacggactaaaccggtaacctaaagttaaacgttaaccctttggtagtactaccgtagaaacgtaagtaacggtactacgtacccgtggaagtaccggaccgtacgacgtacgtctaggtcttaagtccggagaccgnggtaacgtggctaggcggtacgaggtaccgaggtacgg

SEQ ID NO: 221069 - DNA, 1029 bp, Homo sapiens
  misc_feature: GYAE6OF02HPQZ1.18.87.H10.1.454.CMB.1.raw
  modified_base (198)..(198): a, c, t, g, unknown or other
  misc_feature (198)..(198): n is a, c, g, or t
  modified_base (675)..(675): a, c, t, g, unknown or other
  misc_feature (675)..(675): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcttgggttttcctgttgcttattttagaaggtgtccagtgtcgngtgagcgtggtggtaggtcgtcggggtgggtacgttagttcgtacggccggtcggggtccggtcgagacgtcctctcgtgcacgctctggtagtctacttcgtcgtacgtccttacgtggtgtacgtcacgtagtacggtacccgtacccgtaacgtaccggtaacgggagggtaacgtacggtacgggttgggttcggtaccggttaccgttaacggtaaacggttaaagttaaggtaacggttcggggttacggggggtccgggttaccgaaaccgttaaccggttacccggttaacccgggtaccgggtacccggttacccgggtttaccgggggtaccgggggtacccccggttaccccctttaccgaaacccctaccggttaaacccccggttcccccgggtaaaacggaaacccctaaaacccccgtaaaacccgaaaacgggttaaacccgtaaaccccccgggggtttntttaaacggttttaccgtaacccggttaaacgtaaaccgttaaaaacggggaccggttaaagggtaccccgtttaacgggggtttccggggttaaacgggggtaacccgggggtaacccgggtaaaccgggaaacccgggtttaacgggtaccggttttaacctttttaaaccggtttttaaccggttccggttaaccggggtaaaccggggtaacggggttaaaacccgggggtttaaaccccggggggttaaccgggtttttaccccgggaccccgggggttttaaaacccgggggtttaaccggggggtttacccgggggggggtttttaacccccgtccccccggggggg

SEQ ID NO: 221070 - DNA, 759 bp, Homo sapiens
  misc_feature: GYAE6OF02ICPDQ.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagagactcaccatggaatggggctgagcttgggtttcctcgttgcttattttagaaggtgtcctagtgtgacgtgcagctggtggagtcgtggggaggcttggtccaggccgtggggggtccctggagacctctccgtggtgccgacggccctgactagttcattcgtttaattagttagttggtatcggtctaccgttgggtccccgccgtaacgggccgtacccgggggaaggggtcccgggaggttggggtcggaccctaaagaagtaacgtgacaaggaattcggggaaactgggaaagaacgaactaagtgtacggtctacgtggtacggtaacggggcctaattacccggactacgttaccacgaacgtaagaaccaaacgaaccgtaaaaggtaaccttaacgtagtttaactcccgtaagaactaaaacgtcgtaaaaccgtaccgacccgttaacgaacggaaccggtaaccccggaagaaaccccgtaacgggtccgtttaggtaacgtttacggttaaaccccggttgggtaaccgggtaaccgggtaaaaacgtcggtaccggtaaaggttccggggtaaaccccggtttgggggtaaaacccctaggttaaccccggggggg

SEQ ID NO: 221071 - DNA, 640 bp, Homo sapiens
  misc_feature: GYAE6OF02HN3MJ.18.87.H10.1.454.CMB.1.raw
  modified_base (214)..(214): a, c, t, g, unknown or other
  misc_feature (214)..(214): n is a, c, g, or t
  modified_base (332)..(332): a, c, t, g, unknown or other
  misc_feature (332)..(332): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (552)..(552): a, c, t, g, unknown or other
  misc_feature (552)..(552): n is a, c, g, or t
  modified_base (567)..(567): a, c, t, g, unknown or other
  misc_feature (567)..(567): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaacttggggctgagctgggttttcctgttgcttattttagaaggtgtccagtgtgacgtgacagctggtggagtcggtaggggggngtcgttcggtccaggtccgtcggggggtccctggacgtactctccgtgtcgcgacggcccttgactatttcatttaccgtttaaatagtttagttggacttgctacgtcgggtacccncgtagggccggtacgggggaacggggccggaggtcgggtacggacccagtaactaagcgaacgaagtagaggttaacgagagaaagtattaggtccgtagtactgtggagtacgggctacgtacacgtncgtacagactaacagactaagtacttnagttacngtcgtaaangtanacntccanaggcgacgagtccgagtcgtgttacagttttaccgngccgaagaaccgggngttaggaacccggtggttaggacacggagtaaccgggtcccggttagggaccggggaaccgttaaccccgggg

SEQ ID NO: 221072 - DNA, 945 bp, Homo sapiens
  misc_feature: GYAE6OF02HFSII.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagagactcaccagtggaagttggggctgagtcgttcgggttttcctcgttgtcttattttaggaaggttgtccagttgtgacgtgcagtcgtgggtggagtcggtgggggagtcgttcgggtcccgacggtcccgggttcggggggttcccctaggacgtacccgttccgtcccgttggtcgcccggaccgggtcccctggtaccttacgtttacctaacttttaaccttttaaagttaaggttttagttacgggtacgttacggacccgttaccggttacccggggtaccccgacccgggtacggggtccccggggttaaccccggggggggaaccggggggtacccggggttaggggtaccgggggttaccgggaacccgtaaaaccgtaagttaaaccggtcggaaaccgtaaagggtaacggttaacggaaacgttaaggaaaaggtaaaaccggtaacttaggttacgggtaccgtacgttcggtaagggtaacggaccgggtacctacgttacccaccgtacgttcccaacgtaacgaaactaacctaaacgtaacgttaaaccgttaacctttacgtacgttaaccttaacgtactaaacgttaaacgaacccgtaaacgtccccgtaccgtaaaccgaacgggtacccgggaacccgggtaacggaaaccccgttacgggtttaccgttacgggttttaacggttttaaccgtttccggtaacgggtaggtaaacccgggtaaaggtcccggtaacggggtccggggttaagggttcccgggtaaggtaaccccgggttgggtaaccccgggg

SEQ ID NO: 221073 - DNA, 668 bp, Homo sapiens
  misc_feature: GYAE6OF02F2P8P.18.87.H10.1.454.CMB.1.raw
  modified_base (598)..(598): a, c, t, g, unknown or other
  misc_feature (598)..(598): n is a, c, g, or t
tcagtacgagtatgcacgaccggtgctcgatttagcagtactgcgttgggtttggggaggtctcagagaggagccttagccctcggactccaaggcctttccacttggtgatcagcactgagcacagaggactcaccatggaattggggctgagcgtgggtttttcctcgttgcttattttagaaggtgtccagtgtgacgtgcagcgtggtggaggtcgtgggggaggtcgttggtccagccgtcggggggtccctgagactctcctgtgccaggccctgcctattctattactttaatagttattggatgcacgtgggtccgccgaggccggtaccgggggaacggggccggtagggtgggtcgggaccaacgataagtgacgaagataggaactggaagaaagtaactagtgtagtactgtggtaggacgggcctaagtccactactcctaccgagacgaactaaccaactaaagtaacctttagtacttacctactgtaacgaaagtacgaaaccgtcgtaccctacggaacggtacggaacccggtaaacgggaccgtacccgggcgtttaggttaacgttactttaaccggnggttaccgggaacgttaagggaacgtcggtaagggtaccggtaccggtaggggtacttaagggtccgggg

SEQ ID NO: 221074 - DNA, 949 bp, Homo sapiens
  misc_feature: GYAE6OF02I75ZV.18.87.H10.1.454.CMB.1.raw
tcagtacgagtatgcacgaccggtgctcgatttagcagtactgcgttgggtttgggaggagccttagccctggactccaaggcctttccacttggtgatcagcactgagcacagaggactcaccagtggaagttggggctgagcgttgggtttccgtcgttggctagtttagaaggtcgtcagtgtcgacgtgctagcgtgggtggagttcggtggggggaggtcgttcggtaccgagccgggttcggggggtacccctggaacgtcctccgttccggttgtcggactacgggtcccgtggtccttaatttccgtaacgttttaccttttaattaaggttttagttggactcggacgttaccggtcggttccccggaccggtaacggggtccccggggttaccggggggaacgggggttaccgggtacgggttacggggggccggaacccgttaaacgaaggtttaactaccggtaaggtaaacggacggttaacggggaaaaccgttaggaaaacgggttaaaacggttaaaaccgttcggttagggggtttaaaccggttaccttttaacggggtacggtttaacggggggtaaacccggtaccgggttaaccttaccggtaacctaccggttaccccttaacggaaccgttaacgaaacccttaaaccgtaaacgtttaaacgttaccgttaaacgttacgtacgttaacggttaacgaacgtaacgtaacggtaccaccggactaccgtacgggtaacccgtcggtaacgggtaccgggaacgttccggtaagttacggtttaaccggtttacgtaacggtttaccgggaacgtaaccgggtaacggtacgggttaaccgggtccgttacggggttaacgggtaacgttacggggttaccggtacccggggtacgggttacccgggggacggttaaaccccgggg

SEQ ID NO: 221075 - DNA, 852 bp, Homo sapiens
  misc_feature: GYAE6OF02G7JN2.18.87.H10.1.454.CMB.1.raw
  modified_base (735)..(735): a, c, t, g, unknown or other
  misc_feature (735)..(735): n is a, c, g, or t
  modified_base (838)..(838): a, c, t, g, unknown or other
  misc_feature (838)..(838): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagctgggtttctcgttgctatttagaggtgtcctagtgtgacgtgcagtcgtggtaggacgtcgtcgggggagtcgttggtaccgacgtccgtcgggggggtccctaggacgtacgtcctccgtggtcgcgtacggccctggctaattccagttaccttttaaagttagttaatttgggaattcgacgtaaccggttgggtacccgtcccgaagggtcccgggtaccggggggaaacgggtcccggtaacggggttcggggacggtaaccgaaaactagtaaacggtcgaaccgtaaagaacgtttcgggaaacccttaggaaacggtaaaacggtaaccttaaggtaccggtaggtaaaccgtcggttttaaccggaggggttaaaacccgggggacctttaaaccttcccgtaaaccccgtaacgttaaccctaacccgggtaaacgaaaacgggaaccctaaaaaccggtaaaccgttaaaccgggttaaaccttttaacttacgttaaccttacgttacgaaacgaaacgttaggaaaccccttgaacccgtttacggaaacggtcgaacccggggtaaanaaccggtacgggttaccgaaggtttaccgttaaccgtttcgtacgggttaaggaccggaaaggtttaaccgaccggtagttaacgggtccggtaacgggaacnccgggtttaacggg

SEQ ID NO: 221076 - DNA, 853 bp, Homo sapiens
  misc_feature: GYAE6OF02GPINP.18.87.H10.1.454.CMB.1.raw
  modified_base (748)..(748): a, c, t, g, unknown or other
  misc_feature (748)..(748): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttattttagaaggtgtccagtgtgacgtgcagctggtggagtcgtggggggaggtcgttggtcccaggtccggtcggggggggtcccctggacgtacctccgtcctggtcgcacgggcccctgctagttccagttacttttaaagtacgttttattcgggattcgcgtaccggtgggggttcccgacccgaacgggtccggtacccggggggggaaacggggggtccccggggtaaggggttacgggggggttaccgggaccccgtaaaaacgaacgttaaaacgttacgggtacccgaaaaggtaacggttaaggggaaacccttaggggaaaacggaaaggtaaaaccttaggttagggtacggttaaccgttcgttagggtagggaaccgggggtcccggtaaatttccccaaaccgtacgtccctaacccgagaaacgggaaccctaaaccgtaaacgtaaaccgttaaacttaccgtagttacttacccgtagaactaaaacggtctaaaaccgtaccggtaacaccgtaagggacccggaacccgggaaacggttaacccgaacccgggtnttacccgggtttagttaaccgtttcgtacgggttacggaacggtaacgggttacggaccgtacgggttacgggtccggaacgggggtaactgggttaaccggggg

SEQ ID NO: 221077 - DNA, 527 bp, Homo sapiens
  misc_feature: GYAE6OF02IG72F.18.87.H10.1.454.CMB.1.raw
  modified_base (466)..(466): a, c, t, g, unknown or other
  misc_feature (466)..(466): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctatttttagaaggtgtccagtgtgacgtgcagctggtggagtctgggggagcttggtccagcctggggggtcccctgagactctcctgtgcaggccctgcattcatctttaatagttattggatgcactgggtccgccaggctccggggaaggggccggagtgggtgccaacagtaatgcaagatggaactgaagaagaactatgtggactctgtgaagggccattcaccatctcaagacgacaacactaaagtaaacttactagttaatctcgactaaatcgaaacagccctanagagcccgaaggcaacgggctgtatattaactgcncgaagngcagtggctgggacagtcgg

SEQ ID NO: 221078 - DNA, 796 bp, Homo sapiens
  misc_feature: GYAE6OF02H6SGP.18.87.H10.1.454.CMB.1.raw
  modified_base (146)..(146): a, c, t, g, unknown or other
  misc_feature (146)..(146): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (383)..(383): a, c, t, g, unknown or other
  misc_feature (383)..(383): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcacgtgggtccnccagggccgtaccggggggaaggggccggtaggtggggtcggaccaaactataatgacaagatggaaactggaagaagtaaactagtggtaggactcgtgtaggaacgggcctattccaccatcctacaagaagacaaacaacgtaanaaccttactgtactcgagacaaaatcgaaacngccctnaaaggacggacccggaaggaccgagggtccttaggtacggttaatttacgnggtacgacggaagagtcgaaggtcgggagtacgggactaacggtgggtaaccgtcgggtacgggggacccaaaacgggggccctaacgggtcctacccgttctccccgagtacccgaccctacccgaacccggaaacggggtcccccttaaacggttcccgggttccctttcccccgggtcgggtacccgtccccgtacggtcccgttaccggaacgggaccgtaccgtaccccgtaccggaaacggacgacccgaaccgaccggccccgggtacccggtcgggttaccgtcggtaccgttaccgggaacctaacgggttacccttacccgtttaccctaacgtacccggtttaccaacggttccggtaggacccgggtcgtaccgggaaccggtacgggaccgtacgtaacg

SEQ ID NO: 221079 - DNA, 797 bp, Homo sapiens
  misc_feature: GYAE6OF02HLECM.18.87.H10.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
  modified_base (659)..(659): a, c, t, g, unknown or other
  misc_feature (659)..(659): n is a, c, g, or t
  modified_base (736)..(736): a, c, t, g, unknown or other
  misc_feature (736)..(736): n is a, c, g, or t
tcagtacgagtatgcacgaccggtgctcgatttagcagtactgcgttgggtttggggaggtctcagagaggagccttagccctggactccgaagcctttccacttggtgatcagcactgagcacagaggactcaccatggaattggggctgagtctgggttttcctcgttagtctatttagaaggtgtcagtgtgacgtgcagcgtggnggagtcggttgggggagtcttggtccgngcccggttgggggccctgacgtacctcctcgtgtcgcgacggtcccncgtctagttacctntttacgtttaaatacgtttagttaaggtntacggctaccggttcggtcccgcgagggtccggtaccggggaacggggccgggtaggtcggggtacgggaccctaaagtaagtagtacggaacctaaagggtaacacggggaaacctggaaaacggtaaacgggttaaacctaagggttcgggttagggtaaacccgtttgggttaacgggtaaccgggaaaaccgggggtcccgttaaacggtttacccaaccccgttacgtaccgtaacccggttaaggaaacccggtaaacccaaacgtaaacccggttaaaaaacttaccgtttaaacgtcgtactttaaccgaggaacccttaaaanacccgtaaccgacgtacccgtaagtacgggacacggacgtaaacccgtcgggtaccttagttgtaaccgttttaagngaacggaccgaaaggccgtaacggtaggtacgggtaccgtagggtacctgggtaaaccggg

SEQ ID NO: 221080 - DNA, 620 bp, Homo sapiens
  misc_feature: GYAE6OF02HN7G1.18.87.H10.1.454.CMB.1.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (502)..(502): a, c, t, g, unknown or other
  misc_feature (502)..(502): n is a, c, g, or t
  modified_base (538)..(538): a, c, t, g, unknown or other
  misc_feature (538)..(538): n is a, c, g, or t
  modified_base (546)..(546): a, c, t, g, unknown or other
  misc_feature (546)..(546): n is a, c, g, or t
  modified_base (595)..(595): a, c, t, g, unknown or other
  misc_feature (595)..(595): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagagactcacatggaagttggggctgagcgttgggtttcctcgttgctattttagaaggtgtccagtgtgagtgcagcgtggtggacgtgtgggggcgnttggccagccgtggggggtccctggacgctctcctgtgcnggccctgcctattcatcttttaaagtagttattaggangacncgttcgggtccgccaggtccggaccgggggaaacgggccgggtaagtcgggggacggaccgaaactaagtaagtaccgacaaaggacgtttaaggacgagaagtaaaccgaaatgttagaggacgttcaggaggaaacgggtctactacacctagcctagaagtaggaaccaaattaacgaagtaaactacgttanacccttagcaaactaaagggctaaacgcgacccgtnaaaccggngacggaacgaagtacgcgttagtacttagtacgtgaacggacgttaagngacgttggacgaggacgtagagtgg

SEQ ID NO: 221081 - DNA, 734 bp, Homo sapiens
  misc_feature: GYAE6OF02HRSHV.18.87.H10.1.454.CMB.1.raw
  modified_base (184)..(184): a, c, t, g, unknown or other
  misc_feature (184)..(184): n is a, c, g, or t
  modified_base (572)..(572): a, c, t, g, unknown or other
  misc_feature (572)..(572): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctggttttctcgttgcttattttagaaggtntcctagtgtagacgtgcagctggtcggagtcgtgggggagcttaggtccagtccgtggggggtcccttagacctccccgtgtaccaggtcctcgtggtactttcctacgttttcgaacggtaacggtcctggaatcggtaacgttcgggtacccgtaccgacggtcctccggaaggggaacggggtcctaggggacgggttgggggttacggtacccggttaaaacttaaaaccaaaacgtggtacgtaggggttacgggaactaacgacgacttacgcgtacggacctacccgtaaggaaacggctaacgtagtaccctactacgtactcaaaaggacgtattaggtaacttaaacgaaaagtcccaaggttcctagggtttaaccncggttaacgaaccttaaagaaccggtactaccggcttacggaacgtaaccggacgttaacaacggaccgtcggttactagttaccgtctaaacccgcttaccgtacctaggtaacccgtactaaccgtaactaccgttaacgtaccgttaaggtctaaccgg

SEQ ID NO: 221082 - DNA, 777 bp, Homo sapiens
  misc_feature: GYAE6OF02GJTAH.18.87.H10.1.454.CMB.1.raw
  modified_base (632)..(632): a, c, t, g, unknown or other
  misc_feature (632)..(632): n is a, c, g, or t
  modified_base (677)..(677): a, c, t, g, unknown or other
  misc_feature (677)..(677): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaattggggctgagcttgggttttcctcgttgctattttagaaggtgtccagtgtgacgtgcagctggtggagtcgtggggggaggcttggtccagccgtggggggtccctgagactctcctgtgcaggcctgcattcattctttaattagttattggatgacctacgtcgggtccgccgagggccgtaccggggggaaggggccgggaggtcgggggtacggacccgaaacgaagttaaacgtggacgtaaaggacgtagggaacctaggaacgtaaacgaaacttagtggtacggacgttcgtaggtacgggaaacgggcccgtaagttaccaacccgtagtaccctaaccgaaggaaacgtaaaccaaacccgtaacgttaaaaacggtaaccctttaacgtcgttaacgtcccttaagaacctaaaacgttcggaaacctaccggtaccttaccggaaaggtacccgggtaaccgggaacgggaaccgttaacccggggtnttaccgggttattaacgttacgttggtacggaacggtaaacgggngttaaccggaggggttacgggtaccggtaccgggggtaaattcgggttaccgggggtaaaccgttcgggggttaacggggaaccccgggtaaacccgggg

SEQ ID NO: 221083 - DNA, 831 bp, Homo sapiens
  misc_feature: GYAE6OF02FOMNQ.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttatttagaaggtgtccagtgtgaggtgcagctggtggaggttccggggggaggcgttggtccaggcccgtcggggggtcccctaggtaaacctcttccctgtgcagccctcgtgggttccaccttcgagtcggccttctgtactagtgccgtacggttcggggtccccggcccgtacggggtcccggttaccgggggtaaaacggggtcggttacggggagggttcggggggtttcgggtaccggtttaaacggtttaaggaacggtaaccgaaaacggtaccgttaaacgaacgggttttaacccgacggtaaccgacggtaccgaattaaacgtcgggttaccgttcgggtacccgggttacgggggttaacggtaaaccgggtaccggttaccgggtttaccccgtaaccccggttcccgttaaaccccggtaaacgtaaaacgttaacgtaacgttaaaccgtaaaacgggtaaaccgtaaccgggtaccgttactacgtacgtaacgaaacgtacgaacgacgacccgtaacggaaaccgaacgaaccgacggaccgttagtaacttacgtagtaccgtaacgacgtacgggtagttacgttaacggtggtttagggtagttacggtacgggtaccgggtaacgggggtaaccg

SEQ ID NO: 221084 - DNA, 813 bp, Homo sapiens
  misc_feature: GYAE6OF02GBOS1.18.87.H10.1.454.CMB.1.raw
tcagtacgagtatgcacgaccggtgctcgatttagcagtactgcgtttgggtttggggaggagccttagccctggactccaaggcctttccacttggtgatcagcactgagcacagaggactcaccataggaagttggggctgagcgttgggtttttcctcgttgtcttattttagaaggtgtcctagtgtgacgtgcagcgtgtggagtcgtgggggagcgttggtccaggccgttggggggtccctgagaccttctccgttgtcgcgacggccctgctattcagtttacttttaagttagtttatttggacttcggctacggttgggtccccgtccgacggggtcccggttaccgggggggaacggggtccggggtacggttcgggggttccggacccgtaaaaccgtataaaggtggaccgtaaaggtaagttacgggaaacgtacggtaaagtaaaacggtaaacgttaagttggttaaggtacccttaggtttacggagggttaaaccgggtccggttaaactttacccggaacctacgtttcccgtaccgaaacggaaccgaaaccgtaaaaccaaccgttaaaacgttaaacccgtttaacgtaggtttaccttactaacgggttaactaaaaagtaccggaaaccgtaccggtaccgttaacgaacgggaacgtcccgggaaacggaacgtaccggtgttacgtacgttaagttccgtagtagaccggaaagtggaaccgtggttacggtaacggtggtaaacttgggtaaccggttcgggtacgaccgggggaccgtaaccggg

SEQ ID NO: 221085 - DNA, 845 bp, Homo sapiens
  misc_feature: GYAE6OF02HT1YY.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagtcgttgggttttcctcgttgtcttattttagaaggtgtccagtgtgacgtgcagtcgtggtggaggtcggtgggggaggtcgttcgggtcccgacggtcccgggtcggggggttcccctaggacgtaccttcctcccgttggtcggccgtaccgggtccccttggctacgtttacctaagtttaactttttaaacgttaggttttaagtttgggtaacttcggtaccgtaaccgggttcggggtacccccggtacccggacggggtcccggggtaacccgggggggaacggggggtcccgggtaggggttccgggggtaccggaacccgaaacgtaagtaacgtcggaacgaacggtagtacgggtaacgtaggaaaggtaaacgtaaacgttgtaggtcggtaccttacggtagggtacgggtaaccgggtccgttacgtttaccctaaccgtataccctacggaagaaccgtaaaccaaaccgtaaacgttaaacggttaacccttttaacgtacgtttaacctcgtaacgaacctaaagtacgaacctaccgtactaccgtaacgggaccgtaccgggaacggaaccgcggttacttaggtttaacgttaacgtttcggttacggtacgggaacgtaacggtacgtacgtacgggtcggtaccgggtaggtaacgtgggttaaccgggg

SEQ ID NO: 221086 - DNA, 780 bp, Homo sapiens
  misc_feature: GYAE6OF02FGWOA.18.87.H10.1.454.CMB.1.raw
  modified_base (168)..(168): a, c, t, g, unknown or other
  misc_feature (168)..(168): n is a, c, g, or t
  modified_base (487)..(487): a, c, t, g, unknown or other
  misc_feature (487)..(487): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagacggactcaccatcggaattgggctgagcgttgggttttccncgttgcttagtttagaaggtcgtccagtgtgacgtgcagcgtggtggtacgtcggtgggggacgtccttcggccacggtccggtcgggggtccctggacgtcctccgtccgtagtcgaccacggccctgctatctaatctttaagtagttctggactggcctacggttcgccgtgacggtccggtacggggtaacgggcggtggtcgggtacgacctaacgtaagtacgtacgacgtaacgagtacggtagtaaccgaaggaaacgtactaacgtcggttacgaccgtacgttggacggaaccggtacctacgtaaccnccgtaacctaccgtaccgaaacgtaaccgtaaacaacccgtaaacgtttaaccggtaaacctttacgttacgtaccttacgttacggaaacctaaacggtaaccgtaaccggacccgttaaaccgtaaccgaaccggggtacgtaaacccggacggggtaacttaccccggggttacgttagttaaccggttttacgttaaacggtcgaaacccggttaagaaccgggtaggtacccgtaagggttacccgggttacggtaaccgggttaccggttaaggttaccccgggggg

SEQ ID NO: 221087 - DNA, 923 bp, Homo sapiens
  misc_feature: GYAE6OF02FM0AZ.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgttgggttttcctcgttgcttattttagaaggtgtccaggtgtgacgtgcagctgggtggagtcggtgggggaggtcgttggtccgaggtccggtacggggggtccctggacgaccttccgtcctaggtgcgcggccctgacctattccgtatttactttaaagttacgtttaagttggagttcggaccgtaccggttcggggtccccgaccggtacggtcccggggtacggggggaacggggtccgggtacgggtcggggtacggaccctaaaggtaacgttaacgtcggaacgtaaaggtacgtaaggggtaaccttagggaaacggtaaaacgtaacgttacgtagggtaccggtaccgttacggttacgggtacgggaaaccggggttccgttaaaccgttcccgtaaacgtccgttacccgtaccgaaacgggtaacgaaacccgtaaaccctaaacggttaaacgttaaaccttttaccggttaaagtttaccgtaccggtttaacgtaaccgtaaaactttacgggaaacccgtacccggaacccggtttacgaacccggggtaaccgtaacccgggtaaacggggtaaacccgttaccccggggtaccgttttagggtaaccgttttaacgggtttttaccccggggtagggttaaacccggggttaaaccggtaacgggttaacgggtaccgggttaaccgggtttccggggtaacccggggtttacggggtaaccgtccgggtttaaaaccccgggggg

SEQ ID NO: 221088 - DNA, 833 bp, Homo sapiens
  misc_feature: GYAE6OF02IGFH7.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatcggaattggggctgagcgtgggttttcctcgttgcttattttagaaggtgtccagtgtgacgtgcagctggtggagtcgtgggggagcttgggtccagccgtgggggtccctgagtctctcctgcgcgacggtcctgctacgttactagtttacttttaaattacgtttagttcggatacggtccgtaacggttccggggtacccgtcccggaagggtcccggttacccgggggggaagggggtaccccggggtaagggttcgggggtaccggacccgtaaaacgtacggttaaactcggaccgtaaaggtaacggttacgggaaacgtaaacgggaagaaaacggtaacgttaacggttacgggtacggttaaccgttcggtacgggtttacgggaacgggacccgttaatttacccgaaaccctagtttaccccgaaaccgtaaagggaaaccgtaaacctaaaacccggttaaagttaaaaccttaaaacccgttttcgtaggttaacctacgttaggaaacttaaaacggacggtaaaacgcccgttaaacccgtagaaccggaaccggacccggtaaacggggcccttaaggggcccttttgggtaaccttacgtttaacggtcggtaacggtaacgaacggactcggggtacggtaacgggtcccggtaagacccggttggtaacgggg

SEQ ID NO: 221089 - DNA, 790 bp, Homo sapiens
  misc_feature: GYAE6OF02JUN53.18.87.H10.1.454.CMB.1.raw
  modified_base (147)..(147): a, c, t, g, unknown or other
  misc_feature (147)..(147): n is a, c, g, or t
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
  modified_base (609)..(609): a, c, t, g, unknown or other
  misc_feature (609)..(609): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcacttcgggtccnccaggcgtcgggggaaggggccggaggtgggtggccaanataatgcaagntggaactgagaagatatgtgactngtagagggctattcacatcctacagacgacaacacgtaaacgtacttacttagtaactcttagactaaatcgaaacganccctagacgacgccgtacggacacggtcctgtaggttactagtgtacggagagacgacgtagcggacgtagggataggtggtaaccggttccgggacgggaacctaacgggggaacccctacggggtaccctacccgtacccgttccgaccgtacccgtacccgacccgtaacccggtaacccgggtcccccgttaaaccggttccccgggttaaccccggtttccccgggtcccggtcccggttacccccgtaccggtcccgttaaccgacccgggtaacccgtacccgtaaccccgtacccgggtanaacccggccggtaacccgcccgggaccccgggttccggtcccggggttccttacgggtacccggtacggggttaaccgaaccggttacccgtttaacctcccgttaaacgttcccgttacgtaaccggtcgtaacccgggtcccggggtcgtaccgggtaccggaaccggacggtactggg

SEQ ID NO: 221090 - DNA, 784 bp, Homo sapiens
  misc_feature: GYAE6OF02G6Z3Y.18.87.H10.1.454.CMB.1.raw
  modified_base (653)..(653): a, c, t, g, unknown or other
  misc_feature (653)..(653): n is a, c, g, or t
  modified_base (728)..(728): a, c, t, g, unknown or other
  misc_feature (728)..(728): n is a, c, g, or t
tcagtacgagtatgcacgaccggtgctcgatttagcagtactgcgttgggtttggggaggtctcagagaggagccttagccctggactccaaggcctttcccacttggtgatcagcactgagcacagaggactcaccatggaagttcgggctggagtcgtgggtttttccttcggttgtacgttattttacggtaaggttgtccagttgtcgtaggtcgcgacgcgtgggtcggtaaggttcgtggggggagtcgttcgggtacgtacggccgggttcgggggggtccctgggtaacgccctccgttccgtggtcgaccgaaccggccgttcgacctagtttcctaatttacgttttaaacttaggtttattagggtacttcggacgttaccggttcgggtaccccgccgtacggtccggtaccgggggacggggaaccgggtcggtgggggtccgaccgtaagtaacgagttacgacgtaaacgagtacgtaacgtgaaagtaacggtaactaagtggtcggaaacttccgtagggtacgggaacgggtaccggtacgttaccaaccggtacttaccgacggtaacgaacggtaaacctaacgaaacttaaaaccgactttaaccgtagttacctacgtagaaactaagtanaaaccgtacgaccttagacggaacgacgaacggagcgtaacgtagttacgtacggttaccggtataccggggaanaacgggttaacgccgttagggtaccggtacggtaagggtacggtacctaacggggg

SEQ ID NO: 221091 - DNA, 915 bp, Homo sapiens
  misc_feature: GYAE6OF02F3SBD.18.87.H10.1.454.CMB.1.raw
  modified_base (121)..(121): a, c, t, g, unknown or other
  misc_feature (121)..(121): n is a, c, g, or t
  modified_base (141)..(141): a, c, t, g, unknown or other
  misc_feature (141)..(141): n is a, c, g, or t
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (245)..(245): a, c, t, g, unknown or other
  misc_feature (245)..(245): n is a, c, g, or t
  modified_base (311)..(311): a, c, t, g, unknown or other
  misc_feature (311)..(311): n is a, c, g, or t
tcagtacgagtatgcacgaccggtgctcgatttagcagtactgcgttgggtttgggggaggcttggtccagcctgggggtccctgagactctcctgtgcaggccctgcattcatctttaanagttatgatgcactggtccncaggctccggggaagggccgagtgggtcgaccaanattaancgacaagatggaactgagaagaactatggtgactcgtggtacgaagggccctattccaacctntcctaccgagacgaacaaacgtataaacgaacctttacgtgtaactctgaactaaaagtcgaaacncgtacctacgaaggtacgtccgggaaaggtaccgaccggtcttaggttaacgtttacgttaaccgtgggtacgaaccggtaaagcggtaccgtaggggtcgttaaccggtaggggaactacgggttacggggtacgtaccggggttcggggaaacccgtaaaaccggggacccgttaccgggtttaaccctaccccggttttcccgtaaccgtcccgaaaccgtttcccccgggtaacccgtaaaccccgggtaacccgggtacccccgtttaaaccggttaccccccggggttttacccccgttccccccggggttccggtaaccccccggttcccccggtaaacgggttccccggttaacccggaaacgggtaccccgtaccccgtaaacccggtcggaacccgggtaccgacccgttacccgggaccgggtccccgggtaacccgggttcggtccgttaacccggttccgggtaaagggtttaacccgaaccgtttacccgttaaccccgttacccggttaaacgtttaccccgttacgtaccggtaccggtaccgggtccggtaacccgggttggaaaccgtaccgggtcaaccgttcgg

SEQ ID NO: 221092 - DNA, 779 bp, Homo sapiens
  misc_feature: GYAE6OF02G7BL0.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagctggtttcctcgttgctatttagagtgtccagtgtgacgtgcagcgtggtgagtcgtggggaggtcgttggtccgagccgtggggggtccctggagacctctctgtgcacggccctgctacgttctatctttaatcgttattacggattgtccgacggttcgggttacccgaccgacgggtccggtaccccggggggaagggggtcccgggagggttgggggtaccggacccgaaaccggtaagtaacgtacggaacgtaaaggtaacgttacgggtaaaccgtaggtaaaggtaaaaccgtaaacgttaacgttaggggttacggtaccgttaccggtttagggtaaccgggtaacgggggtcccgtaacgttaccaaccggttaactaccgttaaccgaacgggaaccgaaacctaaacccgtaacgtaaaacggtaacctttaaccgtacggttaattacccgtagaacgtaaacttacgaaacgtacggtacccttacggaacgttaccgggaacccggtagggaaaccctacggggtacttggttaaccggttacgtagttccgggttacgaacggacgtaggacccgtaggtcggtacggacgggtacgtacggtaccggg

SEQ ID NO: 221093 - DNA, 689 bp, Homo sapiens
  misc_feature: GYAE6OF02FVQPO.18.87.H10.1.454.CMB.1.raw
  modified_base (263)..(263): a, c, t, g, unknown or other
  misc_feature (263)..(263): n is a, c, g, or t
  modified_base (580)..(580): a, c, t, g, unknown or other
  misc_feature (580)..(580): n is a, c, g, or t
  modified_base (665)..(665): a, c, t, g, unknown or other
  misc_feature (665)..(665): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggtttcctcgttgcttattttagaaggtgtccagtgtgacgtgcagcgtggtgagtcgtgggggagtcttggtccagccggtgggggtccctgagtactctcctgtncgtacggccctgctagttcctaattctttaaatagttagtggtatgtacctacgtcgggtccgaccgtacggtcccggtaccggggggagggcccgggtagggttcggggtacggacccgtaaaactagtaaacgtcggaaccgtaaaggacgtacgggtaaaccgaggaaacggaaacgtaaacgtagtggtacggtacttccggtaggtacggacgggtacgtattacccgaacctgtcctaccgaagaccaaacaaacgtactaaagtactttcgtagtatcggaactaacaaagtgaacctacgtcccgtaanagggaccgtaccgaaggtaccgacgggtctaggttacgtactttacggacggtagaaccgtagtccgaaggtcggttaacgggtnaaccggggtatacgggttaccggg

SEQ ID NO: 221094 - DNA, 739 bp, Homo sapiens
  misc_feature: GYAE6OF02G1T3V.18.87.H10.1.454.CMB.1.raw
  modified_base (634)..(634): a, c, t, g, unknown or other
  misc_feature (634)..(634): n is a, c, g, or t
tcagtacgagtatgcacgaccggtgctcgatttagcagtactgcgttgggtttgggaggagccttagccctggactccaaggcctttccacttggtgatcagcactgagcacagaggactcaccatggaagttggggctgagcttgggttttcctcgttgcttatttagaaggtgtccagtgtgacgtgcagcgtggtggagtcgtgggggagtcgttggtccaggccggtggggggtccctggagactctcctgtcgcgacggccctgcattcattactttaattagtttattggattgctacgtcgggtccgccgagggccgggtaccggggggaacggggtccggtaggtggggtaccggacccaaagtaataagtgacgtaaggagtaggaacgtaggaaagtaaagtaactagtggtacggtaacttcggtagggtaggaaccggggtcctaacttaccgaactacgtccctaaacgacggaaacgaaccaaacgtaactaaaagttaaccgttactttaggtacttacggtagtaactaaaaggtccgaaacgacttacccgtacgaaaggggtaccgacccgggtaaggacccgaggggtcctttaggttaagttaactttacgggnggtttacgaacgggtaaggtcggtaacgggacggttacggggaggttacggaattcggggtcggtaaccggggtttcggggaacccgggggaacaacccgggggg

SEQ ID NO: 221095 - DNA, 698 bp, Homo sapiens
  misc_feature: GYAE6OF02IA7Q7.18.87.H10.1.454.CMB.1.raw
  modified_base (147)..(147): a, c, t, g, unknown or other
  misc_feature (147)..(147): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
  modified_base (485)..(485): a, c, t, g, unknown or other
  misc_feature (485)..(485): n is a, c, g, or t
tcagtacgagtatgcacgaccggtgctcgatttagcagtactgcgttggggtttgggggaggcttggtccagccgtggggggtccctgagactctcctgtgcaggccctgcattcatctttaatagttatggatgacattcgggccnccagggtccggtaccggggggaagggggccggaggtcgggggtacgaccctaaagaattaactggaccaaagtacgtagggaaccttggaagtaaacgaacttagtggtagacttcgtggagggaacggcctataccgaccatcacagacgaactaacactaagtacttactgtatcagacaaatcgaacacgtccanaaggcgacggaagacctacggtntacgtatacctttagtggtagacgaaaggaccgtataggtgggcgttaaggggactagnggtaacgtccgggtaggaaccggaacggacgtcccgggtatacccgtctccgacgacnccctacccgacggtacgaccctagtcccgtcctcccggtcgccctaccgtctccgcgtacggacctacccggtaccaccggtacgacgacccgacgtaaccggcccggtccgcgggtccttccgcggttaacgtacggaacccgacccgttaacctccgtacctaccgttgtaccgtaggcggtaccggtcggacgtccggaagcctatacgg

SEQ ID NO: 221096 - DNA, 804 bp, Homo sapiens
  misc_feature: GYAE6OF02IOIXD.18.87.H10.1.454.CMB.1.raw
tcagtacgagtatgcacgaccggtgctcgatttagcagtactgcgttgggtttggggaggtcgtcagagaggagcctttagccctggactccaaggccttccacttggtgatcagcactgagcacagaggactcaaccagtggaagttgggctgaggtcgttcggttttccgtcgttcgcttagttttaagaaggttgtaccgagttgtcgtacgtgcagtcgttgggtaggcgttcgtgggggagtcgttggtccgaggtccgtcgggggttccctggaccgtaccgtcttccgtaggtcgtacgtaccggtccgtacggtacttacgttacgtacgtttaaccgtttaaacgttacggtttagttacggtacgtcgtaccgtaccggttccgggtacccgtaccggtacgggtaccgggtaccggggggtaaccgggtccgggttacgggttacgggtaaccggtaaccgtaacgtaacgtaacggtcgaaccgtaagtacgtacggtaacgtacggtaaagtaacgtaacgttagtacggttacgtacgttacgttacggtaacggtaaccggtacgttacttaacccgtaacgtaacgtccgtaacgaaagtaacgtaaccgtaacctaacgtaacgttaacgttacgtagtacgtacgtaagtacgtaaacgtcgaacctacgtacgtacgtaacgaccgtacggtaacgtaccggtgtacgttaggttaacgttacgttcggtagtaccgtaagtacggaccgtcggtacggtacggacggttacgaacggtcgtcgg

SEQ ID NO: 221097 - DNA, 760 bp, Homo sapiens
  misc_feature: GYAE6OF02G93DJ.18.87.H10.1.454.CMB.1.raw
  modified_base (226)..(226): a, c, t, g, unknown or other
  misc_feature (226)..(226): n is a, c, g, or t
  modified_base (637)..(637): a, c, t, g, unknown or other
  misc_feature (637)..(637): n is a, c, g, or t
  modified_base (702)..(702): a, c, t, g, unknown or other
  misc_feature (702)..(702): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagagactcaccatggaattggggctagagtcgttcgggttttcctcgttgcttatttagaaggtgtccagtgtgagtgcagcgtggtggagtcggtgggggngtcgttcggtccgacggtccggttcggggggtccctaggacgtaccttctccgtggtcgccgtaccggccccgtgtcctaactttcaacgttttacttttaaagttagtttagttgggtaacgtcgtcgtaaccggtccggggtccccgaccggtacgggcccggggtaccggggggaaccgggcggggtaggggtcgggtaccggaaccctaagaacgtaagtcgaaacgtaagtacgtaacggtaacgtaaggaaacggtaaactaaggttgtaggtacgtacttcggtacgggtaaggtacgggtaacctcttaaccactacgtcccaaacggagaacccaaacctaacgtaaacctaaagttaacctttacgacgtttacgtaactgtaaaaccaataaccggaacncgtaacccgtacgaacgtaccgaccggacgaccggtacggtcgttacgttaccgttagttacggnggtacgaacggtaaccgtagtggacggtccgtagggggtactacggtaggtacccggg

SEQ ID NO: 221098 - DNA, 773 bp, Homo sapiens
  misc_feature: GYAE6OF02H2EX6.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagagactcaccatggaattggggctgagcgtggtttcctcgttgtctattttagaaggtgtaccagtgtgacgtgcagcgtggtcggagtcgtgggggagcgttggtcccaggtccggtgggggtacccctgaggactcgtcctgtacgctacgggccctgcgactttacattacgttttaattagttacgtttaggattacgccgtaacgtcggggttaccgaccgagggtaccggtaccgggggggaacgggggtccgggaaggttcgggggtaccggaaccctaaacgtaaacggtaggtaacgaacgtaaaggacgtttaaacggaccgttagggaaacgtaaaaactaaacgtttaacgaggtacggtaccttggtagttaacgggaacggggtactaaccgttacacccgtacttaccgtacgacggtaaacaaacgtaaccgtaacccttaaaagtaaacccgttttataacgttaaccttcgggaaacttaaacaacgttaaacgacgttaaccgtacctacgaaggaaccgtcggaaccgtaacgacgtccgtagtacgttaacttacggtccggtaacggaacggaacgtaggtccggaacggtcggggttaaccggtaacggcgtaacggttaccggg

SEQ ID NO: 221099 - DNA, 758 bp, Homo sapiens
  misc_feature: GYAE6OF02FN4V6.18.87.H10.1.454.CMB.1.raw
  modified_base (137)..(137): a, c, t, g, unknown or other
  misc_feature (137)..(137): n is a, c, g, or t
  modified_base (147)..(147): a, c, t, g, unknown or other
  misc_feature (147)..(147): n is a, c, g, or t
  modified_base (179)..(179): a, c, t, g, unknown or other
  misc_feature (179)..(179): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (722)..(722): a, c, t, g, unknown or other
  misc_feature (722)..(722): n is a, c, g, or t
tcagtacgagtatgcacgaccggtgctcgatttagcagtactgcgttgggtttgggggaggcttggtccagcctgggggggtccctgagactctcctgtgcaggccctgcattcatcttttaatagttattggatgnactgggtccncaggctccggggaagggccgagtggtgccaanataatgcaagtatggaactgagaanaactatggtggactcgngtggaaaggcattcaccatctaccaagtacgaacaacgtaataaacgtaactttacgtcggtaatcctaggactaaatgaaactcggacttcgagacgccgtaaggacacggctaggtgtacttacgtcggagaccggtaaagacgtcctaaggtcgggtaccgtaggggtacctaagttcggggacttacgggtcggggacccggaaaaaggggtccctaacggggttcctaacccgttcgttacccgtaccggagttaacccccgtccgaacccggtaaaccgggacccctacggttacccgggttaccccttccccggtacgggtcccgtacccgttaccggtacccgttaaccgaccgggtaaccggtacccgtaacccgttacccggaacggtaacgacccggttaaacgtcccgggccggtaccccggtggtacctcggtcccgtacgggtaccgtaacgtacctaccgtaccctacgtacccttacggtaccgngtacggccggtagtcggtaccggagccgtataacgg

SEQ ID NO: 221100 - DNA, 918 bp, Homo sapiens
  misc_feature: GYAE6OF02G22B1.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttggggctaggagtcgttcgggttttcctcgttgtacttagttttaggaaggttcgtaccgtagtgtgacgtgcgagtcgtggaggagtcgtggggacgtcttcggccacggtccggttcgggggtccctaggacgtaccgttcgtccgttgcgaccgtacgggtcccctaggaccttaacggtttctaacgtttaacgttttaaaacgttaggttttaacgttaggtactttacgaccggttaaccggtcgggttaacccgccggtaacgggttacccgggtaaccggggggacggggtacggggtacgggttacggggttacggaacccaacgtaagtacgttcggaaacaaggttacggtaacggtaacgtacggaaagtaaacgtaacgttacgtaggtaaccggttaccgttaggtacgggtaaacggggtaaccggggtacctaaaccggtttacccaaccggttacccgtaaccgtaacccggttaaacggaacccggtaaaccgtaaaaccggttaaccgtaaaaccggtttaaccgttaaccggttttaacgttaattaccggaacgttaaaccgtaacgttaaccgggaactacccggtttacaaccgggttaacggacccggttaaccgggaacggttaacccgggacgttacccgtttaggttaccggtttaacgtttacgtaccggggtacgttaacgggaacgtaacgttacgggtaccgggtgggtacccgggtaacggttaccgagggttaacccgggg

SEQ ID NO: 221101 - DNA, 768 bp, Homo sapiens
  misc_feature: GYAE6OF02FO7H1.18.87.H10.1.454.CMB.1.raw
  modified_base (196)..(196): a, c, t, g, unknown or other
  misc_feature (196)..(196): n is a, c, g, or t
tcagtacgagtatgcacgaccggtgctcgatttagcagtactgcgtggagtctgggggaggcttggtccagcctggggggtccctgagactctcctgtgcaggccctgcattcattctttaatagttattggatgcactgggtccgcaggctccgggggaaggggccggagtgggtggaccaacataatgacaagntaggaactgagaagaactatggtggactctgtagaacgggccgattccacatcctaccagagacaacaactaagaacttactagtactcgtagacaaatacgaacgacgtcctacgaggacgaccggtaaggaaccaccgggcttaggtacgtttaatttcgtaggttcgacgaaacgtacggtacagggttcggacgttaacggggactaggttacgggaccggttacgggtcgggggaaccaaagggggttaccccgacggggtacccctaccggttcccgttacccgtacgtaccgtcccgtaaccccgtaacccgggaaaccgggtcccctaacggttcccggtttacccccgtttaccccggacccggtcccgtacccgttccggtaccgtacccggtaacgggtaccgtaccgtaaccccgttaccggaaccggaccgaccgaccgtacgggcccgttacccggcgggtaccgtcgttcgttccgggtacgtaacgtaccttacccggttaccgtacttaccggttacgtacggcgacgggtccggcggtacgaccggagtaccgg

SEQ ID NO: 221102 - DNA, 624 bp, Homo sapiens
  misc_feature: GYAE6OF02G82X2.18.87.H10.1.454.CMB.1.raw
  modified_base (357)..(357): a, c, t, g, unknown or other
  misc_feature (357)..(357): n is a, c, g, or t
  modified_base (527)..(527): a, c, t, g, unknown or other
  misc_feature (527)..(527): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggagcttggtccagccgtggggggtccctggagactctccgtgtgcacggccctgctattcatctttaatagttattggatgcacgtggtccaccgaggcgtccggggaagggccggaggtgggtcggccaacgataangacaagagtaggactagaagaagtaacgtagtgtacggacttcgtaggtacgggaacgggcctaattacccaaccgtacttcccgtaccaagaacgaacaaaccgtactaaaacgaaacctttacgtacgttaacttccgagtaactaaaacgtcgaaacgacgtcccanaacggtacgacccgaaggaacccgagggtctagggttactacgttagtgacggtacgaagtacgactcgggtagtccggaagggtactaggtaccgg

SEQ ID NO: 221103 - DNA, 811 bp, Homo sapiens
  misc_feature: GYAE6OF02FR21K.18.87.H10.1.454.CMB.1.raw
  modified_base (729)..(729): a, c, t, g, unknown or other
  misc_feature (729)..(729): n is a, c, g, or t
tcagtacgagtatgcacgaccggtgctcgatttagcagtactgcgttgggtttggggaggtctcagagaggagccttagccctggactccaaggcctttccacttgtgatcagcactgagcacagagactcaccatggaagttggggctgagtcgtggttttcctcgttgcttatttagaaggtgtccagtgtgagtgcagcgtggtcggagtcgtggggagtcgttcggtccacggtcccggttacggggggtcctaggacgtacctccgtccgtggtcgccgacggtcccctgcctagtttctaacgttactttaagttagtttagttaggatcgtacgtacgtcgggtccgccgtacgggtccgggtaccgggggaacgggggtccggtaacgggtcggggttacggaacccgtaacgtaacgttaaggtacgacgtaaaggacgttacggtaaacgtaggtaaacggaaaacgttaacgtaagtggtacggtacgttacgtagggtaacgggtaaccggtacgtaccttaccgaaccgttaagttcccgtaaacccgtaagggaaaccttaaacccgtaaacctaaacccggtttaaagtaaaccccgttttacgtacggttataaccccgttagaaaccgtaaaactccgtaaaacgccgtttaccaggaaccgagaccgtaacgtacccggtcgtctttagggttaacttacgtttaaccggnggtaaccggtaagaacccggttaacccggaggtttaacgggccccggttaaggtaccgggtaaacgtccggtttaacccggg

SEQ ID NO: 221104 - DNA, 836 bp, Homo sapiens
  misc_feature: GYAE6OF02FSXSI.18.87.H10.1.454.CMB.1.raw
  modified_base (439)..(439): a, c, t, g, unknown or other
  misc_feature (439)..(439): n is a, c, g, or t
tcagtacgagtatgcacgaccggtgctcgatttagcagtactgcgttgggtttggggaggtctcagagaggagccttagccctggactccaaggcctttccacttggtgactcagcactgagcacagaggactcaccagtaggaagttggggctgagcgttgggttttcctcgttgcttattttagaaggtgtccagtgtgacgtgcagcgtggtggagtcgtgggggagtcttggtccagccggtcgggggtccctgacgtactctccgtgtcgccgacggccctgactattctaattctttaaattaggtttatggatgtcgtacggtcgggtccgaccgtacgggccggtaccggggggaaggggccggtaggtcggggtacgacccaaagtagtaacgtggaacgaaacggtacgtacggaaacgtaagggaaanaaaaccggtaaataggtttacgggtaacggtacctacggtttacgggtaaccggggaacggggtacccgttaacgtttacccgaaaccccgtattacccccggtacggtaaacggaaaacctaaacccgtaaaaccctaaaccggtttaaaacggtaaacccttttaagttaacgttaacccgtaccgtttaagtaaaccgtaaaagttaaaccggaaacgtacccgttaaccgttaccggaaacggtaaacccggaaccggtaaaccgggtacccgtaggggtttacttacgggtttaacgttaacgtttccggtaaagttccggggaaaacggtaagtaccgggtaacgttaggggtaccgggtaacccttagggtacccgtagggtaacccggg

SEQ ID NO: 221105 - DNA, 681 bp, Homo sapiens
  misc_feature: GYAE6OF02JQ5ZW.18.87.H10.1.454.CMB.1.raw
  modified_base (526)..(526): a, c, t, g, unknown or other
  misc_feature (526)..(526): n is a, c, g, or t
  modified_base (571)..(571): a, c, t, g, unknown or other
  misc_feature (571)..(571): n is a, c, g, or t
  modified_base (588)..(588): a, c, t, g, unknown or other
  misc_feature (588)..(588): n is a, c, g, or t
  modified_base (604)..(604): a, c, t, g, unknown or other
  misc_feature (604)..(604): n is a, c, g, or t
  modified_base (623)..(623): a, c, t, g, unknown or other
  misc_feature (623)..(623): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaagttgggctgagcgtgggttttcctcgttgctattttagaaggtgtccagtgtgacgtgcagctggtggagtcgtggggaggtcttggtccaggccggttcgggggggtcccctaggacgtacgttcctccgttggtgccgtacggccccttggtcctatttcgtattacctttttaaagttaagtttagttcggtagttcgtccgtacggtccgggtcccgtccgtacggggtccggttaacccggggggaacggggtccgggtacgggttcggggtcgggaccccaaacgttaagtaagtcggaacgaggaacgtaggaaactggaagaaacgtaacgttagtagtcgtacgtcgtagggtagaacgggtccattcccgaacntccgtacaaggacaaacctacgaactaacggtaaccttatcgttntacgtgaacttaaacgnacgtacgaccctaganaacgggcccgagaacccgncgttagtacgtaagttccgtaggaaaccggagatgacggtcgacgtgggattaggcgg

SEQ ID NO: 221106 - DNA, 729 bp, Homo sapiens
  misc_feature: GYAE6OF02JIJV5.18.87.H10.1.454.CMB.1.raw
  modified_base (623)..(623): a, c, t, g, unknown or other
  misc_feature (623)..(623): n is a, c, g, or t
  modified_base (704)..(704): a, c, t, g, unknown or other
  misc_feature (704)..(704): n is a, c, g, or t
  modified_base (712)..(712): a, c, t, g, unknown or other
  misc_feature (712)..(712): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattgggctgagcgtggtttcctcgttgcttattttagaaggtgtccagtgtgacgtgcagcgtgggtggagtcggtgggggagtcgttaggccgaggcccggttcggggggtcccctaggacgtacgttccgtcccgtggttacgccgtacgggtcccctggactactttacaactttacgttttaaagttggtttaagttggtaacgttcgacgtaccggtcgggttaccccgaccgtacgggtcccgggtaccggggggaacggggtcgggtagggttcggggaccgacccgtaaagtaacgttaagcggaacgtaaaggtcgtaggtaaccgtaggaaagtaaacgtacgtagtaggtacggtaactggtaggtacgggacggtctacttccgaaccgtctaccgaccgagaaacaacctaacgaacttaaacgtacctttagtactacttcgtacggaaacttaaaggagttaaaccncgttaccgaagtacggaaccgtccggaaacgacgacggtcttagggttacacgttaaggcgttaaaacggtaacgagtcgnggtacggnggtaggacgattacggg

SEQ ID NO: 221107 - DNA, 675 bp, Homo sapiens
  misc_feature: GYAE6OF02F6OF1.18.87.H10.1.454.CMB.1.raw
  modified_base (628)..(628): a, c, t, g, unknown or other
  misc_feature (628)..(628): n is a, c, g, or t
tcagtacgagtatgcacgaccggtgctcgatttagcagtactgcggttaggggtttggggaggtctcagagaggacgcccttacgccctggactccaaggcctttccacttggtgatcagcactgagcacagaggactcaccatggaattggggctgagctgggttttcctcgttgctattttagaaggtgtccagtgtgacgtgcagtctggtggagtcgtgggggaggtcttgggtccaggccgtcggggggtccctggacgactctcctgtcgcgacgccctgctattcattactttaatagttattggatcgactacggtcgggtccgccgacggaccgggtaccggggggaacggggccgggtagggtcggggtacggaccaacgaagtaagtgacgaaggtatagggaactaggaaagaaacgtaactagtagtacggtacttcgtaggtacgggaacgggtccctaatttcccgaactactcccgtaaccgaagaaccgaaaccaacctaaacgttaaagtaacctttacgtataacctctacgaactaaaagtcgaaacgtctaaccctagaacggacgacccggaaggaccgtacggtctaggttaactaggttaaccngtacggaccgaagcgtacgaggtcgtacggaggtaccgtggtccggg

SEQ ID NO: 221108 - DNA, 863 bp, Homo sapiens
  misc_feature: GYAE6OF02GV123.18.87.H10.1.454.CMB.1.raw
  modified_base (756)..(756): a, c, t, g, unknown or other
  misc_feature (756)..(756): n is a, c, g, or t
  modified_base (805)..(805): a, c, t, g, unknown or other
  misc_feature (805)..(805): n is a, c, g, or t
  modified_base (821)..(821): a, c, t, g, unknown or other
  misc_feature (821)..(821): n is a, c, g, or t
tcagtacgagtatgcacgaccggtgctcgatttagcagtactgcgttgggtttggggaggtctcagagaggagccttagccctggactaccaaggcctttccacttggtgatcagcactgagcacaggaggactcaccagtggaagttggggctggagtcgttcgggttttcctcgttgcttatttaggaaggtgtcagtgtgacgtagcgagcgtgggtggagtcggtgggggagtcgttcggccgacggtccgggtcggggggttccctaggtacgccttccgtccgttggtcgccgcggtccccgtgacctagtttacctaacgtttacgtttaagttaggtttagttggaagttcggtaccgtacgggttcgggtcccgaccggtacggggacccggggtaccgggggggtaaccggggtccggggttaggggtaccgggggttaccgaaccgtaaacgtaacgttaacggtacgtaacggtaaaggtaaggtaacgggtaacggttaaacgggaaacgggtaaaacgtttaaaccggttaaggtttaccgggttaacggtaaccggttacggttacggggtaaaccggggtaacccggggtacccttaaacggtttacccctaaccggttaccgttacccgtaacgaacggtaaaccgaaaacttaaacccgtaaaacgttaaacggttaaacctttacggtaacttagtaaccgtacgtaaactaacgtacgaacctacgccttaaacgnggaaccggtacggacgtaaccgccgttagttacggtacttagttacggngtaacggactaacggntacggtcggtaaggtccggtaaggtagtacccggttacgggg

SEQ ID NO: 221109 - DNA, 668 bp, Homo sapiens
  misc_feature: GYAE6OF02HPSU0.18.87.H10.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagtacgagtatgcacgaccggtgctcgatttagcagtactgcgttgggtttgggggaggcttggtccagcctggggggtccctgagactctcctgtgcaggccctgcattcatctttaatagttattggatgcactgggtccnccaggcgtccggggaagggccggagtgggtggccaacataatgcaaagntggaactggagaagaactagtgtggactcgtgtagaagggccgtattcaccatcctccagacgacaaacnctaagaacttactgatctagacaaagtgaacagcctnagacgccgagaccgaggtctagtcgtatttacnggtacngaaacggngacgtaggtaggcgtaggactagtacggcggttacggtacgggaacgaacgggaccggtacgtcccgaaccgttcgccgtacgaccgtcccctaccgaccggaacggccctacggtcccgttcccgttcccgtcggcccgtcccgtacgtccgtaccggacgtacgacccgtaccgtccggacgtacgaccgtacgaccgggtcccggaccgtcgggtcctaccggtacgttccggtacgtacgtcccgttaccctaccgtaacgtaccgtacgtacggtacggtaccggcggtaccggtaggaacgtacggtacagacg

SEQ ID NO: 221110 - DNA, 833 bp, Homo sapiens
  misc_feature: GYAE6OF02HIAO5.18.87.H10.1.454.CMB.1.raw
  modified_base (205)..(205): a, c, t, g, unknown or other
  misc_feature (205)..(205): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgttgggttttcctcgttgtcttattttagaaggtgtccagtgtgacgtgcngcgtggtcggaggtcggtgggggaggtcgttcgggtccaggtcccggtcgggggggttcccctggacgtaccttccgttccgtggtacggccgacggtccccgtgacctattcctaactttacttttaaagttacgtttagttacgggtactggtaccgtacggttccgggtcccgaccgtaacgggtcccgggtaccgggggggaacgggggtccgggtagggtcggggtaccggacctaaacgtaagtaaacgtcggaacgtaaaggtagtacgggtaaacgaggtaaaggaaaacgtaaacgttacgttagggtacggttaacgttcggttagggtacgggaacgggggtaccttaaccttaacccaccgtaacttacccgtaccgaaagtaaaccgaaccaaacgtaaaccgtaaaacgtttaaccttaacgttcgttaacctacaccgaaagttaaacgtaccggaaacccgtcgtaccgaacggacgggtaaaccgaccggtaacggaccgttacggtcgttacgtttaacggttcctttaagggacggttaacggaacggtacggaaccgttaggggaccggttaacggggtcggaaaccggttaggtccgggttaacggg

SEQ ID NO: 221111 - DNA, 816 bp, Homo sapiens
  misc_feature: GYAE6OF02GXCZ3.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagcgttgggttttcctcgttgcttattttagaaggtgtccagtgtgacgtgcagctgggtggagtcgtgggggaggcgttggtccaggccgtggggggtccctggacgactctcctgtgcacggccctgctattcattctttaatagttagttggatgctacgtcgggtcccgccgagggtccggtaccggggggaacgggggtccgggaagggttcgggggtcggacccgaaacgtaacgtaagtcggaacgtaaaggtagtacgggtaaacgtaggaaaggtaaaacggtaaacgttagttacgggtcggtaaccgttacgttacgggtaagggaaacgggggtccctaaacgtttacccaaacccgttaacttacccgtaaccggaaagaacggtaaaacccaaaaccgttaaaccgttaaaaacggttaaaaccctttttacggtttaacgttaaccgttaccgttaagtaaaccgtaaaacgttacggaaaacccgtacggtacccccgttaaggaaccgggacgaaccccggggtaaacggaacccgtaaccgggttctttacgggttagtttaacgtttccggtaggtaccggaaacggtaacggaggtaccgttaggggtcggtaccgggtacgggtaccgttagggtacccggggg

SEQ ID NO: 221112 - DNA, 778 bp, Homo sapiens
  misc_feature: GYAE6OF02JXUXD.18.87.H10.1.454.CMB.1.raw
tcagtacgagtatgcacgaccggtgctcgatttagcagtactgcgttggggtttggggaggtctcagagaggagccttagccctggactccaaggcctttccacttggtgatcagcactgagcacagaggactcaccatggaattggggctgagcgttgggttttcctcgttgcttattttagaaggtgtccagtgtgacgtgcagcgtgggtggagtcggtgggggaggcgttggtccaggccggtcggggggtccctggacgactcctcctgtcgcacggccctgctattccatttactttaattaggtttatggtatcgacgacggttcgggtcccgccggacgggccggggtaccggggggaacgggggacccggggtagggtacgggggtacggaacccgtaaacgtaagtaaagtacggaacgtaaaggagtaaggaaacgtaggaaaggtaaactaagtaacgttggacggtaccttacgggtagtaacggggaaccgggtcctaaccgttccaaccgttactcccaaccgtaaagtaaccgaaaccctaaactaaacccgttaaaacttaacctttaacgttaagttaccttcaaacgtaactaaaacgaacgtaaaccgaccgtaacctaacggaacgaaccggtaccggaaacggaacccggtacggttcctaggggttaatttaacgtaccgggtaggtaacggtacggtaaggtaagggcccgtttaggggaggtaccggtaacgggtacgtcgggttaaccgggg

SEQ ID NO: 221113 - DNA, 655 bp, Homo sapiens
  misc_feature: GYAE6OF02H82NB.18.87.H10.1.454.CMB.1.raw
  modified_base (295)..(295): a, c, t, g, unknown or other
  misc_feature (295)..(295): n is a, c, g, or t
  modified_base (499)..(499): a, c, t, g, unknown or other
  misc_feature (499)..(499): n is a, c, g, or t
  modified_base (644)..(644): a, c, t, g, unknown or other
  misc_feature (644)..(644): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgcttattttagaaggtgtccagtgtgacgtgcagctggtggagtcgtgggggagcttggtccagccgtggggggtccctggagactctcctgtgcacggccctgctattcattacttaattagttnttggatgctacgtgggtcccacgagggcggtccgggggaaggggtccggaggttcgggcgggaccaaagagtaagtggacaaggagttagggaactaggaagaagaacgtagtagtcggacctcgtagggtacggaacggggccttattaccgaaccatccgtacaagacgaaacctaaacaaccgttaaagtaacttttacgngttactacgtacgtaacaaacgttcgaaacgaccgtcccgtaagaaccggtacgaaccgggaaggtaacccgacggttcgttaggttcttaacgtttcgaggtcggaacgtaaaggcaggtacggtagggaccggtagggtaccnggttacccggg

SEQ ID NO: 221114 - DNA, 639 bp, Homo sapiens
  misc_feature: GYAE6OF02FOUFC.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctctgtgcaggccctgcattcattactttaattagttattggtatgacacgttgggcccgccgaggcgtaccgggggaagggccggaggtcggggtgaccgaagataagtcgacaagataggaataggaagaagtaactagtggtaggtacttgtaggtaggaacgggtcctaagtcaccaagttcccgtaccgaagaaccgtaacaaaaccgtacgtaaaagtaaccttagttagtacgtactgaaactaaactaggaaaccacgtccgaaccgtaaggaccgtacggaaacggtacgacgggtcttacgttagtacgtttagtcggtacgaacgtaacggatcggtacggttaccgggactaggggtactaggttaaccgggg

SEQ ID NO: 221115 - DNA, 753 bp, Homo sapiens
  misc_feature: GYAE6OF02GSW37.18.87.H10.1.454.CMB.1.raw
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagaggactcaccatggaagttggggctgagctgggttttcctcgttgctatttagaaggtgtccagtgtgacgtgcagcgtgggtggagtcgtgggggaggtcgttggtccaggtcccggtcgggggggtcccctggacgacctcgtcctgtacngtctctggacttcaccgtctcctactttnccatcggccgtcggggtcccggccggctccggaggggaacgggccgtggggaggtcggggtcctccgtactatcgtaggtcgaacctacgttaggtaaagtcgggacgaagtacgacgtaaggtcggtaaccggcgacgggtccgtccggggtagggggtacgggggtcccgttacgaacccgtaagttacggacaaggaacgaacctaaacgtaacccgaaaggaaacccgtacgttacttaacttaacctaaacaaaacgttacgaaaccgacggtaccgtaggaacggaaccgaccgggaaaccggtaacccggacccggttccccttaggtttacctttcggttacggttggtaacggaaggtaacgttaacgttaaaccgtttaaacccgttttacccggtttaacgttacgttttacggtttacgtttaagtaacggg

SEQ ID NO: 221116 - DNA, 733 bp, Homo sapiens
  misc_feature: GYAE6OF02F8B1X.18.87.H10.1.454.CMB.1.raw
  modified_base (692)..(692): a, c, t, g, unknown or other
  misc_feature (692)..(692): n is a, c, g, or t
tcagtacgagtatgcacgaccggtgctcgatttagcagtactgcgttgggtttggggaggtctcagagaggagccttagccctggactccaaggcctttccacttggtgatcagcactgagcacagaggactcacatggaagttggggctgagcttgggttttcctcgttgcttattttaggaaggtgtccagtgtgacgtgcagctggtggagtcggtgggggaaggtcgttggtccgaggtcccggttcggggggggtacccctggacgtaccgttccgtccctggttcggaccgacgggtccccctggacctatttctatttaccttttaaagttaggttttagttgggaacttcggacgtaccggttcggggtccccgaccggtacgggtcccgggtaccggggggaacggggccgggtaggggttcggggccggtaccaaacgtagtaaacgtgtaacgaaagtgtacgggaactaggtaaagaaagtaaccgagttggtaggtacctcggtggtaagggtaccggggtacctactttacccaacgtctccgtacaagaacaacaaaccgtacttaaacgaacttattacgttctacagtaacaatccgaacaccgtacctagaaccggtacgacgacggaccgacggtaccgtgttctaagttcggtcgtaggaaccgttaagggntaccggagggttccggagtaaccgggatcggttaaccgggg

SEQ ID NO: 221117 - DNA, 740 bp, Homo sapiens
  misc_feature: GYAE6OF02HQEKC.18.87.H10.1.454.CMB.1.raw
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
  modified_base (488)..(488): a, c, t, g, unknown or other
  misc_feature (488)..(488): n is a, c, g, or t
  modified_base (667)..(667): a, c, t, g, unknown or other
  misc_feature (667)..(667): n is a, c, g, or t
  modified_base (688)..(688): a, c, t, g, unknown or other
  misc_feature (688)..(688): n is a, c, g, or t
tcagtacgagtatgcacgaccggtgctcgatttagcagtactgcggttgggtttggggaggtctcagagaggagccttagccctggactccaaggcctttccacttggtgactcagcactgagcacagacgactcacagtaggaagttggggctggagcgttcgggttttcctcgttcgtcttaatttaggaaggtgtccgagtgtcgacgtgacntcgtggnggagtcggnggggagcgttacggcgacgtccggtgggggtccngagctcgtcgtgtcncgtacgcctgctagttactattacttaagtagttcttggatcgtacncggtcggtccgcgacgggtccggtaccggggacgggtaccggtggcgggtaccggacctaaagtgtaacgtagaaccgtaggagtacgggattagggaaagaagtaaacgtggtcgttacgcgttagtacgggtaggaaccgggcttaacgtacctaccngttaccgtcgaagtaccgaaactaaaccgtacgttaaaccgtaaacgtttcgttaacgtaccgtttacgaccaaagtttaaccgaacgtttaaacccgcgtaaccgtaaccgacgggaaccgaaccgggttaacgacccgttacgggtctttaaacccggttggtttaattacccgggngttaacggaccggtaaaacgnggtacgggttaccgggcggtaacgggtacttaacgggtcgtttaaccggggg

SEQ ID NO: 221118 - DNA, 709 bp, Homo sapiens
  misc_feature: GYAE6OF02II0Z0.18.87.H10.1.454.CMB.1.raw
  modified_base (151)..(151): a, c, t, g, unknown or other
  misc_feature (151)..(151): n is a, c, g, or t
  modified_base (677)..(677): a, c, t, g, unknown or other
  misc_feature (677)..(677): n is a, c, g, or t
tcagtacgagtatgcacgaccggtgctcgatttagcagtactgcgttgggtttggggaggtctcagagaggagccttagccctggactccaaggccctttccacttggtgatcagcactgagcacagaggactccaccagtggagttgggntgagcgttcgggtttcctcgttgtcttagtttaggaggtgtctagtgtgacgtgcgagcgtgggtggaggtcgggtgggggaggtcgttcggtccgacggtccgggttcgggggggtccctggtaacggtccttccgtccgttggtcggccggtccggtcccgtggtcctatttactattacctttaaagttacgttaggtggtatcgcgtggtccggtaccgcgtaccggtcggtacgggggacgggtcgggtagggtcgggtcggaaccgtaagtaagtaacgtaggacgtaaggtacgtacgggtaacgaagaaacgtaaagtaacgttagtccggttacgaacgttcgtagggtacggacggtccgtaactcctaaacgctacggacaacgagtaacacgtaactaaggttaccttgaacttcgtacttaagaacctagtaaccgacacgtacgcgaagacccggtaacgcggtaaaccgttcgtacgttgttaaggttctagtacggaggaccgtagacgnggtaagggtcgtaaggcgtacgtgggaacggg

SEQ ID NO: 221119 - DNA, 738 bp, Homo sapiens
  misc_feature: GYAE6OF02G597A.18.87.H10.1.454.CMB.1.raw
  modified_base (592)..(592): a, c, t, g, unknown or other
  misc_feature (592)..(592): n is a, c, g, or t
  modified_base (701)..(701): a, c, t, g, unknown or other
  misc_feature (701)..(701): n is a, c, g, or t
tcagtacgagtatgcacgaccggtgctcgatttagcagtactgcgttgggtttgggggaggtctcagagaggagccttagccctggactccaaggcctttccacttggtgatcagcactgagcacagaggactcaccatggaagttggggctggagcgttgggttttcctcgttgcttattttagaggtgtccagtgtgacgtgcagctggtggagtcgtgggggaggtcgttgggtccaggtcccggtcgggggggtcccctggacgaccttccgtccgtggtcgccgaccggtccctgcctattcaatttactttaaatagtttattcggtattcggtacgtcgggtcccgccgtacgggccgggtaccggggggaacggggccgggtagggttgggtaccggacccaacgtaagttaacgtaggaccgtaaaggtacgtaacgggaaacgtacggaaacgtaaagtaaacgttaggtacggtacggtaaccgtgtaggtaagggaaccgggtcccttaacttcccgaaccctattcccctaaccgaagaaacgtaccaaactaaccgtaaacgtaactttcgtacgtancgtacaaactaatccgaaacgtcgtacctagaacggtacgcccgggtaaggacctaccgggttgtagttcggttaacttccggtggtaacggaaccgtaaggcgtacgngggtcggtacggtagggaccttagggtaccggtcggg

SEQ ID NO: 221120 - DNA, 763 bp, Homo sapiens
  misc_feature: GYAE6OF02HZZJ9.18.87.H10.1.454.CMB.1.raw
  modified_base (205)..(205): a, c, t, g, unknown or other
  misc_feature (205)..(205): n is a, c, g, or t
  modified_base (599)..(599): a, c, t, g, unknown or other
  misc_feature (599)..(599): n is a, c, g, or t
  modified_base (701)..(701): a, c, t, g, unknown or other
  misc_feature (701)..(701): n is a, c, g, or t
tcagtacgagtatgcacgaccggtgctcgatttagcagtactgcgttgggtttggggaggtctcagagaggagccttagccctggactccaacggtcctttccacttggtgatcagcactgagcacagagactcaccatggaagttgggctgagcgttgggtttcctcgttgtcttagttttagaaggtgtccagtgtgacgtgnagctggtggagtcggtgggggagtcgttggtccgaggtccggttcggggggtccctggacgtaccttccgtccgtggtcgaccgacggccctggcctatttcctagttacttttaagttaagtttgttaggatcgcctacggttccgggtaccgcgacgggtccggtaaccgggggacggggtccggtcgggtgggtcgacccgaagtagtaagcgaacgtaagacgtaaggaactagggaaagtaacgtaacgttagtagggttacgtacgttcggacgggttacggaacggtcgtaactaccgtaaccgcgtacgtacccggaagaaaccgtaacccgtaaaccgaaagttaaaccgtttaaccgttttaacccgtaggttaacctcgtaanaaacccgttaaagtaccggaaacctacccgtccgtaaagacggtaccgggaaccgaaggtaccccggttacgcttacgggtttacttaaccggtttaccggngtaccggtaaacgacggtagtacggtaccgggttcggaccggtaggtacgtacgggtacggg

SEQ ID NO: 221121 - DNA, 870 bp, Homo sapiens
  misc_feature: GYAE6OF02GZKLW.18.87.H10.1.454.CMB.1.raw
tcagtacgagtatgcacgaccggtgctcgatttagcagtactgcgttgggtttggggaggtctcagagaggagccttagccctggactccaaggcctttccacttggtgatcagcactgagcacagagactcaccatggaattgggctgagctgggttttcctcgttgctattttagaaggtgtccagtgtgacgtgcagcgtggtaggagtcgtgggggagtcgttcgggtccaggtcccgtcgggggggtcccctggacgtactccgtccgtgtgccgacggtccccgtagcctaagttctaacgtttaccttttaagttaagtttaagtttcggattcggtacctaccgttcggggttccccgaccggaacgggtacccgggttaccccgggggggaaacgggggcccggggtaacgggttcgggggttacggaaccccgtaaaacgtaaacgttaaacgtcggtaaccgaaaggtacggttagggtaaaccgttagggaaaacggaaaacggtaaaccgtttaacgtaacgggttaacgggtaaccgtttacgttacgggtaacgggtaaacggggggttcccctaaagtttaccccggaaccccttacggttacccctaacgtaaaggaccgtaaaccgaaacccgtaaaccttaaagggttaacccttttaaccgtggtttaacctccggttaagacctaaaggttacgaaacctacgcccgttagaacggcccggtacggaacggtaaccgtaccgtcgtttacggtacgttaaccttcggtagggtaacccggtaacgtaaccgagggtacccgttacgggtagggttccccggtaaaggggtccctacgggttaaccgggg

SEQ ID NO: 221122 - DNA, 216 bp, Homo sapiens
  misc_feature: GYAE6OF01BP9X7.21.74.G08.1.454.CMB.1.raw
  modified_base (213)..(216): a, c, t, g, unknown or other
  misc_feature (213)..(216): n is a, c, g, or t
tcagtcgtcgctcgcacgaccggtgctcgatttagtagctctatcagggcagacccaggtgctggcccgggtttggtctgagcctcagtcactgtgttatgtcttcggaactgggaccaaggtcaccgtcctaggtcagcccaaggccaacccactgtcacttgttcccacctcctcctcgtctctactgagcgggctggcaaggcgcatagnnnn

SEQ ID NO: 221123 - DNA, 220 bp, Homo sapiens
  misc_feature: GYAE6OF01D4L76.21.74.G08.1.454.CMB.1.raw
  modified_base (217)..(220): a, c, t, g, unknown or other
  misc_feature (217)..(220): n is a, c, g, or t
tcagtcgtcgctcgcacgaccggtgctcgatttagtagctctatcaggggcagacccaggtgctggcccggggtttggtctgagcctcagtcactgtgttatgtcttcggaactgggaccaaggtcaccgtcctaggtcagcccaaggccaacccactgtcactctgttcccgccctcctcctcgtctctactgagcgggctggcaaggcgcatagnnnn

SEQ ID NO: 221124 - DNA, 262 bp, Homo sapiens
  misc_feature: GYAE6OF01CU9DK.21.74.G08.1.454.CMB.1.raw
  modified_base (233)..(233): a, c, t, g, unknown or other
  misc_feature (233)..(233): n is a, c, g, or t
  modified_base (238)..(240): a, c, t, g, unknown or other
  misc_feature (238)..(240): n is a, c, g, or t
  modified_base (242)..(242): a, c, t, g, unknown or other
  misc_feature (242)..(242): n is a, c, g, or t
  modified_base (244)..(248): a, c, t, g, unknown or other
  misc_feature (244)..(248): n is a, c, g, or t
  modified_base (250)..(250): a, c, t, g, unknown or other
  misc_feature (250)..(250): n is a, c, g, or t
  modified_base (252)..(253): a, c, t, g, unknown or other
  misc_feature (252)..(253): n is a, c, g, or t
  modified_base (255)..(255): a, c, t, g, unknown or other
  misc_feature (255)..(255): n is a, c, g, or t
  modified_base (258)..(262): a, c, t, g, unknown or other
  misc_feature (258)..(262): n is a, c, g, or t
tcagtcgtcgctcgcacgaccggtgctcgatttagtagctctatcagggggcaggacccaggtgtctggcccggggtttggtctgagcctcagtcacgtgtcgttatagtctttcggaactgggacaaggttcacgtctaggtcagccaaggctaaccccagtgtcacgtcctaggttcccgaccgtctacctcgtactactacgtggagcgggctaggcaaggcgctatagntcgcnnnanannnnngngnngnagnnnnn

SEQ ID NO: 221125 - DNA, 221 bp, Homo sapiens
  misc_feature: GYAE6OF01DRZOF.21.74.G08.1.454.CMB.1.raw
  modified_base (220)..(221): a, c, t, g, unknown or other
  misc_feature (220)..(221): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggccaaccccactgtcactctgttcccgccctcctccgagcgacgactgagcgggctggcaaggcgcatagnn

SEQ ID NO: 221126 - DNA, 215 bp, Homo sapiens
  misc_feature: GYAE6OF01B4DI1.21.74.G08.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtagctctatcagggcagacccaggtgctggcccgggtttggtctgagcctcagtcactgtgttatgtcttcggaactgggaccaaggtcaccgtcctaggtcagcccaaggccaacccactgtcactctgttcccaccctcctcctcgtctctactgagcgggctggcaaggcgcatagn

SEQ ID NO: 221127 - DNA, 221 bp, Homo sapiens
  misc_feature: GYAE6OF01CZP44.21.74.G08.1.454.CMB.1.raw
  modified_base (218)..(221): a, c, t, g, unknown or other
  misc_feature (218)..(221): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccgcctcctcctcgtctctactgagcgggctggcaaggcgcatagnnnn

SEQ ID NO: 221128 - DNA, 222 bp, Homo sapiens
  misc_feature: GYAE6OF01BEKBZ.21.74.G08.1.454.CMB.1.raw
  modified_base (219)..(222): a, c, t, g, unknown or other
  misc_feature (219)..(222): n is a, c, g, or t
tcagtcgtcgctcgcacgaccggtgctcgatttagtagctctatcaggggcagacccaggtgctggccccggggttttggtctgagcctcagtcactgtgttatgtcttcggaactgggaccaaggtcaccgtcctaggtcagcccaaggccaacccactgtcactctgttcccgccctcctcctcgtctctactgagcgggctggcaaggcgcatagnnnn

SEQ ID NO: 221129 - DNA, 222 bp, Homo sapiens
  misc_feature: GYAE6OF01DNRKU.21.74.G08.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221130 - DNA, 226 bp, Homo sapiens
  misc_feature: GYAE6OF01C6O31.21.74.G08.1.454.CMB.1.raw
  modified_base (222)..(226): a, c, t, g, unknown or other
  misc_feature (222)..(226): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnn

SEQ ID NO: 221131 - DNA, 225 bp, Homo sapiens
  misc_feature: GYAE6OF01BHT93.21.74.G08.1.454.CMB.1.raw
  modified_base (221)..(225): a, c, t, g, unknown or other
  misc_feature (221)..(225): n is a, c, g, or t
tcagtcgtcgctcgcacgaccggtgctcgatttagtagctctatcaggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnn

SEQ ID NO: 221132 - DNA, 222 bp, Homo sapiens
  misc_feature: GYAE6OF01AE5F4.21.74.G08.1.454.CMB.1.raw
  modified_base (219)..(222): a, c, t, g, unknown or other
  misc_feature (219)..(222): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnn

SEQ ID NO: 221133 - DNA, 223 bp, Homo sapiens
  misc_feature: GYAE6OF01CF2MU.21.74.G08.1.454.CMB.1.raw
  modified_base (221)..(223): a, c, t, g, unknown or other
  misc_feature (221)..(223): n is a, c, g, or t
tcagtcgtcgctcgcacgaccggtgctcgatttagtagctctatcaggggcagaccccaggtgctggccccggggttttggtctgagcctcagtcactgtgttatgtcttcggaactgggaccaaggtcaccgtcctaggtcagcccaaggccaaccccactgtcactctgttcccaccctcctccgagcgacgactgagcgggctggcaaggcgcatagnnn

SEQ ID NO: 221134 - DNA, 222 bp, Homo sapiens; identical to SEQ ID NO: 221129
  misc_feature: GYAE6OF01B4X5D.21.74.G08.1.454.CMB.1.raw
  modified_base (220)..(222): a, c, t, g, unknown or other
  misc_feature (220)..(222): n is a, c, g, or t

SEQ ID NO: 221135 - DNA, 224 bp, Homo sapiens
  misc_feature: GYAE6OF01CYDQ1.21.74.G08.1.454.CMB.1.raw
  modified_base (221)..(224): a, c, t, g, unknown or other
  misc_feature (221)..(224): n is a, c, g, or t
tcagtcgtcgctcgcacgaccggtgctcgatttagtagctctatcaggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnn

SEQ ID NO: 221136 - DNA, 225 bp, Homo sapiens
  misc_feature: GYAE6OF01DC87S.21.74.G08.1.454.CMB.1.raw
  modified_base (217)..(225): a, c, t, g, unknown or other
  misc_feature (217)..(225): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccatgtcactctgttcccacctcctcctcgtctctactgagcgggctggcaaggcgcatagnnnnnnnnn

SEQ ID NO: 221137 - DNA, 223 bp, Homo sapiens
  misc_feature: GYAE6OF01A328P.21.74.G08.1.454.CMB.1.raw
  modified_base (221)..(223): a, c, t, g, unknown or other
  misc_feature (221)..(223): n is a, c, g, or t
tcagtcgtcgctcgcacgaccggtgctcgatttagtagctctatcaggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221138 - DNA, 224 bp, Homo sapiens
  misc_feature: GYAE6OF01D8JK7.21.74.G08.1.454.CMB.1.raw
  modified_base (219)..(224): a, c, t, g, unknown or other
  misc_feature (219)..(224): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggccaacccactgtcactctgttcccgccctcctcctcgtctctactgagcgggctggcaaggcgcatagnnnnnn

SEQ ID NO: 221139 - DNA, 227 bp, Homo sapiens
  misc_feature: GYAE6OF01C81N9.21.74.G08.1.454.CMB.1.raw
  modified_base (222)..(227): a, c, t, g, unknown or other
  misc_feature (222)..(227): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnn

SEQ ID NO: 221140 - DNA, 225 bp, Homo sapiens
  misc_feature: GYAE6OF01CTWAP.21.74.G08.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnn

SEQ ID NO: 221141 - DNA, 238 bp, Homo sapiens
  misc_feature: GYAE6OF01EN33U.21.74.G08.1.454.CMB.1.raw
  modified_base (222)..(238): a, c, t, g, unknown or other
  misc_feature (222)..(238): n is a, c, g, or t
tcagtcgtcgctcgcacgaccggtgctcgatttagtagctctatcaggggcaggaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnnnnnnnnnnnnn

SEQ ID NO: 221142 - DNA, 241 bp, Homo sapiens
  misc_feature: GYAE6OF01EXD7K.21.74.G08.1.454.CMB.1.raw
  modified_base (223)..(241): a, c, t, g, unknown or other
  misc_feature (223)..(241): n is a, c, g, or t
tcagtcgtcgctcgcacgaccggtgctcgatttagtagctctatcagggggcagaccccaggtgctggccccggggttttggtctgagcctcagtcacctgtgttatgtcttcggaactgggaccaaggtcaccgtcctaggtcagcccaaggccaaccccactgtcactctgttcccaccctcctcctcgtctctactgagcgggctggcaaggcgcatagnnnnnnnnnnnnnnnnnnn

SEQ ID NO: 221143 - DNA, 221 bp, Homo sapiens
  misc_feature: GYAE6OF01EXTOP.21.74.G08.1.454.CMB.1.raw
  modified_base (219)..(221): a, c, t, g, unknown or other
  misc_feature (219)..(221): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221144 - DNA, 223 bp, Homo sapiens
  misc_feature: GYAE6OF01BW4LV.21.74.G08.1.454.CMB.1.raw
  modified_base (220)..(223): a, c, t, g, unknown or other
  misc_feature (220)..(223): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnn

SEQ ID NO: 221145 - DNA, 225 bp, Homo sapiens; identical to SEQ ID NO: 221140
  misc_feature: GYAE6OF01D5NMD.21.74.G08.1.454.CMB.1.raw
  modified_base (222)..(225): a, c, t, g, unknown or other
  misc_feature (222)..(225): n is a, c, g, or t

SEQ ID NO: 221146 - DNA, 223 bp, Homo sapiens
  misc_feature: GYAE6OF01BZ1EM.21.74.G08.1.454.CMB.1.raw
  modified_base (221)..(223): a, c, t, g, unknown or other
  misc_feature (221)..(223): n is a, c, g, or t
tcagtcgtcgctcgcacgaccggtgctcgatttagtagctctatcagggggcagaccccaggtgctggccccggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnn

SEQ ID NO: 221147 - DNA, 228 bp, Homo sapiens
  misc_feature: GYAE6OF01C60P0.21.74.G08.1.454.CMB.1.raw
  modified_base (216)..(228): a, c, t, g, unknown or other
  misc_feature (216)..(228): n is a, c, g, or t
tcagtcgtcgctcgcacgaccggtgctcgatttagtagctctatcagggcagacccaggtgctggcccgggtttggtctgagcctcagtcactgtgttatgtcttcggaactggaccaaggtcaccgtcctaggtcagcccaaggccaaccccactgtcactctcgttcccaccctcctcctcgtctctactgagcgggctggcaaggcgcatagnnnnnnnnnnnnn

SEQ ID NO: 221148 - DNA, 226 bp, Homo sapiens
  misc_feature: GYAE6OF01DL4QN.21.74.G08.1.454.CMB.1.raw
  modified_base (221)..(226): a, c, t, g, unknown or other
  misc_feature (221)..(226): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccacctcctcctcgtctctactgagcgggctggcaaggcgcatagnnnnnn

SEQ ID NO: 221149 - DNA, 227 bp, Homo sapiens; identical to SEQ ID NO: 221139
  misc_feature: GYAE6OF01A0W4N.21.74.G08.1.454.CMB.1.raw
  modified_base (222)..(227): a, c, t, g, unknown or other
  misc_feature (222)..(227): n is a, c, g, or t

SEQ ID NO: 221150 - DNA, 265 bp, Homo sapiens
  misc_feature: GYAE6OF01BQXD7.21.74.G08.1.454.CMB.1.raw
  modified_base (231)..(265): a, c, t, g, unknown or other
  misc_feature (231)..(265): n is a, c, g, or t
tcagtcgtcgctcgcacgaccggtgctcgatttagtagctctatcagggggcgagaccccaggtgctggccccgggggttttggtctggagcctcaacgtcactgtgttatgtcttcggaactgggaccaaggtcaccgtcctaggtcagcccaaggccaaccccgactagtcactctgttccccacctcctcctcgtctcctactgagcgggctgggcaaggcgcatagnnnnnnnnnnnnnnnnnnnnnnnnnnnnnnnnnnn

SEQ ID NO: 221151 - DNA, 224 bp, Homo sapiens; identical to SEQ ID NO: 221135
  misc_feature: GYAE6OF01CW7HF.21.74.G08.1.454.CMB.1.raw
  modified_base (221)..(224): a, c, t, g, unknown or other
  misc_feature (221)..(224): n is a, c, g, or t

SEQ ID NO: 221152 - DNA, 219 bp, Homo sapiens
  misc_feature: GYAE6OF01A832E.21.74.G08.1.454.CMB.1.raw
  modified_base (218)..(219): a, c, t, g, unknown or other
  misc_feature (218)..(219): n is a, c, g, or t
tcagtcgtcgctcgcacgaccggtgctcgatttagtagctctatcaggggcagacccaggtgctggcccggggtttggtctgagcctcagtcactgtgttatgtcttcggaactgggaccaaggtcaccgtcctaggtcagcccaaggccaaccccactgtcactctgttcccaccctcctccgagcgacgactgagcgggctggcaaggcgcatagnn

SEQ ID NO: 221153 - DNA, 226 bp, Homo sapiens
  misc_feature: GYAE6OF01DMXOL.21.74.G08.1.454.CMB.1.raw
  modified_base (223)..(226): a, c, t, g, unknown or other
  misc_feature (223)..(226): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnn

SEQ ID NO: 221154 - DNA, 224 bp, Homo sapiens
  misc_feature: GYAE6OF01DPYQ5.21.74.G08.1.454.CMB.1.raw
  modified_base (221)..(224): a, c, t, g, unknown or other
  misc_feature (221)..(224): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaacccactgtcactctgttcccaccctcctcctcgtctctactgagcgggctggcaaggcgcatagnnnn

SEQ ID NO: 221155 - DNA, 235 bp, Homo sapiens
  misc_feature: GYAE6OF01BHHRA.21.74.G08.1.454.CMB.1.raw
  modified_base (215)..(215): a, c, t, g, unknown or other
  misc_feature (215)..(215): n is a, c, g, or t
  modified_base (221)..(235): a, c, t, g, unknown or other
  misc_feature (221)..(235): n is a, c, g, or t
tcagtcgtcgctcgcacgaccggtgctcgatttagtagctctatcagggggcagacccaggtgctggccccggggtttggtctgagcctcagtcactgtgttatgtcttcggaactgggaccaagggtcaccgtcctaggtcagcccaaggccaaccccactgtcactctgttcccaccctcctcctcgtctctactgagcgggctggcaaggcncatagnnnnnnnnnnnnnnn

SEQ ID NO: 221156 - DNA, 227 bp, Homo sapiens
  misc_feature: GYAE6OF01CVA26.21.74.G08.1.454.CMB.1.raw
  modified_base (222)..(227): a, c, t, g, unknown or other
  misc_feature (222)..(227): n is a, c, g, or t
tcagtcgtcgctcgcacgaccggtgctcgatttagtagctctatcagggggcagaccccaggtgctggccccgggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnn

SEQ ID NO: 221157 - DNA, 227 bp, Homo sapiens
  misc_feature: GYAE6OF01BTOQC.21.74.G08.1.454.CMB.1.raw
  modified_base (223)..(227): a, c, t, g, unknown or other
  misc_feature (223)..(227): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnn

SEQ ID NO: 221158 - DNA, 225 bp, Homo sapiens
  misc_feature: GYAE6OF01AU4GB.21.74.G08.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnn

SEQ ID NO: 221159 - DNA, 223 bp, Homo sapiens; identical to SEQ ID NO: 221144
  misc_feature: GYAE6OF01AYNMU.21.74.G08.1.454.CMB.1.raw
  modified_base (220)..(223): a, c, t, g, unknown or other
  misc_feature (220)..(223): n is a, c, g, or t

SEQ ID NO: 221160 - DNA, 228 bp, Homo sapiens
  misc_feature: GYAE6OF01EIQUO.21.74.G08.1.454.CMB.1.raw
  modified_base (217)..(228): a, c, t, g, unknown or other
  misc_feature (217)..(228): n is a, c, g, or t
tcagtcgtcgctcgcacgaccggtgctcgatttagtagctctatcagggggcagaccccaggtgctggcccggggtttggtctgagcctcagtcactgtgttatgtcttcggaactgggaccaaggtcaccgtctaggtcagccaaggccaacccactgtcactctgttcccaccctcctcctcgtctctactgagcggctcggcaaggcgcatagnnnnnnnnnnnn

SEQ ID NO: 221161 - DNA, 224 bp, Homo sapiens
  misc_feature: GYAE6OF01AU1NC.21.74.G08.1.454.CMB.1.raw
  modified_base (221)..(224): a, c, t, g, unknown or other
  misc_feature (221)..(224): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttccgccctcctcctcgtctctactgagcgggctggcaaggcgcatagnnnn

SEQ ID NO: 221162 - DNA, 227 bp, Homo sapiens; identical to SEQ ID NO: 221139
  misc_feature: GYAE6OF01EGSJX.21.74.G08.1.454.CMB.1.raw
  modified_base (222)..(227): a, c, t, g, unknown or other
  misc_feature (222)..(227): n is a, c, g, or t

SEQ ID NO: 221163 - DNA, 222 bp, Homo sapiens
  misc_feature: GYAE6OF01DTSZR.21.74.G08.1.454.CMB.1.raw
  modified_base (218)..(222): a, c, t, g, unknown or other
  misc_feature (218)..(222): n is a, c, g, or t
tcagtcgtcgctcgcacgaccggtgctcgatttagtagctctatcaggggcagacccaggtgctggcccggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnn

SEQ ID NO: 221164 - DNA, 224 bp, Homo sapiens
  misc_feature: GYAE6OF01A7UIZ.21.74.G08.1.454.CMB.1.raw
  modified_base (214)..(214): a, c, t, g, unknown or other
  misc_feature (214)..(214): n is a, c, g, or t
  modified_base (220)..(224): a, c, t, g, unknown or other
  misc_feature (220)..(224): n is a, c, g, or t
tcagtcgtcgctcgcacgaccggtgctcgatttagtagctctatcagggggcagaccccaggtgctggccccggggtttggtctgagcctcagtcactgtgttatgtcttcggaactgggaccaaggtcaccgtcctaggtcagcccaaggccaaccccactgtcactctgttcccgccctcctcctcgtctctactgagcggctggcaaggcncatagnnnnn

SEQ ID NO: 221165 - DNA, 227 bp, Homo sapiens
  misc_feature: GYAE6OF01DLPJL.21.74.G08.1.454.CMB.1.raw
  modified_base (222)..(227): a, c, t, g, unknown or other
  misc_feature (222)..(227): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccgccctcctccgagcgacgactgagcgggctggcaaggcgcatagnnnnnn

SEQ ID NO: 221166 - DNA, 222 bp, Homo sapiens
  misc_feature: GYAE6OF01C6BMV.21.74.G08.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtagctctatcaggggcagacccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221167 - DNA, 228 bp, Homo sapiens
  misc_feature: GYAE6OF01B95T0.21.74.G08.1.454.CMB.1.raw
  modified_base (223)..(228): a, c, t, g, unknown or other
  misc_feature (223)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnnn

SEQ ID NO: 221168 - DNA, 226 bp, Homo sapiens; identical to SEQ ID NO: 221130
  misc_feature: GYAE6OF01B202H.21.74.G08.1.454.CMB.1.raw
  modified_base (222)..(226): a, c, t, g, unknown or other
  misc_feature (222)..(226): n is a, c, g, or t

SEQ ID NO: 221169 - DNA, 226 bp, Homo sapiens
  misc_feature: GYAE6OF01E0JM5.21.74.G08.1.454.CMB.1.raw
  modified_base (221)..(226): a, c, t, g, unknown or other
  misc_feature (221)..(226): n is a, c, g, or t
tcagtcgtcgctcgcacgaccggtgctcgatttagtagctctatcagggggcagaccccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnn

SEQ ID NO: 221170 - DNA, 225 bp, Homo sapiens; identical to SEQ ID NO: 221140
  misc_feature: GYAE6OF01CH1Y5.21.74.G08.1.454.CMB.1.raw
  modified_base (222)..(225): a, c, t, g, unknown or other
  misc_feature (222)..(225): n is a, c, g, or t

SEQ ID NO: 221171 - DNA, 224 bp, Homo sapiens
  misc_feature: GYAE6OF01ACYNX.21.74.G08.1.454.CMB.1.raw
  modified_base (222)..(224): a, c, t, g, unknown or other
  misc_feature (222)..(224): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnn

SEQ ID NO: 221172 - DNA, 225 bp, Homo sapiens; identical to SEQ ID NO: 221158
  misc_feature: GYAE6OF01AJZVU.21.74.G08.1.454.CMB.1.raw
  modified_base (222)..(225): a, c, t, g, unknown or other
  misc_feature (222)..(225): n is a, c, g, or t

SEQ ID NO: 221173 - DNA, 223 bp, Homo sapiens; identical to SEQ ID NO: 221144
  misc_feature: GYAE6OF01EHHO7.21.74.G08.1.454.CMB.1.raw
  modified_base (220)..(223): a, c, t, g, unknown or other
  misc_feature (220)..(223): n is a, c, g, or t

SEQ ID NO: 221174 - DNA, 228 bp, Homo sapiens
  misc_feature: GYAE6OF01EZTE8.21.74.G08.1.454.CMB.1.raw
  modified_base (224)..(228): a, c, t, g, unknown or other
  misc_feature (224)..(228): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggcccaaccccatgtcactctcgttccccaccctcctcctcgtctctactgagcgggctggcaaggcgcatagnnnnn

SEQ ID NO: 221175 - DNA, 260 bp, Homo sapiens
  misc_feature: GYAE6OF01AVOJG.21.74.G08.1.454.CMB.1.raw
  modified_base (223)..(225): a, c, t, g, unknown or other
  misc_feature (223)..(225): n is a, c, g, or t
  modified_base (227)..(260): a, c, t, g, unknown or other
  misc_feature (227)..(260): n is a, c, g, or t
tcagtcgtcgctcgcacgaccggtgctcgatttagtagctctatcaggggcagaccccaggtgctggccccgggggttttggtctgagccctcacgtcactgtgttatgtcttcggaactgggaccaaggtcaccgtcctaggtcagcccaaggccaaccccactgtcactctgttcccgccctcctcctcgtctctactgagcggctggcaaggcgcatagnnngnnnnnnnnnnnnnnnnnnnnnnnnnnnnnnnnnn

SEQ ID NO: 221176 - DNA, 229 bp, Homo sapiens
  misc_feature: GYAE6OF01B9XI0.21.74.G08.1.454.CMB.1.raw
  modified_base (224)..(229): a, c, t, g, unknown or other
  misc_feature (224)..(229): n is a, c, g, or t
tcagtcgtcgctcgcacgaccggtgctcgatttagtagctctatcagggggcagaccccaggtgctggtccccggggttttggtctgagcctcagtcactgtgttatgtcttcggaactgggaccaaggtcaccgtcctaggtcagccaaggccaaccccactgtccactctcgttccccgccctcctccgagcgacgactgagcggctggcaaggcgcatagnnnnnn

SEQ ID NO: 221177 - DNA, 225 bp, Homo sapiens
  misc_feature: GYAE6OF01DB46R.21.74.G08.1.454.CMB.1.raw
  modified_base (221)..(225): a, c, t, g, unknown or other
  misc_feature (221)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaacccactgtcactctgttcccacctcctcctcgtctctactgagcgggctggcaaggcgcatagnnnnn

SEQ ID NO: 221178 - DNA, 231 bp, Homo sapiens
  misc_feature: GYAE6OF01B5F7Z.21.74.G08.1.454.CMB.1.raw
  modified_base (221)..(231): a, c, t, g, unknown or other
  misc_feature (221)..(231): n is a, c, g, or t
tcagtcgtcgctcgcacgaccggtgctcgatttagtagctctatcagggggcagaccccaggtgctggccccggggtttggtctgagcctcagtcactgtgttatgtcttcggaactgggaccaaggtcaccgtcctaggtcagcccaaggccaaccccatgtcactctgttcccaccctcctcctcgtctctactcgagcgggctggcaaggcgcatagnnnnnnnnnnn

SEQ ID NO: 221179 - DNA, 227 bp, Homo sapiens
  misc_feature: GYAE6OF01DKWHY.21.74.G08.1.454.CMB.1.raw
  modified_base (223)..(227): a, c, t, g, unknown or other
  misc_feature (223)..(227): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctcgttcccaccctcctcctcgtctctactgagcgggctggcaaggcgcatagnnnnn

SEQ ID NO: 221180 - DNA, 227 bp, Homo sapiens; identical to SEQ ID NO: 221139
  misc_feature: GYAE6OF01CFTPZ.21.74.G08.1.454.CMB.1.raw
  modified_base (222)..(227): a, c, t, g, unknown or other
  misc_feature (222)..(227): n is a, c, g, or t

SEQ ID NO: 221181 - DNA, 225 bp, Homo sapiens
  misc_feature: GYAE6OF01A7843.21.74.G08.1.454.CMB.1.raw
  modified_base (224)..(225): a, c, t, g, unknown or other
  misc_feature (224)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttccccaccctcctcctcgtctctactgagcgggctggcaaggcgcatagnn

SEQ ID NO: 221182 - DNA, 231 bp, Homo sapiens
  misc_feature: GYAE6OF01AW1HY.21.74.G08.1.454.CMB.1.raw
  modified_base (222)..(231): a, c, t, g, unknown or other
  misc_feature (222)..(231): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcggctggcaaggcgcatagnnnnnnnnnn

SEQ ID NO: 221183 - DNA, 226 bp, Homo sapiens
  misc_feature: GYAE6OF01CHELG.21.74.G08.1.454.CMB.1.raw
  modified_base (220)..(226): a, c, t, g, unknown or other
  misc_feature (220)..(226): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaacccatgtcactctcgttcccgccctcctcctcgtctctactgagcggctggcaaggcgcatagnnnnnnn

SEQ ID NO: 221184 - DNA, 225 bp, Homo sapiens
  misc_feature: GYAE6OF01DO5VB.21.74.G08.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtagctctatcaggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnn

SEQ ID NO: 221185 - DNA, 276 bp, Homo sapiens
  misc_feature: GYAE6OF01C6T0H.21.74.G08.1.454.CMB.1.raw
  modified_base (164)..(164): a, c, t, g, unknown or other
  misc_feature (164)..(164): n is a, c, g, or t
  modified_base (227)..(276): a, c, t, g, unknown or other
  misc_feature (227)..(276): n is a, c, g, or t
tcagtcgtcgctcgcacgaccggtgctcgatttagtagctctatcagggggcagaccccaggtgctgggccccgggggttttggtctgagcctcagtcactgtgttatgtcttacggaactggacctaaggtcaccgtcctaggtcagcccaaggccaaccccnctgtcactctgttcccgccctcctcctcgtcctctactgagcgggctggcaaggcgcgatagnnnnnnnnnnnnnnnnnnnnnnnnnnnnnnnnnnnnnnnnnnnnnnnnnn

SEQ ID NO: 221186 - DNA, 224 bp, Homo sapiens
  misc_feature: GYAE6OF01B9GVC.21.74.G08.1.454.CMB.1.raw
  modified_base (223)..(224): a, c, t, g, unknown or other
  misc_feature (223)..(224): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaacaaggtcaccgtcctaggtcagcccaaggccaaccccactgtcactctgttcccgccctcctcctcgtctctactgagcgggctggcaaggcgcatagnn

SEQ ID NO: 221187 - DNA, 264 bp, Homo sapiens
  misc_feature: GYAE6OF01D5KST.21.74.G08.1.454.CMB.1.raw
  modified_base (226)..(264): a, c, t, g, unknown or other
  misc_feature (226)..(264): n is a, c, g, or t
tcagtcgtcgctcgcacgaccggtgctcgatttagtagctctatcagggggtcagaccccaggtgctggccccggggttttggtcctgagcctcagttcacttgtgttatgtcttcggaactgggaccaaggtcaccgtcctaggtcagcccaaggccaaccccatgtctactctgttcccaccttcctcctcgtctctactgagcgggctggcaaggcgcatagnnnnnnnnnnnnnnnnnnnnnnnnnnnnnnnnnnnnnnn

SEQ ID NO: 221188 - DNA, 228 bp, Homo sapiens
  misc_feature: GYAE6OF01CDNRB.21.74.G08.1.454.CMB.1.raw
  modified_base (223)..(228): a, c, t, g, unknown or other
  misc_feature (223)..(228): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaacccactgtccactctgttccccaccctcctcctcgtctctactgagcgggctggcaaggcgcatagnnnnnn

SEQ ID NO: 221189 - DNA, 230 bp, Homo sapiens
  misc_feature: GYAE6OF01BLC51.21.74.G08.1.454.CMB.1.raw
  modified_base (223)..(230): a, c, t, g, unknown or other
  misc_feature (223)..(230): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnnnn

SEQ ID NO: 221190 - DNA, 237 bp, Homo sapiens
  misc_feature: GYAE6OF01CMDZE.21.74.G08.1.454.CMB.1.raw
  modified_base (223)..(237): a, c, t, g, unknown or other
  misc_feature (223)..(237): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnnnnnnnnnnnn

SEQ ID NO: 221191 - DNA, 229 bp, Homo sapiens
  misc_feature: GYAE6OF01EEQGQ.21.74.G08.1.454.CMB.1.raw
  modified_base (223)..(229): a, c, t, g, unknown or other
  misc_feature (223)..(229): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctccgagcgacgactgagcgggctggcaaggcgcatagnnnnnnn

SEQ ID NO: 221192 - DNA, 245 bp, Homo sapiens
  misc_feature: GYAE6OF01B81YT.21.74.G08.1.454.CMB.1.raw
  modified_base (225)..(245): a, c, t, g, unknown or other
  misc_feature (225)..(245): n is a, c, g, or t
tcagtcgtcgctcgcacgaccggtgctcgatttagtagctctatcagggggcagaccccaggtgctggccccgggggttttggtctgagtcctcagtcactgtgttatgtcttcggaactgggaccaaggtcaccgtctaggtcagcccaaggccaacccctatgtcactctgttccccgccctcctcctcgtctctactgagcgggctggcaagggcgcatagnnnnnnnnnnnnnnnnnnnnn

SEQ ID NO: 221193 - DNA, 233 bp, Homo sapiens
  misc_feature: GYAE6OF01B6CI5.21.74.G08.1.454.CMB.1.raw
  modified_base (217)..(217): a, c, t, g, unknown or other
  misc_feature (217)..(217): n is a, c, g, or t
  modified_base (223)..(233): a, c, t, g, unknown or other
  misc_feature (223)..(233): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctcgttcccaccctcctcctcgtctctactgagcgggctggcaaggcncatagnnnnnnnnnnn

SEQ ID NO: 221194 - DNA, 228 bp, Homo sapiens
  misc_feature: GYAE6OF01BY1TI.21.74.G08.1.454.CMB.1.raw
  modified_base (225)..(228): a, c, t, g, unknown or other
  misc_feature (225)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaaccccactgtcactctgttccccaccctcctcctcgtctctactgagcgggctggcaaggcgcatagnnnn

SEQ ID NO: 221195 - DNA, 230 bp, Homo sapiens
  misc_feature: GYAE6OF01CCT40.21.74.G08.1.454.CMB.1.raw
  modified_base (224)..(230): a, c, t, g, unknown or other
  misc_feature (224)..(230): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccatgtcactctcgttccccaccctcctccgagccgacgactgagcgggctggcaaggcgcatagnnnnnnn

SEQ ID NO: 221196 - DNA, 227 bp, Homo sapiens
  misc_feature: GYAE6OF01AONEL.21.74.G08.1.454.CMB.1.raw
  modified_base (223)..(227): a, c, t, g, unknown or other
  misc_feature (223)..(227): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnn

SEQ ID NO: 221197 - DNA, 225 bp, Homo sapiens
  misc_feature: GYAE6OF01D2EHV.21.74.G08.1.454.CMB.1.raw
  modified_base (221)..(225): a, c, t, g, unknown or other
  misc_feature (221)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtctaggtcagcccaaggccaacccactgtcactctgttcccgccctcctcctcgtctctactgagcgggctggcaaggcgcatagnnnnn

SEQ ID NO: 221198 - DNA, 225 bp, Homo sapiens
  misc_feature: GYAE6OF01B8ONB.21.74.G08.1.454.CMB.1.raw
  modified_base (224)..(225): a, c, t, g, unknown or other
  misc_feature (224)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctcgttccccaccctcctcctcgtctctactgagcgggctggcaaggcgcatgnn

SEQ ID NO: 221199 - DNA, 254 bp, Homo sapiens
  misc_feature: GYAE6OF01B44LL.21.74.G08.1.454.CMB.1.raw
  modified_base (229)..(254): a, c, t, g, unknown or other
  misc_feature (229)..(254): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccatgtcactctcgttccccgccctcctcctcgtctctactgacggcgggctggacaaggcgacagtagnnnnnnnnnnnnnnnnnnnnnnnnnn

SEQ ID NO: 221200 - DNA, 241 bp, Homo sapiens
  misc_feature: GYAE6OF01BCJP9.21.74.G08.1.454.CMB.1.raw
  modified_base (223)..(241): a, c, t, g, unknown or other
  misc_feature (223)..(241): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggcccaaccccactgtcactctgttcccgccctcctcctcgctctactgagcgggctggcaaggcgcatagnnnnnnnnnnnnnnnnnnn

SEQ ID NO: 221201 - DNA, 224 bp, Homo sapiens
  misc_feature: GYAE6OF01EMVM1.21.74.G08.1.454.CMB.1.raw
  modified_base (219)..(224): a, c, t, g, unknown or other
  misc_feature (219)..(224): n is a, c, g, or t
tcagtcgtcgctcgcacgaccggtgctcgatttagtagctctatcagggggcagaccccaggtgctggccccggggttttgtctgagcctcagtcactgtgttatgtcttcggaactgggaccaaggtcaccgtcctaggtcagcccaaggccaacccatgtcactctgttccccaccctcctcctcgtctctactgagcggctggcaaggcgcatagnnnnnn

SEQ ID NO: 221202 - DNA, 235 bp, Homo sapiens
  misc_feature: GYAE6OF01BQSAD.21.74.G08.1.454.CMB.1.raw
  modified_base (225)..(225): a, c, t, g, unknown or other
  misc_feature (225)..(225): n is a, c, g, or t
  modified_base (228)..(235): a, c, t, g, unknown or other
  misc_feature (228)..(235): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtctaggtcagcccaaggcccaaccccactgtcattctcgttccccgccctcctcctcgtctctactgacgcgggctggaccaaggcgctanagnnnnnnnn

SEQ ID NO: 221203 - DNA, 225 bp, Homo sapiens
  misc_feature: GYAE6OF01A0YBK.21.74.G08.1.454.CMB.1.raw
  modified_base (223)..(225): a, c, t, g, unknown or other
  misc_feature (223)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnn

SEQ ID NO: 221204 - DNA, 284 bp, Homo sapiens
  misc_feature: GYAE6OF01DCB9J.21.74.G08.1.454.CMB.1.raw
  modified_base (168)..(168): a, c, t, g, unknown or other
  misc_feature (168)..(168): n is a, c, g, or t
  modified_base (229)..(230): a, c, t, g, unknown or other
  misc_feature (229)..(230): n is a, c, g, or t
  modified_base (232)..(233): a, c, t, g, unknown or other
  misc_feature (232)..(233): n is a, c, g, or t
  modified_base (235)..(284): a, c, t, g, unknown or other
  misc_feature (235)..(284): n is a, c, g, or t
tcagtcgtcgctcgcacgaccggtgctcgatttagtagctctatcagggggcgagaccccaggtgctggccccgggggttttggtctggagccctcaggtccactgttgttatgtcttcggaactgggaccaagggtcaccgtcctaggtcagcccaagccaaccccntgtcacctctgttcccaccctcctcctcgtctctactgagcgggctggcaaggcgcatagnnanncnnnnnnnnnnnnnnnnnnnnnnnnnnnnnnnnnnnnnnnnnnnnnnnnnn

SEQ ID NO: 221205 - DNA, 228 bp, Homo sapiens
  misc_feature: GYAE6OF01AZ5HL.21.74.G08.1.454.CMB.1.raw
  modified_base (222)..(228): a, c, t, g, unknown or other
  misc_feature (222)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtctaggtcagcccaaggccaacccactgtcactctcgttcccgccctcctcctcgtctctactgagcgggctggcaaggcgcatagnnnnnnn

SEQ ID NO: 221206 - DNA, 239 bp, Homo sapiens
  misc_feature: GYAE6OF01CFF8R.21.74.G08.1.454.CMB.1.raw
  modified_base (217)..(217): a, c, t, g, unknown or other
  misc_feature (217)..(217): n is a, c, g, or t
  modified_base (223)..(239): a, c, t, g, unknown or other
  misc_feature (223)..(239): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggcccaaccccatgtcactctcgttccccgccctcctcctcgtctctactgagcggctggcaggcncatagnnnnnnnnnnnnnnnnn

SEQ ID NO: 221207 - DNA, 232 bp, Homo sapiens
  misc_feature: GYAE6OF01C3OU4.21.74.G08.1.454.CMB.1.raw
  modified_base (158)..(158): a, c, t, g, unknown or other
  misc_feature (158)..(158): n is a, c, g, or t
  modified_base (215)..(215): a, c, t, g, unknown or other
  misc_feature (215)..(215): n is a, c, g, or t
  modified_base (220)..(232): a, c, t, g, unknown or other
  misc_feature (220)..(232): n is a, c, g, or t
tcagtcgtcgctcgcacgaccggtgctcgatttagtagctctatcgagggggcagaccccaggtgctggccccggggttttggtctgagcctcagtcactgtgttatgtcttcggaactgggacaggtcacgtcctaggtcagccaaggccaaccccntgtccactctcgttccccgccctcctcctcgtctctatgagcgggtctggacaggcncatgnnnnnnnnnnnnn

SEQ ID NO: 221208 - DNA, 237 bp, Homo sapiens
  misc_feature: GYAE6OF01D4KC2.21.74.G08.1.454.CMB.1.raw
  modified_base (218)..(218): a, c, t, g, unknown or other
  misc_feature (218)..(218): n is a, c, g, or t
  modified_base (225)..(237): a, c, t, g, unknown or other
  misc_feature (225)..(237): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtctaggtcagccaaggccaacccatgtcactctcgtccccaccctcctcctcgtctctacgtgacgcgggtctaggcaaggcncagtagnnnnnnnnnnnnn

SEQ ID NO: 221209 - DNA, 257 bp, Homo sapiens
  misc_feature: GYAE6OF01EACQL.21.74.G08.1.454.CMB.1.raw
  modified_base (163)..(163): a, c, t, g, unknown or other
  misc_feature (163)..(163): n is a, c, g, or t
  modified_base (229)..(257): a, c, t, g, unknown or other
  misc_feature (229)..(257): n is a, c, g, or t
tcagtcgtcgctcgcacgaccggtgctcgatttagtagctctatcagggggcagaccccaggtgctggccccggtggttttggtctgagcctcagtcactgtgttatgtcttcggaactgggaccaaggtcaccgtcctaggtcagcccaaggcccaaccccntgtcactctcgttccccgccctcctcctcgtctctactgagcgggctggacaaggcgactagtagnnnnnnnnnnnnnnnnnnnnnnnnnnnnn

SEQ ID NO: 221210 - DNA, 228 bp, Homo sapiens
  misc_feature: GYAE6OF01D0RLM.21.74.G08.1.454.CMB.1.raw
  modified_base (224)..(228): a, c, t, g, unknown or other
  misc_feature (224)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttccccaccctcctcctcgtctctactgagcgggctggcaaggcgcatagnnnnn

SEQ ID NO: 221211 - DNA, 224 bp, Homo sapiens
  misc_feature: GYAE6OF01EGBVG.21.74.G08.1.454.CMB.1.raw
  modified_base (218)..(218): a, c, t, g, unknown or other
  misc_feature (218)..(218): n is a, c, g, or t
  modified_base (223)..(224): a, c, t, g, unknown or other
  misc_feature (223)..(224): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccatgtcactctcgttcccgccctcctcctcgtctctactgagcgggctggcaaggcgnatagnn

SEQ ID NO: 221212 - DNA, 238 bp, Homo sapiens
  misc_feature: GYAE6OF01A03OW.21.74.G08.1.454.CMB.1.raw
  modified_base (225)..(238): a, c, t, g, unknown or other
  misc_feature (225)..(238): n is a, c, g, or t
tcagtcgtcgctcgcacgaccggtgctcgatttagtagctctatcagggggcagaccccaggtgctgggccccgggggttttggtctgagcctcagtcactgtgttatgtcttcggaactgggaccaaggtcaccgtcctaggtcagcccaaggccaaccccatgtcactctcgttcccgccctcctcctcgtctctactgagcgggctggcaaggcgacatagnnnnnnnnnnnnnn

SEQ ID NO: 221213 - DNA, 239 bp, Homo sapiens
  misc_feature: GYAE6OF01AJECY.21.74.G08.1.454.CMB.1.raw
  modified_base (225)..(239): a, c, t, g, unknown or other
  misc_feature (225)..(239): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctcgttcccaccctcctcctcgtctctactgacgcgggctggcaaggcgcatagnnnnnnnnnnnnnnn

SEQ ID NO: 221214 - DNA, 233 bp, Homo sapiens
  misc_feature: GYAE6OF01BYI3N.21.74.G08.1.454.CMB.1.raw
  modified_base (216)..(216): a, c, t, g, unknown or other
  misc_feature (216)..(216): n is a, c, g, or t
  modified_base (221)..(233): a, c, t, g, unknown or other
  misc_feature (221)..(233): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaagccaaccccatgtcactctcgttccccgcctcctcctcgtctctactgagcggctggcaaggcgnatagnnnnnnnnnnnnn

SEQ ID NO: 221215 - DNA, 226 bp, Homo sapiens
  misc_feature: GYAE6OF01ACFX9.21.74.G08.1.454.CMB.1.raw
  modified_base (221)..(226): a, c, t, g, unknown or other
  misc_feature (221)..(226): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccaccctctcctcgtctctactgagcgggctggcaaggcgcatagnnnnnn

SEQ ID NO: 221216 - DNA, 245 bp, Homo sapiens
  misc_feature: GYAE6OF01CVXE4.21.74.G08.1.454.CMB.1.raw
  modified_base (231)..(245): a, c, t, g, unknown or other
  misc_feature (231)..(245): n is a, c, g, or t
tcagtcgtcgctcgcacgaccggtgctcgatttagtagctctatcagggggcagaccccaggtgctggccccggggttttggtctgagcctcagtcactgtgttatgtcttcggaacgtggaccaaggtcaccgtcctaggtcacgcccaaggccaaccccactcgtcactctcgttccccgccctcctcctcgtctctactgagcggcgtcggcgagcgggggcagtagnnnnnnnnnnnnnnn

SEQ ID NO: 221217 - DNA, 216 bp, Homo sapiens
  misc_feature: GYAE6OF02GYS6W.21.74.G08.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtagctctatcagggcagacccaggtgctggcccggggtttggtctgagcctcagtcactgtgttatgtcttcggaactgggaccaaggtcaccgtcctaggtcagcccaaggccaacccactgtcactctgttcccgccctcctcctcgtctctactgagcgggctggcaaggcgcatagn

SEQ ID NO: 221218 - DNA, 262 bp, Homo sapiens
  misc_feature: GYAE6OF02IY8VD.21.74.G08.1.454.CMB.1.raw
  modified_base (213)..(215): a, c, t, g, unknown or other
  misc_feature (213)..(215): n is a, c, g, or t
  modified_base (218)..(221): a, c, t, g, unknown or other
  misc_feature (218)..(221): n is a, c, g, or t
  modified_base (223)..(262): a, c, t, g, unknown or other
  misc_feature (223)..(262): n is a, c, g, or t
tcagtcgtcgctcgcacgaccggtgctcgatttagtagctctatcaggggcagacccaggtgctggcccggggtttggtctgagcctcagtcactgtgttatgtcttcggaactggaccaaggtcacgtcctaggtcagccaggccaacccactgtcactctgttcccgcctcctcctcgtctctacgtgagcgggctggcaaggcgcatagnnngcnnnncnnnnnnnnnnnnnnnnnnnnnnnnnnnnnnnnnnnnnnnn

SEQ ID NO: 221219 - DNA, 220 bp, Homo sapiens
  misc_feature: GYAE6OF02GVGE4.21.74.G08.1.454.CMB.1.raw
  modified_base (218)..(220): a, c, t, g, unknown or other
  misc_feature (218)..(220): n is a, c, g, or t
tcagtcgtcgctcgcacgaccggtgctcgatttagtagctctatcaggggcagacccaggtgctggcccggggtttggtctgagcctcagtcactgtgttatgtcttcggaactgggaccaaggtcaccgtcctaggtcagcccaaggccaaccccactgtcactctgttcccaccctcctccgagcgacgactgagcgggctggcaaggcgcatagnnn

SEQ ID NO: 221220 - DNA, 223 bp, Homo sapiens
  misc_feature: GYAE6OF02G6D60.21.74.G08.1.454.CMB.1.raw
  modified_base (219)..(223): a, c, t, g, unknown or other
  misc_feature (219)..(223): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnn

SEQ ID NO: 221221 - DNA, 222 bp, Homo sapiens
  misc_feature: GYAE6OF02IFMCO.21.74.G08.1.454.CMB.1.raw
  modified_base (218)..(222): a, c, t, g, unknown or other
  misc_feature (218)..(222): n is a, c, g, or t
tcagtcgtcgctcgcacgaccggtgctcgatttagtagctctatcaggggcagacccaggtgctggccccgggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnn

SEQ ID NO: 221222 - DNA, 220 bp, Homo sapiens
  misc_feature: GYAE6OF02IUQST.21.74.G08.1.454.CMB.1.raw
  modified_base (217)..(220): a, c, t, g, unknown or other
  misc_feature (217)..(220): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttccacctcctcctcgtctctactgagcgggctggcaaggcgcatagnnnn

SEQ ID NO: 221223 - DNA, 239 bp, Homo sapiens
  misc_feature: GYAE6OF02GQLGP.21.74.G08.1.454.CMB.1.raw
  modified_base (220)..(239): a, c, t, g, unknown or other
  misc_feature (220)..(239): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnnnnnnnnnnnnnnnn

SEQ ID NO: 221224 - DNA, 227 bp, Homo sapiens
  misc_feature: GYAE6OF02HYHOU.21.74.G08.1.454.CMB.1.raw
  modified_base (219)..(227): a, c, t, g, unknown or other
  misc_feature (219)..(227): n is a, c, g, or t
tcagtcgtcgctcgcacgaccggtgctcgatttagtagctctatcaggggcagaccccaggtgctggccccggggttttggtctgagcctcagtcactgtgttatgtcttcggaactgggaccaaggtcaccgtcctaggtcagcccaaggccaaccccactgtcactctgttcccaccctctcctcgtctctactgagcggctggcaaggcgcatagnnnnnnnnn

SEQ ID NO: 221225 - DNA, 240 bp, Homo sapiens
  misc_feature: GYAE6OF02JB1H9.21.74.G08.1.454.CMB.1.raw
  modified_base (223)..(240): a, c, t, g, unknown or other
  misc_feature (223)..(240): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnnnnnnnnnnnnnnn

SEQ ID NO: 221226 - DNA, 223 bp, Homo sapiens
  misc_feature: GYAE6OF02FWKNI.21.74.G08.1.454.CMB.1.raw
  modified_base (222)..(223): a, c, t, g, unknown or other
  misc_feature (222)..(223): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnn

SEQ ID NO: 221227 - DNA, 222 bp, Homo sapiens
  misc_feature: GYAE6OF02JHK0L.21.74.G08.1.454.CMB.1.raw
  modified_base (219)..(222): a, c, t, g, unknown or other
  misc_feature (219)..(222): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnn

SEQ ID NO: 221228 - DNA, 243 bp, Homo sapiens
  misc_feature: GYAE6OF02FNLV9.21.74.G08.1.454.CMB.1.raw
  modified_base (223)..(243): a, c, t, g, unknown or other
  misc_feature (223)..(243): n is a, c, g, or t
tcagtcgtcgctcgcacgaccggtgctcgatttagtagctctatcgtaggggcgagacccaggtgctggcccggggtttggtctgagcctcgagtcactgtgttatgtcttcggaactgggaccaaggtcaccgtcctaggtcagcccaaggcctaacccactgttcactctgttcccacctctcctcgtctctactgagcgggtctgggcaaggcgcatagnnnnnnnnnnnnnnnnnnnnn

SEQ ID NO: 221229 - DNA, 227 bp, Homo sapiens
  misc_feature: GYAE6OF02JJRK1.21.74.G08.1.454.CMB.1.raw
  modified_base (219)..(227): a, c, t, g, unknown or other
  misc_feature (219)..(227): n is a, c, g, or t
tcagtcgtcgctcgcacgaccggtgctcgatttagtagctctatcgaggggcagacccaggtgctggccccggggtttggtctgagcctcagtcactgtgttatgtcttcggaactgggaccaaggtcaccgtcctaggtcagcccaaggccaaccccactgtcactctgttcccaccctctcctcgtctctactgagcgggctggcaaggcgcatagnnnnnnnnn

SEQ ID NO: 221230 - DNA, 225 bp, Homo sapiens; identical to SEQ ID NO: 221158
  misc_feature: GYAE6OF02IW3NS.21.74.G08.1.454.CMB.1.raw
  modified_base (222)..(225): a, c, t, g, unknown or other
  misc_feature (222)..(225): n is a, c, g, or t

SEQ ID NO: 221231 - DNA, 225 bp, Homo sapiens; identical to SEQ ID NO: 221203
  misc_feature: GYAE6OF02IPE2V.21.74.G08.1.454.CMB.1.raw
  modified_base (223)..(225): a, c, t, g, unknown or other
  misc_feature (223)..(225): n is a, c, g, or t

SEQ ID NO: 221232 - DNA, 221 bp, Homo sapiens
  misc_feature: GYAE6OF02I87I1.21.74.G08.1.454.CMB.1.raw
  modified_base (220)..(221): a, c, t, g, unknown or other
  misc_feature (220)..(221): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnn

SEQ ID NO: 221233 - DNA, 222 bp, Homo sapiens
  misc_feature: GYAE6OF02I7S8F.21.74.G08.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtagctctatcagggggcagacccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221234 - DNA, 221 bp, Homo sapiens
  misc_feature: GYAE6OF02H1VPF.21.74.G08.1.454.CMB.1.raw
  modified_base (218)..(221): a, c, t, g, unknown or other
  misc_feature (218)..(221): n is a, c, g, or t
tcagtcgtcgctcgcacgaccggtgctcgatttagtagctctatcaggggcagacccaggtgctggcccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnn

SEQ ID NO: 221235 - DNA, 226 bp, Homo sapiens; identical to SEQ ID NO: 221153
  misc_feature: GYAE6OF02GSNKX.21.74.G08.1.454.CMB.1.raw
  modified_base (223)..(226): a, c, t, g, unknown or other
  misc_feature (223)..(226): n is a, c, g, or t

SEQ ID NO: 221236 - DNA, 277 bp, Homo sapiens
  misc_feature: GYAE6OF02H44HP.21.74.G08.1.454.CMB.1.raw
  modified_base (231)..(277): a, c, t, g, unknown or other
  misc_feature (231)..(277): n is a, c, g, or t
tcagtcgtcgctcgcacgaccggtgctcgatttagtagctctatcagggggtcgacgaccccaggtgctcggccccgggggttttggtctgacgcctcagtcactgtgttatgtcttcggaactgggaccaaggtcaccgtccttaggtcagcccaaggccaaccccactggtcactctgttcccgccctcctcctcgtctctactgagcgggctggcaaggcgcagtagnnnnnnnnnnnnnnnnnnnnnnnnnnnnnnnnnnnnnnnnnnnnnnn

SEQ ID NO: 221237 - DNA, 256 bp, Homo sapiens
  misc_feature: GYAE6OF02HJ9KL.21.74.G08.1.454.CMB.1.raw
  modified_base (224)..(256): a, c, t, g, unknown or other
  misc_feature (224)..(256): n is a, c, g, or t
tcagtcgtcgctcgcacgaccggtgctcgatttagtagctctatcgagggggcagaccccaggtgctggccccggggttttggtctgagacctcagtcactgtgttatgtcttcggaactgggaccaaggtcaccgtccgtaggtcagcccaaggccaaccccactgtcactctgttcccaccctcctcctcgtctctactgagcggctggcaaggcgcatagnnnnnnnnnnnnnnnnnnnnnnnnnnnnnnnnn

SEQ ID NO: 221238 - DNA, 226 bp, Homo sapiens; identical to SEQ ID NO: 221130
  misc_feature: GYAE6OF02FUUH0.21.74.G08.1.454.CMB.1.raw
  modified_base (222)..(226): a, c, t, g, unknown or other
  misc_feature (222)..(226): n is a, c, g, or t

SEQ ID NO: 221239 - DNA, 286 bp, Homo sapiens
  misc_feature: GYAE6OF02G7OQD.21.74.G08.1.454.CMB.1.raw
  modified_base (203)..(203): a, c, t, g, unknown or other
  misc_feature (203)..(203): n is a, c, g, or t
  modified_base (228)..(230): a, c, t, g, unknown or other
  misc_feature (228)..(230): n is a, c, g, or t
  modified_base (232)..(286): a, c, t, g, unknown or other
  misc_feature (232)..(286): n is a, c, g, or t
tcagtcgtcgctcgcacgaccggtgctcgatttagtagctctatcagggggcgagaccccaggtgctggccccggggttttggtctgagcctcagtcactgtgttatgtcttcggaactgggaccaaggtcaccgtcctaggtcagccccaaggccaaccccactgtcactctgttccccacctcctcctcgtctctactganccgggctggccaaggcgcataggcnnntnnnnnnnnnnnnnnnnnnnnnnnnnnnnnnnnnnnnnnnnnnnnnnnnnnnnnnn

SEQ ID NO: 221240 - DNA, 223 bp, Homo sapiens
  misc_feature: GYAE6OF02G918D.21.74.G08.1.454.CMB.1.raw
  modified_base (219)..(223): a, c, t, g, unknown or other
  misc_feature (219)..(223): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnn

SEQ ID NO: 221241 - DNA, 244 bp, Homo sapiens
  misc_feature: GYAE6OF02HOPP7.21.74.G08.1.454.CMB.1.raw
  modified_base (228)..(244): a, c, t, g, unknown or other
  misc_feature (228)..(244): n is a, c, g, or t
tcagtcgtcgctcgcacgaccggtgctcgatttagtagctctatcgaggggcacgaccccaggtgctggccccggggtttggtcgtgagccgtcagtcactgtgttatgtcttcggaactgggaccaaggtcacgtctaggtcagccaaggccaacccactggtcactctgttcccgccctccgtcctcgtcctcgtactgacgcgggctggcaaggtccgcactagnnnnnnnnnnnnnnnnn

SEQ ID NO: 221242 - DNA, 288 bp, Homo sapiens
  misc_feature: GYAE6OF02F9FF6.21.74.G08.1.454.CMB.1.raw
  modified_base (230)..(230): a, c, t, g, unknown or other
  misc_feature (230)..(230): n is a, c, g, or t
  modified_base (232)..(288): a, c, t, g, unknown or other
  misc_feature (232)..(288): n is a, c, g, or t
tcagtcgtcgctcgcacgaccggtgctcgatttagtagctctatcagggggtcgagaccccaggttgctggccccgggggttttggtctgagcctcagtcactgtgttaatgtcttcggaactgggaccaaggtcaccgtcctaggtcagcccaaggccaacccactggtcactcctgttcccaccctcctcctcgtctctactgaggcgggctggcaaggcgcatacgncnnnnnnnnnnnnnnnnnnnnnnnnnnnnnnnnnnnnnnnnnnnnnnnnnnnnnnnnn

SEQ ID NO: 221243 - DNA, 223 bp, Homo sapiens
  misc_feature: GYAE6OF02JMHL6.21.74.G08.1.454.CMB.1.raw
  modified_base (217)..(223): a, c, t, g, unknown or other
  misc_feature (217)..(223): n is a, c, g, or t
tcagtcgtcgctcgcacgaccggtgctcgatttagtagctctatcagggcgagacccaggtgctggcccggggtttggtcgtgagcctcagtcactgtgttatgtcttcggaactgggaccaaggtcaccgtcctaggtcagccaaggccaacccactgtcactctgttcccaccctcctcctcgtctctactgagcgggctggcaaggcgcatagnnnnnnn

SEQ ID NO: 221244 - DNA, 223 bp, Homo sapiens; identical to SEQ ID NO: 221146
  misc_feature: GYAE6OF02HXLB8.21.74.G08.1.454.CMB.1.raw
  modified_base (221)..(223): a, c, t, g, unknown or other
  misc_feature (221)..(223): n is a, c, g, or t

SEQ ID NO: 221245 - DNA, 223 bp, Homo sapiens
  misc_feature: GYAE6OF02GNTNB.21.74.G08.1.454.CMB.1.raw
  modified_base (221)..(223): a, c, t, g, unknown or other
  misc_feature (221)..(223): n is a, c, g, or t
tcagtcgtcgctcgcacgaccggtgctcgatttagtagctctatcagggggcagacccaggtgctggccccggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnn

SEQ ID NO: 221246 - DNA, 225 bp, Homo sapiens
  misc_feature: GYAE6OF02GXOFC.21.74.G08.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtagctctatcagggggcagaccccaggtgctggccccgggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnn

SEQ ID NO: 221247 - DNA, 219 bp, Homo sapiens
  misc_feature: GYAE6OF02GH8BA.21.74.G08.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagn

SEQ ID NO: 221248 - DNA, 223 bp, Homo sapiens; identical to SEQ ID NO: 221226
  misc_feature: GYAE6OF02HD9NZ.21.74.G08.1.454.CMB.1.raw
  modified_base (222)..(223): a, c, t, g, unknown or other
  misc_feature (222)..(223): n is a, c, g, or t

SEQ ID NO: 221249 - DNA, 222 bp, Homo sapiens; identical to SEQ ID NO: 221166
  misc_feature: GYAE6OF02F1EH5.21.74.G08.1.454.CMB.1.raw
  modified_base (220)..(222): a, c, t, g, unknown or other
  misc_feature (220)..(222): n is a, c, g, or t

SEQ ID NO: 221250 - DNA, 224 bp, Homo sapiens
  misc_feature: GYAE6OF02HVJ5Y.21.74.G08.1.454.CMB.1.raw
  modified_base (223)..(224): a, c, t, g, unknown or other
  misc_feature (223)..(224): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnn

SEQ ID NO: 221251 - DNA, 241 bp, Homo sapiens
  misc_feature: GYAE6OF02FYW0Y.21.74.G08.1.454.CMB.1.raw
  modified_base (222)..(241): a, c, t, g, unknown or other
  misc_feature (222)..(241): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnnnnnnnnnnnnnnnnn

SEQ ID NO: 221252 - DNA, 224 bp, Homo sapiens
  misc_feature: GYAE6OF02IAWD0.21.74.G08.1.454.CMB.1.raw
  modified_base (222)..(224): a, c, t, g, unknown or other
  misc_feature (222)..(224): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221253 - DNA, 234 bp, Homo sapiens
  misc_feature: GYAE6OF02F3W15.21.74.G08.1.454.CMB.1.raw
  modified_base (222)..(234): a, c, t, g, unknown or other
  misc_feature (222)..(234): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctagggtcagcccaaggccaaccccactgtcactctgttcccacccttcctccgagcgacgactgagcgggctggcaaggcgcatagnnnnnnnnnnnnn

SEQ ID NO: 221254 - DNA, 284 bp, Homo sapiens
  misc_feature: GYAE6OF02FV7PW.21.74.G08.1.454.CMB.1.raw
  modified_base (239)..(284): a, c, t, g, unknown or other
  misc_feature (239)..(284): n is a, c, g, or t
tcagtcgtcgctcgcacgaccggtgctcgatttagtagctctatcgaaggggggcagaccccacggtgctgggccccgggggttttggtctgagcctcagtcacgtcgtgttatgtcttcggaacgtgggacccaaggtcaccgtcctaggtcacgccccaagggccaacccccatgtcactcctgttccccgccctcctcctccgtctctacctgcgcgggctggcaggcgcatagannnnnnnnnnnnnnnnnnnnnnnnnnnnnnnnnnnnnnnnnnnnnn

SEQ ID NO: 221255 - DNA, 244 bp, Homo sapiens
  misc_feature: GYAE6OF02HMM2X.21.74.G08.1.454.CMB.1.raw
  modified_base (223)..(244): a, c, t, g, unknown or other
  misc_feature (223)..(244): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnnnnnnnnnnnnnnnnnn

SEQ ID NO: 221256 - DNA, 231 bp, Homo sapiens
  misc_feature: GYAE6OF02JBGWY.21.74.G08.1.454.CMB.1.raw
  modified_base (221)..(231): a, c, t, g, unknown or other
  misc_feature (221)..(231): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctctcctcgtctctactgagcgggctggcaggcgcatagnnnnnnnnnnn

SEQ ID NO: 221257 - DNA, 220 bp, Homo sapiens
  misc_feature: GYAE6OF02HREM1.21.74.G08.1.454.CMB.1.raw
  modified_base (218)..(220): a, c, t, g, unknown or other
  misc_feature (218)..(220): n is a, c, g, or t
tcagtcgtcgctcgcacgaccggtgctcgatttagtagctctatcaggggcagacccaggtgctggccccggggtttggtctgagcctcagtcactgtgttatgtcttcggaactgggaccaaggtcaccgtcctaggtcagcccaaggccaaccccactgtcactctgttcccaccctcctcctcgtctctactgagcggctggcaaggcgcatagnnn

SEQ ID NO: 221258 - DNA, 224 bp, Homo sapiens; identical to SEQ ID NO: 221250
  misc_feature: GYAE6OF02IZUWO.21.74.G08.1.454.CMB.1.raw
  modified_base (223)..(224): a, c, t, g, unknown or other
  misc_feature (223)..(224): n is a, c, g, or t

SEQ ID NO: 221259 - DNA, 226 bp, Homo sapiens
  misc_feature: GYAE6OF02FSH7A.21.74.G08.1.454.CMB.1.raw
  modified_base (222)..(226): a, c, t, g, unknown or other
  misc_feature (222)..(226): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnn

SEQ ID NO: 221260 - DNA, 223 bp, Homo sapiens
  misc_feature: GYAE6OF02F4C7G.21.74.G08.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagn

SEQ ID NO: 221261 - DNA, 221 bp, Homo sapiens
  misc_feature: GYAE6OF02GIDDM.21.74.G08.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagtagctctatcagggggcagaccccaggtgctggccccggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagn

SEQ ID NO: 221262 - DNA, 234 bp, Homo sapiens
  misc_feature: GYAE6OF02HWHWJ.21.74.G08.1.454.CMB.1.raw
  modified_base (221)..(234): a, c, t, g, unknown or other
  misc_feature (221)..(234): n is a, c, g, or t
tcagtcgtcgctcgcacgaccggtgctcgatttagtagctctatcagggggcgagaccccaggtgctggccccggggttttggtctgagcctcagtcactgtgttatgtcttcgggaactgggaccaaggtcaccgtcctaggtcagcccaaggccaaccccactgtcactctgttcccgcctcctcctcgtctctactgagcggctggcaggcgcatagnnnnnnnnnnnnnn

SEQ ID NO: 221263 - DNA, 240 bp, Homo sapiens
  misc_feature: GYAE6OF02G5LY1.21.74.G08.1.454.CMB.1.raw
  modified_base (222)..(240): a, c, t, g, unknown or other
  misc_feature (222)..(240): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccactgtcactctgttcccaccctcctcctcgtctctactgagcggctggccaaggcgcatagnnnnnnnnnnnnnnnnnnn

SEQ ID NO: 221264 - DNA, 245 bp, Homo sapiens
  misc_feature: GYAE6OF02JLHSZ.21.74.G08.1.454.CMB.1.raw
  modified_base (230)..(231): a, c, t, g, unknown or other
  misc_feature (230)..(231): n is a, c, g, or t
  modified_base (233)..(242): a, c, t, g, unknown or other
  misc_feature (233)..(242): n is a, c, g, or t
  modified_base (244)..(245): a, c, t, g, unknown or other
  misc_feature (244)..(245): n is a, c, g, or t
tcagtcgtcgctcgcacgaccggtgctcgatttagtagctctatctaggggcagacccaggtgctgcccggggtttggtcgtggagcctcagtcactgtgttatgtcttcggaactggaccaaggtcaccgtctaggtcagtcccaaggcctaacccgactgtcaactctcgttacccgccctctcctcgtacctctactgagtcgggctggctaaggccgtcgatgacnnannnnnnnnnntnn

SEQ ID NO: 221265 - DNA, 226 bp, Homo sapiens
  misc_feature: GYAE6OF02GATTZ.21.74.G08.1.454.CMB.1.raw
  modified_base (223)..(226): a, c, t, g, unknown or other
  misc_feature (223)..(226): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctccgagcgacgactgagcgggctggcaaggcgcatagnnnn

SEQ ID NO: 221266 - DNA, 225 bp, Homo sapiens
  misc_feature: GYAE6OF02F0VLX.21.74.G08.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgctctactgagcgggctggcaaggcgcatagnnnn

SEQ ID NO: 221267 - DNA, 225 bp, Homo sapiens
  misc_feature: GYAE6OF02IAZS6.21.74.G08.1.454.CMB.1.raw
  modified_base (223)..(225): a, c, t, g, unknown or other
  misc_feature (223)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnn

SEQ ID NO: 221268 - DNA, 225 bp, Homo sapiens; identical to SEQ ID NO: 221267
  misc_feature: GYAE6OF02FL03U.21.74.G08.1.454.CMB.1.raw
  modified_base (223)..(225): a, c, t, g, unknown or other
  misc_feature (223)..(225): n is a, c, g, or t

SEQ ID NO: 221269 - DNA, 226 bp, Homo sapiens
  misc_feature: GYAE6OF02FR5R7.21.74.G08.1.454.CMB.1.raw
  modified_base (223)..(226): a, c, t, g, unknown or other
  misc_feature (223)..(226): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnn

SEQ ID NO: 221270 - DNA, 241 bp, Homo sapiens
  misc_feature: GYAE6OF02H7RW1.21.74.G08.1.454.CMB.1.raw
  modified_base (225)..(241): a, c, t, g, unknown or other
  misc_feature (225)..(241): n is a, c, g, or t
tcagtcgtcgctcgcacgaccggtgctcgatttagtagctctatcagggggcagaccccaggtgctggccccggggttttggtctgagcctcagtcactgtgttatgtcttcggaactcgggaccaaggtcaccgtcctaggtcagcccaaggcccaaaccccactgtcactctgttcccaccctcctcctcgtctctactgagcgggctggcaaggcgcatagnnnnnnnnnnnnnnnnn

SEQ ID NO: 221271 - DNA, 224 bp, Homo sapiens
  misc_feature: GYAE6OF02G2DHG.21.74.G08.1.454.CMB.1.raw
  modified_base (223)..(224): a, c, t, g, unknown or other
  misc_feature (223)..(224): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnn

SEQ ID NO: 221272 - DNA, 227 bp, Homo sapiens; identical to SEQ ID NO: 221196
  misc_feature: GYAE6OF02HWYGH.21.74.G08.1.454.CMB.1.raw
  modified_base (223)..(227): a, c, t, g, unknown or other
  misc_feature (223)..(227): n is a, c, g, or t

SEQ ID NO: 221273 - DNA, 232 bp, Homo sapiens
  misc_feature: GYAE6OF02I0K4B.21.74.G08.1.454.CMB.1.raw
  modified_base (142)..(142): a, c, t, g, unknown or other
  misc_feature (142)..(142): n is a, c, g, or t
  modified_base (180)..(180): a, c, t, g, unknown or other
  misc_feature (180)..(180): n is a, c, g, or t
  modified_base (220)..(232): a, c, t, g, unknown or other
  misc_feature (220)..(232): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtctagtcnaccgacgacgacccacctgtcactctcgttcctacccncctcctcgtctctactgagcggcgtgcgacgacgcatagnnnnnnnnnnnnn

SEQ ID NO: 221274 - DNA, 290 bp, Homo sapiens
  misc_feature: GYAE6OF02IZAQ9.21.74.G08.1.454.CMB.1.raw
  modified_base (230)..(230): a, c, t, g, unknown or other
  misc_feature (230)..(230): n is a, c, g, or t
  modified_base (232)..(290): a, c, t, g, unknown or other
  misc_feature (232)..(290): n is a, c, g, or t
tcagtcgtcgctcgcacgaccggtgctcgatttagtagctctatcagggggcagaccccaggtgctggccccgggggttttggtctgagtcctcagtcactgtgttatgtcttcggaactgggaccaaggtcaccgtcctaggtcagcccaaggccaaccccacttgtcactctgtttcccgccctcctcctcgtctctactgagcgggctggcaagggcggcagtagcngnnnnnnnnnnnnnnnnnnnnnnnnnnnnnnnnnnnnnnnnnnnnnnnnnnnnnnnnnnn

SEQ ID NO: 221275 - DNA, 228 bp, Homo sapiens
  misc_feature: GYAE6OF02HS0CE.21.74.G08.1.454.CMB.1.raw
  modified_base (224)..(228): a, c, t, g, unknown or other
  misc_feature (224)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaaccccactgtcactctgttcccaccctcctcctcgtctctactgagcgggctggcaaggcgcatagnnnnn

SEQ ID NO: 221276 - DNA, 223 bp, Homo sapiens; identical to SEQ ID NO: 221137
  misc_feature: GYAE6OF02FIZUF.21.74.G08.1.454.CMB.1.raw
  modified_base (221)..(223): a, c, t, g, unknown or other
  misc_feature (221)..(223): n is a, c, g, or t

SEQ ID NO: 221277 - DNA, 277 bp, Homo sapiens
  misc_feature: GYAE6OF02IDCOS.21.74.G08.1.454.CMB.1.raw
  modified_base (227)..(277): a, c, t, g, unknown or other
  misc_feature (227)..(277): n is a, c, g, or t
tcagtcgtcgctcgcacgaccggtgctcgatttagtagctctatcgagggggcagaccccaggtgctggccccgggggttttggtcgtgagcctcagtcactgtgttatgtcttcggaactgggacccaaggtcaccgtcctaggtcagcccaaggccaacccccatgtcacctctgttccccgccctcctcctcgtcctactgagcggctggcaaggtcgcatagnnnnnnnnnnnnnnnnnnnnnnnnnnnnnnnnnnnnnnnnnnnnnnnnnnn

SEQ ID NO: 221278 - DNA, 228 bp, Homo sapiens
  misc_feature: GYAE6OF02H74F5.21.74.G08.1.454.CMB.1.raw
  modified_base (223)..(228): a, c, t, g, unknown or other
  misc_feature (223)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnn

SEQ ID NO: 221279 - DNA, 228 bp, Homo sapiens
  misc_feature: GYAE6OF02IDSDV.21.74.G08.1.454.CMB.1.raw
  modified_base (220)..(220): a, c, t, g, unknown or other
  misc_feature (220)..(220): n is a, c, g, or t
  modified_base (226)..(228): a, c, t, g, unknown or other
  misc_feature (226)..(228): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggcccaaaccccactgtcactctgttccccgccctcctcctcgtctctactgagcgggctggcaaggcncaatgnnn

SEQ ID NO: 221280 - DNA, 227 bp, Homo sapiens; identical to SEQ ID NO: 221157
  misc_feature: GYAE6OF02GPLRE.21.74.G08.1.454.CMB.1.raw
  modified_base (223)..(227): a, c, t, g, unknown or other
  misc_feature (223)..(227): n is a, c, g, or t

SEQ ID NO: 221281 - DNA, 225 bp, Homo sapiens
  misc_feature: GYAE6OF02FTATJ.21.74.G08.1.454.CMB.1.raw
  modified_base (222)..(225): a, c, t, g, unknown or other
  misc_feature (222)..(225): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggctgccccctggtcactctgttcccgccctcctcctcgtctctactgagcgggctggcaaggcgcatagnnnn

SEQ ID NO: 221282 - DNA, 226 bp, Homo sapiens
  misc_feature: GYAE6OF02HSP5I.21.74.G08.1.454.CMB.1.raw
  modified_base (222)..(226): a, c, t, g, unknown or other
  misc_feature (222)..(226): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcggctggcaaggcgcatagnnnnn

SEQ ID NO: 221283 - DNA, 240 bp, Homo sapiens
  misc_feature: GYAE6OF02HANXK.21.74.G08.1.454.CMB.1.raw
  modified_base (226)..(240): a, c, t, g, unknown or other
  misc_feature (226)..(240): n is a, c, g, or t
tcagtcgtcgctcgcacgaccggtgctcgatttagtagctctatcagggggcgagaccccaggtgctggccccgggggttttggtctgagcctcagtcactgtgttatgtcttcggaactgggaccaaggtcaccgtcctaggtcagcccaaggccaaccccactgtcactctgttccccaccctcctcctcgtctctactgagcgggctggcaaggcgcaatagnnnnnnnnnnnnnnn

SEQ ID NO: 221284 - DNA, 225 bp, Homo sapiens
  misc_feature: GYAE6OF02IZENE.21.74.G08.1.454.CMB.1.raw
  modified_base (221)..(225): a, c, t, g, unknown or other
  misc_feature (221)..(225): n is a, c, g, or t
tcagtcgtcgctcgcacgaccggtgctcgatttagtagctctatcagggggcagacccaggtgctggccccgggggtttggtctgagcctcagtcactgtgttatgtcttcggaactgggaccaaggtcaccgtcctaggtcagcccaaggccaaccccactgtcactctgttcccgccctcctcctcgtctctactgagcgggctggcaaggcgcatagnnnnn

SEQ ID NO: 221285 - DNA, 224 bp, Homo sapiens; identical to SEQ ID NO: 221271
  misc_feature: GYAE6OF02FRLW3.21.74.G08.1.454.CMB.1.raw
  modified_base (223)..(224): a, c, t, g, unknown or other
  misc_feature (223)..(224): n is a, c, g, or t

SEQ ID NO: 221286 - DNA, 225 bp, Homo sapiens; identical to SEQ ID NO: 221203
  misc_feature: GYAE6OF02HD90L.21.74.G08.1.454.CMB.1.raw
  modified_base (223)..(225): a, c, t, g, unknown or other
  misc_feature (223)..(225): n is a, c, g, or t

SEQ ID NO: 221287 - DNA, 245 bp, Homo sapiens
  misc_feature: GYAE6OF02F3R1K.21.74.G08.1.454.CMB.1.raw
  modified_base (223)..(245): a, c, t, g, unknown or other
  misc_feature (223)..(245): n is a, c, g, or t
tcagtcgtcgctcgcacgaccggtgctcgatttagtagctctatcagggggcagaccccaggtgctggccccgggggttttggctgagcctcagtcactgtgttatgtcttcggaactgggaccaaggtcaccgtcctaggtcacgcccaaggcccaaccccatgtcactctgttccccaccctcctcctcgtctctactgagcggctggcaaggcgcatagnnnnnnnnnnnnnnnnnnnnnnn

SEQ ID NO: 221288 - DNA, 260 bp, Homo sapiens
  misc_feature: GYAE6OF02INZG3.21.74.G08.1.454.CMB.1.raw
  modified_base (219)..(219): a, c, t, g, unknown or other
  misc_feature (219)..(219): n is a, c, g, or t
  modified_base (225)..(260): a, c, t, g, unknown or other
  misc_feature (225)..(260): n is a, c, g, or t
tcagtcgtcgctcgcacgaccggtgctcgatttagtagctctatcagggggcagaccccaggtgctggccccgggggttttggtatgagcctcagtcactgtgttatgtcttcggaactgggaccaaggtcaccgtcctaggtcagcccaaggccaaaccccactgtcactctgttcccatccctcctcctcgtctctactgagcgggctggcaaggcncatagnnnnnnnnnnnnnnnnnnnnnnnnnnnnnnnnnnnn

SEQ ID NO: 221289 - DNA, 231 bp, Homo sapiens
  misc_feature: GYAE6OF02H1FTY.21.74.G08.1.454.CMB.1.raw
  modified_base (225)..(231): a, c, t, g, unknown or other
  misc_feature (225)..(231): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggcccaaaccccactgtcactctgttcccaccctcctcctcgtctctactgagcgggctggcaaggcgcatagnnnnnnn

SEQ ID NO: 221290 - DNA, 231 bp, Homo sapiens
  misc_feature: GYAE6OF02FWEQ7.21.74.G08.1.454.CMB.1.raw
  modified_base (224)..(231): a, c, t, g, unknown or other
  misc_feature (224)..(231): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagccgggctggcaaggcgcatagnnnnnnnn

SEQ ID NO: 221291 - DNA, 230 bp, Homo sapiens
  misc_feature: GYAE6OF02HEMIX.21.74.G08.1.454.CMB.1.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (224)..(230): a, c, t, g, unknown or other
  misc_feature (224)..(230): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgttccccaccctcctcctcgtctctactgagcgggctggcaaggcncanagnnnnnnn

SEQ ID NO: 221292 - DNA, 227 bp, Homo sapiens
  misc_feature: GYAE6OF02FN4ZO.21.74.G08.1.454.CMB.1.raw
  modified_base (222)..(227): a, c, t, g, unknown or other
  misc_feature (222)..(227): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccatgtcactctgttcccgccctcctcctcgtctctactgagcgggctggcaaggcgcatagnnnnnn

SEQ ID NO: 221293 - DNA, 228 bp, Homo sapiens
  misc_feature: GYAE6OF02G1VGX.21.74.G08.1.454.CMB.1.raw
  modified_base (223)..(228): a, c, t, g, unknown or other
  misc_feature (223)..(228): n is a, c, g, or t
tcagtcgtcgctcgcacgaccggtgctcgatttagtagctctatcagggggcataccccaggtgctggccccgggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcatagnnnnnn

SEQ ID NO: 221294 - DNA, 225 bp, Homo sapiens; identical to SEQ ID NO: 221203
  misc_feature: GYAE6OF02FJ9QM.21.74.G08.1.454.CMB.1.raw
  modified_base (223)..(225): a, c, t, g, unknown or other
  misc_feature (223)..(225): n is a, c, g, or t

SEQ ID NO: 221295 - DNA, 250 bp, Homo sapiens
  misc_feature: GYAE6OF02JKK45.21.74.G08.1.454.CMB.1.raw
  modified_base (163)..(163): a, c, t, g, unknown or other
  misc_feature (163)..(163): n is a, c, g, or t
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (227)..(231): a, c, t, g, unknown or other
  misc_feature (227)..(231): n is a, c, g, or t
  modified_base (233)..(233): a, c, t, g, unknown or other
  misc_feature (233)..(233): n is a, c, g, or t
  modified_base (235)..(236): a, c, t, g, unknown or other
  misc_feature (235)..(236): n is a, c, g, or t
  modified_base (238)..(239): a, c, t, g, unknown or other
  misc_feature (238)..(239): n is a, c, g, or t
  modified_base (242)..(242): a, c, t, g, unknown or other
  misc_feature (242)..(242): n is a, c, g, or t
  modified_base (246)..(250): a, c, t, g, unknown or other
  misc_feature (246)..(250): n is a, c, g, or t
tcagtcgtcgctcgcacgaccggtgctcgatttagtagctctatcagggggcagaccccaggtgctggccccggggtttgtctgagcctcagtcactgtgttatgtcttacggaactgggaccaaggtcaccgtcctaggtcgaccacggacgacccaccgtntcgactctgtcccaccctcctcctgtctctacctgaggccggctgcgaacgcgcactngntcannnnnancnnannctnatcnnnnn

SEQ ID NO: 221296 - DNA, 226 bp, Homo sapiens
  misc_feature: GYAE6OF02HD0PA.21.74.G08.1.454.CMB.1.raw
  modified_base (221)..(226): a, c, t, g, unknown or other
  misc_feature (221)..(226): n is a, c, g, or t
tcagtcgtcgctcgcacgaccggtgctcgatttagtagctctatcagggggcagaccccaggtgctggccccgggggttttggtctgagcctcagtcactgtgttatgtcttcggaactgggaccaaggtcaccgtcctaggtcagcccaaggccaaccccactgtcactctgtcccaccctcctcctcgtctctactgagcgggctggcaaggcgcatgnnnnnn

SEQ ID NO: 221297 - DNA, 232 bp, Homo sapiens
  misc_feature: GYAE6OF02HJRHN.21.74.G08.1.454.CMB.1.raw
  modified_base (219)..(232): a, c, t, g, unknown or other
  misc_feature (219)..(232): n is a, c, g, or t
tcagtcgtcgctcgcacgaccggtgctcgatttagtagctctatcagggggcagaccccaggtgctggccccggggttttgtctgagcctcagtcactgtgttatgtcttcggaactgggaccaaggtcaccgtcctaggtcagcccaaggccaaccccatgtcactctcgttcccaccctcctcctcgtctctactgagcggctggcaaggcgcatgnnnnnnnnnnnnnn

SEQ ID NO: 221298 - DNA, 347 bp, Homo sapiens
  misc_feature: GYAE6OF02IPFWD.21.74.G08.1.454.CMB.1.raw
  modified_base (161)..(161): a, c, t, g, unknown or other
  misc_feature (161)..(161): n is a, c, g, or t
  modified_base (245)..(246): a, c, t, g, unknown or other
  misc_feature (245)..(246): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (258)..(259): a, c, t, g, unknown or other
  misc_feature (258)..(259): n is a, c, g, or t
  modified_base (262)..(263): a, c, t, g, unknown or other
  misc_feature (262)..(263): n is a, c, g, or t
  modified_base (266)..(266): a, c, t, g, unknown or other
  misc_feature (266)..(266): n is a, c, g, or t
  modified_base (269)..(271): a, c, t, g, unknown or other
  misc_feature (269)..(271): n is a, c, g, or t
  modified_base (273)..(274): a, c, t, g, unknown or other
  misc_feature (273)..(274): n is a, c, g, or t
  modified_base (276)..(347): a, c, t, g, unknown or other
  misc_feature (276)..(347): n is a, c, g, or t
tcagtcgtcgctcgcacgaccggtgctcgatttagtagctctatcagggggcagaccccaggtgctggccccgggggttttggtctgagcctcagtcactgtgttatgtcttcggaatgggaccaaggtcaccgtcctaggtcagcccaaggccaaccccncaggtccactctgttcccccacccgtcctccggagccgaccgacttcgaggccgggactgggaccaagggccctagaactgggnntcgncnggaacnntanncgntgnnngnngnnnnnnnnnnnnnnnnnnnnnnnnnnnnnnnnnnnnnnnnnnnnnnnnnnnnnnnnnnnnnnnnnnnnnnnn

SEQ ID NO: 221299 - DNA, 239 bp, Homo sapiens
  misc_feature: GYAE6OF02JW74A.21.74.G08.1.454.CMB.1.raw
  modified_base (224)..(239): a, c, t, g, unknown or other
  misc_feature (224)..(239): n is a, c, g, or t
tcagtcgtcgctcgcacgaccggtgctcgatttagtagctctatcaggggcagaccccaggtgctggccccggggtttggtctgagcctcagtcactgtgttatgtcttcggaactgggaccaaggtcaccgtcctaggtcagcccaaggcccaaccccactgtcaactctgttccccaccctcctcctcgtctctactgagcgggctggcaaggtcgcatagnnnnnnnnnnnnnnnn

SEQ ID NO: 221300 - DNA, 241 bp, Homo sapiens
  misc_feature: GYAE6OF02I33B7.21.74.G08.1.454.CMB.1.raw
  modified_base (220)..(222): a, c, t, g, unknown or other
  misc_feature (220)..(222): n is a, c, g, or t
  modified_base (224)..(241): a, c, t, g, unknown or other
  misc_feature (224)..(241): n is a, c, g, or t
tcagtcgtcgctcgcacgaccggtgctcgatttagtagctctatcagggggcagaccccaggtgctggccccggggttttggtctgagcctcagtcactgtgttatgtcttcggaactgggaccaaggtcaccgtcctaggtcagcccaaggccaaccccatgtccactctgttcccaccctcctcctcgtctctactgagcggctggcaagcgcatagnnngnnnnnnnnnnnnnnnnnn

SEQ ID NO: 221301 - DNA, 290 bp, Homo sapiens
  misc_feature: GYAE6OF02JPUEX.21.74.G08.1.454.CMB.1.raw
  modified_base (197)..(197): a, c, t, g, unknown or other
  misc_feature (197)..(197): n is a, c, g, or t
  modified_base (239)..(242): a, c, t, g, unknown or other
  misc_feature (239)..(242): n is a, c, g, or t
  modified_base (245)..(247): a, c, t, g, unknown or other
  misc_feature (245)..(247): n is a, c, g, or t
  modified_base (250)..(250): a, c, t, g, unknown or other
  misc_feature (250)..(250): n is a, c, g, or t
  modified_base (252)..(290): a, c, t, g, unknown or other
  misc_feature (252)..(290): n is a, c, g, or t
tcagtcgtcgctcgcacgaccggtgctcgatttagtagctctatcaggggcagaccccaggtgctggccccgggggtttggtcgtgacgcctcagtcactgtgttatgtcttcggaactgggtaccaaggtcaccgtcctaggtcagcccaacggcccaaccccctatgtccaactctcgttccccgccctcctccncgtctctactgagtccgggctggcgaaggccgtacagtacgnnnntannnagnannnnnnnnnnnnnnnnnnnnnnnnnnnnnnnnnnnnnnn

SEQ ID NO: 221302 - DNA, 283 bp, Homo sapiens
  misc_feature: GYAE6OF02JEP66.21.74.G08.1.454.CMB.1.raw
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (231)..(235): a, c, t, g, unknown or other
  misc_feature (231)..(235): n is a, c, g, or t
  modified_base (239)..(283): a, c, t, g, unknown or other
  misc_feature (239)..(283): n is a, c, g, or t
tcagtcgtcgctcgcacgaccggtgctcgatttagtagctctatcagggggcagaccccaggtgctggccccggggggttttggtctgagcctcagtcactgtgttatgtcttcggaactgggaccaaggtcaccgtcctaggtcagcccaacggccaaccccatgtcactctcgttccccaccctcctcctcgtcctctacgngacgcggtcgtggacaggcncagtagnnnnnctgnnnnnnnnnnnnnnnnnnnnnnnnnnnnnnnnnnnnnnnnnnnnn

SEQ ID NO: 221303 - DNA, 245 bp, Homo sapiens
  misc_feature: GYAE6OF02JJJVS.21.74.G08.1.454.CMB.1.raw
  modified_base (217)..(217): a, c, t, g, unknown or other
  misc_feature (217)..(217): n is a, c, g, or t
  modified_base (222)..(245): a, c, t, g, unknown or other
  misc_feature (222)..(245): n is a, c, g, or t
tcagtcgtcgctcgcacgaccggtgctcgatttagtagctctatcagggggcagaccccaggtgctggccccgggggtttttggtctgagcctcagtcactgtgttatgtcttcggaactgggaccaggtcaccgtcctagtcagcccaaggcccaaccccactgtctactctcgttccccgcctctcctcgtctctactgagcggctgacgaggcncatgnnnnnnnnnnnnnnnnnnnnnnnn

SEQ ID NO: 221304 - DNA, 500 bp, Homo sapiens
  misc_feature: GYAE6OF01D6241.36.43.D10.1.454.CMB.1.raw
  modified_base (196)..(196): a, c, t, g, unknown or other
  misc_feature (196)..(196): n is a, c, g, or t
  modified_base (495)..(496): a, c, t, g, unknown or other
  misc_feature (495)..(496): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgattggcctggtaccagcagaaacctggccaggctcccaggctcctcatctatggtgcatccaccagggccactggtatcccaggccggttcagtggcagtgggtctgggacagagttcacgctcaccatcagcagcctgcagagtgaagatttcgactagtttattattgtcagcagtataataactgcctcggtctacgtttcggcggaggaccgaaggtggagatacaaacgactgtggctgcactatctgtcttnntccg

SEQ ID NO: 221305 - DNA, 518 bp, Homo sapiens
  misc_feature: GYAE6OF01AJBM3.36.43.D10.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaacctggccaggctcccaggctcctcatctatggtncatccaccagggccactggtactcccgaggccgttnagtggcaggtgggtctggggacagagttcacgctcaccatcagcagctgcagagtgagtatttcgctagtttattattgtcagctagtataataacgtggcctccggtctacgtttcggcggtagggaccaaggtggagagtacgaaacgtacgtgtcggctcgcacctatctgttcttcgtcttcccg

SEQ ID NO: 221306 - DNA, 510 bp, Homo sapiens
  misc_feature: GYAE6OF01EGQRR.36.43.D10.1.454.CMB.1.raw
  modified_base (196)..(196): a, c, t, g, unknown or other
  misc_feature (196)..(196): n is a, c, g, or t
  modified_base (505)..(505): a, c, t, g, unknown or other
  misc_feature (505)..(505): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgattggcctggtaccagcagaaacctggccaggctcccaggctcctcatctatggtgcatccaccagggccactggtactcccaggcccggttcagtggcaggtgggtctgggacagagttcacgctcacatcagcagcctgcagagtagaagtatttcgactagtttattattgtcagcagtataataactgcctccggtctacgtttcggcggagggaccgaaggtggagatacgaaacgaactggtggctgcactatctgtcttcnttccc

SEQ ID NO: 221307 - DNA, 512 bp, Homo sapiens
  misc_feature: GYAE6OF01BHJFH.36.43.D10.1.454.CMB.1.raw
  modified_base (196)..(196): a, c, t, g, unknown or other
  misc_feature (196)..(196): n is a, c, g, or t
  modified_base (506)..(506): a, c, t, g, unknown or other
  misc_feature (506)..(506): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctctcctgcagggccagtcagagtgttagtaccgacttggcctggtaccagcagaaacctggccaggctcccaggctcctcatctatggtgcatccaccgagggccactggtactcccgaggccggttcaggtggcaggtgggtctggggacagagttcacgctcaccatcagcagcctgcagagtgaagtatttcgctagtttattattgtcagctagtataataactggcctcggtctacgtttcggcggtagggacaagggtggagatacgaaacgactgtggctgcactatctgtcttcnttcccg

SEQ ID NO: 221308 - DNA, 502 bp, Homo sapiens
  misc_feature: GYAE6OF01E2H2Z.36.43.D10.1.454.CMB.1.raw
  modified_base (196)..(196): a, c, t, g, unknown or other
  misc_feature (196)..(196): n is a, c, g, or t
  modified_base (499)..(499): a, c, t, g, unknown or other
  misc_feature (499)..(499): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaaacctggccaggctcccaggctcctcatctatggtgcatccaccagggccactggtatccccaggccggttcagtggcagtgggtctggggacagagttcacgctcaccatcagcagcctgcagagtgaagtatttcgctagtttattattgtcagcagtataataactggcctcggtctactttcggcggagggaccaaggtggagatacaaacgactgtggctgcaccatctgtcttcntcc

SEQ ID NO: 221309 - DNA, 564 bp, Homo sapiens
  misc_feature: GYAE6OF01CEA45.36.43.D10.1.454.CMB.1.raw
  modified_base (198)..(198): a, c, t, g, unknown or other
  misc_feature (198)..(198): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctccgaggggaaangcccaccctctcctgcagggccagtcagagtgttagtaccgattggcctggtaccagcagaacctggccaggctcccaggctcctcatctatggtgcatccaccgagggcccactggtactccccgaggcccggttcaggtcggctaggtgggtctggggacaggagttcacgctcaccatcagcagcctgcagagtgaagtatttcgctagttttattattgtcagctaagtattaaataacgtggacccttccggtactaccgtttcgggaccgggtagggaccaagggtggaagtacgtaccgaaaacggtacgttggtagggctaggcctaaccgtattcgtagttccttcgtcgttccccg

SEQ ID NO: 221310 - DNA, 572 bp, Homo sapiens
  misc_feature: GYAE6OF01CU8GK.36.43.D10.1.454.CMB.1.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaaacctggccaggctcccaggcctcctcatctatggtncatccaccagggcccactggtatccccgaggcccggttcaggtggcagtggggtctggggacagagttcacgtctcaccatcagcagcctgcagagtgaagtatttcgactagttttattatttgtacagctaagttataaagttaactcgggtacccttccgggttactaccgttttcgggcgggtaacgggtaccaaggggtcggaacgtagtacaaaacggtaacttggtacgggctagtaccaacctattccttagttccttcgatttccccg

SEQ ID NO: 221311 - DNA, 500 bp, Homo sapiens
  misc_feature: GYAE6OF01AC8F0.36.43.D10.1.454.CMB.1.raw
  modified_base (496)..(496): a, c, t, g, unknown or other
  misc_feature (496)..(496): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaagagccaccctctcctgcagggccagtcagagtgttagtaccgacttggcctggtaccagcagaaacctggccaggctcccaggctcctcatctatggtgcatccaccagggccactggtatcccaggccggttcagtggcagtgggtctgggacagagttcacgctcaccatcagcagcctgcagagtgaagatttcgctagtttattattgtcagcagtataataactggcctcggtctacgtttcggcggaggaccaaggtgagatacgaaacgactggtggctgcacatctgtcttcntccc

SEQ ID NO: 221312 - DNA, 546 bp, Homo sapiens
  misc_feature: GYAE6OF01A1OX0.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctctcctgcagggccagtcagagtgttagtaccgattggcctggtaccagcagaaacctggccaggctcccaggctcctcatctatggtgcatccaccagggccacgtcggtactccccagggtcccggttcagtcggcagtggggtctggggacaggacgttcacgctcacatcagcagcctgcagagtgaagtatttcgctagtttattattgtcagtctagttataataactggtcccttccggtctacgtttcggcggtacgggaccaagggtgagtatacgaaacgtacgtaggtcggcttacgacctaccgtagttcgtagttccttactcgttcccg

SEQ ID NO: 221313 - DNA, 541 bp, Homo sapiens
  misc_feature: GYAE6OF01CMMPX.36.43.D10.1.454.CMB.1.raw
  modified_base (196)..(196): a, c, t, g, unknown or other
  misc_feature (196)..(196): n is a, c, g, or t
  modified_base (499)..(499): a, c, t, g, unknown or other
  misc_feature (499)..(499): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanacgccaccctctcctgcagggccagtcagagtgttagtaccgacttggcctggtaccagcagaactggccaggctcccaggctctcatctatgatacatcctacagggccactggcatccccagccaggttcagtggcaggtgggtctgggacaggacttcactctacacctatcagcagcctagacctagaagtatttgctagtttatactagtcagcagcgagtacggtctttaccgggcccgtagggaacctaaaggttcggatactacgaaacgtacgtggtggactcgactaaccgtnttccgttggttccttacacttccctttccccgcctattaccg

SEQ ID NO: 221314 - DNA, 664 bp, Homo sapiens
  misc_feature: GYAE6OF01ESXP6.36.43.D10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaancgccaccctctcctgcagggccagtcagagtgttagaccgattggcctggtaccagcagaaacctggccaggctccaggctctcatctatggtncatccacgagggccatggtactcccgaggccggttnaggtcggcaggtgggtctggggacaggtacgttccacgttctccaaccgtatcgaagtccagcccgtgaccagttcctaggtaacgttagttttagacttaaggttttattaaccgttacgtaacctaaactaggttaaactaattcggtaacctcgggtacccttaccgttaccgttaacccggttttcggggaccggggtaacggggtaacccgtaaaggggtacggtaacggtaacgtaaccgtaaaacggtaaccgttagggtacgggtaccgtacggtacccgtaacccgtacgttaccgttacgttaccctttccgtaacgtttcccccgg

SEQ ID NO: 221315 - DNA, 513 bp, Homo sapiens
  misc_feature: GYAE6OF01EWEWV.36.43.D10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctntcctgcagggccagtcagagtgttagaccgacttggcctggtaccagcagaaacctggccaggctcccaggctcctcatctatggtgcatccacagggccacgtggtactcccgaggtcccggttcaggtcggctaggtgggtctggggacaggngttcacgctcaccatcagcagcctgcagagtagaagatttcggctagtttattattgtcagctatataatactgcctccgtntacttcggnggaggacctaaggtggatagacaaacgtagtgaggctgacacctatctagtcttcattcccg

SEQ ID NO: 221316 - DNA, 661 bp, Homo sapiens
  misc_feature: GYAE6OF01D22NB.36.43.D10.1.454.CMB.1.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (432)..(432): a, c, t, g, unknown or other
  misc_feature (432)..(432): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctccgaggggaaancgccaccctctcctgcgagggccagtcagagtgttacgtaccgacttggcctaggtaccagcaacggaaacctggacccaggcctcccgaggcctcctcattctagtggtcncctactccccaaccgacgggccctaacgtcgggtacctccccggaggggtcccgtttgacgggtggacgtagggttcgggtacgtaggggactagggtacgttccgaactccgtaccaaccntcgacgcacgtccctggacaggtacgtagtaagtactttcggatttacggttttattgttgtacacgttcaggttacttacgtagttccggtaccctcgtacgttccgtacggtttcggacgggtagggtaccaggggtacgacgtaacgtaaccgtaaacggtagttcgggcgacgttaccggaccttaacccgttacgttaccttcggtttcccttacgttaccccg

SEQ ID NO: 221317 - DNA, 648 bp, Homo sapiens
  misc_feature: GYAE6OF01BFIPI.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccacctctcctgcagggccagtcagagtgttagtaccgacttgggcctggtaccagcagaacctggccaggctccaggctcctcatctatggtgcatccacagggccacgtggtactcccgaggtcccggttcaggtcggcgaggttggggtctggggactaggacgtttcacgtctacaccctatccagccagtcccgtgccgaaggtacggtagtaacgtagtttcgacttaaggtttttatttagtttggtacctaaggtcctaaggttaacttaaattaacgttcgggtacccttccgggttaccttacggttttccgggaccgggtaacggggtaccctaaaggggttcgggaagtaaccgtaacggaaaaccggtaacgttgggtacggtccgtacggtacccgtaaccgtacgttcgttacgtttcccttctaacgtttccccg

SEQ ID NO: 221318 - DNA, 653 bp, Homo sapiens
  misc_feature: GYAE6OF01CLYS9.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctccgaaggggaaagacgcccaccctctcctgcagggccagtcagtagtgttagaccgtattggcctggtaccagcaacgaacctggaccaggcctacccgaggcctcctcatctagtggtcacctactcccaaccgacgggccctacgtcggtacctcccgagggtcccggttcaggtcggctaggtcgggtcgtaggggactaggtacgttccacggtctaccgaccagtcacgcacgtcctgacgaagtaggtagaagttacgtttcggacgtttaagtttttagttaacgttcgtaccgaagtacctaagttaaattaaacgttaaccgtcggtacccgttccggtaccttacggtttcgggacgggtaacgggtaccgaaggggttcgaacgtacgtaaccgaaacggtacgtggtacggtcgtacgaaccctactacttcttacgtaccttacgtcttccccg

SEQ ID NO: 221319 - DNA, 568 bp, Homo sapiens
  misc_feature: GYAE6OF01CPKW2.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaagagccaccctctcctgcagggccagtcagagtgttagtaccgacttggcctggtaccagcagaaacctggccaggctcccaggctcctcatctatggtgcatccaccagggccactggtatccccaggccggttcagtggcagtgggtctggggacaggagttcacgctcaccatcagcagcctgcaggagtggaaagtagtttcgactagttttaattattgtacagctaagtataataacgtgccttcggtctacgtttcggacggtacgggaccgtaaggtcgggaatagtaccgaaaaccgtaacggttggtagggtcctacgaccgtaaccgtaacttccgttggttaccttccgtacgtttcccccg

SEQ ID NO: 221320 - DNA, 557 bp, Homo sapiens
  misc_feature: GYAE6OF01CM6C7.36.43.D10.1.454.CMB.1.raw
  modified_base (197)..(197): a, c, t, g, unknown or other
  misc_feature (197)..(197): n is a, c, g, or t
  modified_base (400)..(400): a, c, t, g, unknown or other
  misc_feature (400)..(400): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaangcccaccctctcctgcagggccagtcagagtgttagtaccgcttggcctggtaccagcagaacctggccaggctcccaggcctcctcatctatggtgcatcccaccgagggccacgtggtactccccgagggtcccggttcaggtggcaggtgggtctggggacagagttcacgctcacatcagcagcctgcagagtgaagtnttcgctagtttattattgtctagtctagtataatacgtggtcctccggtactacgtttcgggacggtacgggaccgtaagggtggaggtactacgaaaacggtacgtggtacggtcgtagacctaccgtagttcgttgttccttcgtcgtttccccg

SEQ ID NO: 221321 - DNA, 667 bp, Homo sapiens
  misc_feature: GYAE6OF01A2LNZ.36.43.D10.1.454.CMB.1.raw
  modified_base (227)..(227): a, c, t, g, unknown or other
  misc_feature (227)..(227): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagtacgctgtctcacgaccggtgctcgattttagactagcagtaagggggtagggtaacgtcgactaccagttaggaccccagacggaaccaatccggaagccccagcgacagcttcctcttccgtcctggccttacgtcgtggccttcccttaggatatcactggacgaaataggtgactgaccgcagtctccaggcaccctgtctgtggtctcgaggggaaanagaccacctcgtcctgcaggggcctagtcagagtgttagaccgattggccttggtaccagccaagaacctggacctaggcttcccgaggcctcctacgacgtctagtggtgctagtccacgagggccactggtactccgaggtcccgttnaggtcgacagtggtctggacagtagttcagcncactancagtcagcctagcagacgtanaacgtctttaccgacttaagtttacgttccagaccctaggtacttaacgtaacttaactttacgtcggtacccttacgggttaccgggttcggttaccgttaccgggtaaccgtaaacgggtaccgtaacggggtacggtaaaacgtaaccgggaaaaccggggtacttagggtacggtacctaggtaacctaaccgtattaccgttagttacccttgtaacgttccccgg

SEQ ID NO: 221322 - DNA, 693 bp, Homo sapiens
  misc_feature: GYAE6OF01CVJYZ.36.43.D10.1.454.CMB.1.raw
  modified_base (198)..(198): a, c, t, g, unknown or other
  misc_feature (198)..(198): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggaagaaatagtgatgacgcagtctccaggcaccctgtctgtgtctccgaggggaaanacgcccaccctctcctgcgacgggccagtcagtagttgttacgtaccgacttcggacctggtacccagccgaacgaacccgtcggaccgacggcctacccgaggccctcctcgtatccgttagtggtcgcctactcccgaccgacgggccaacgttcgggtaactcccggtaggtcccggttcacgggtggaccgtggttcggggtcgtaggggactaggtaacgttccgaccgtacctccgaacacttacgacgccgacgccgtagccgaaggtagtacggtaaagtttcgttacgacgttaagttttacttagttcgtacagtcgttaaagttaagtaaacgttacgtaccggttcccgttaccggttaccttaccggtttaccggggacgggtaaccgggtaccggtaagggtacggtaagtaccgtaaccgaaacggttacgtgggtacgcgtacggccaacttcgtacttacggttctcgtccttccccg

SEQ ID NO: 221323 - DNA, 629 bp, Homo sapiens
  misc_feature: GYAE6OF01AC2B9.36.43.D10.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaancgccaccctctcctgcagggccagtcagagtgttacgtaccgattggcctggtaccagcagaacctggccaggcctcccgaggcctcctcatctagtggtcncactcccaccgagggcccacgtcggtaactccccgagggtcccggtttacgaggttcggcgtagggttcggggtcgtagggggactaggtacgttccacggtctaccgaccatcgagccacgcctgacgagagtagaacgtagtttcgagttagtttattagttgtacagtactaaggttaattaacgtaacgtcggtacccgttccggtacgttaccggtttcgggacgggtaacgggtaccgtaagggtacggagtaacgtacgaaaccggtacgtggtacggtccgtacgacctaccgtacttacgttcgttccttcgtcgttcccg

SEQ ID NO: 221324 - DNA, 693 bp, Homo sapiens
  misc_feature: GYAE6OF01CY5WX.36.43.D10.1.454.CMB.1.raw
  modified_base (255)..(255): a, c, t, g, unknown or other
  misc_feature (255)..(255): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaagagccaccctctcctgcagggccagtcagagtgttagtcaaaacttgcctggtatacaanaaaagctggccaaggcctcccaggctcctcatctatgatgcttaccaaaagggcccctggcactcccaaccaggttcagtcgcagtggtctgggacagacttcactctcaccatcagcagcctaagacgcctagaacgtattttagaccttaattttacttactacgttaccaaactacggtacccgttaacccgtaaaccgttcgggaacccgggtaccgggttttaccgggaaccccggttaaaccggggaaacccgggtaaacggggttacccgggaaacgggttaacccggtaaaaccgggtaaaccgttacgggttacgggacccgttacggaccctaaccccgtaaggttcccgtttacggttacccctttagtaacctttccccgtttacccccggtacccttaaccgttacccgttaggtaaaacccggg

SEQ ID NO: 221325 - DNA, 555 bp, Homo sapiens
  misc_feature: GYAE6OF01BPISI.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctctcctgcagggccagtcagagtgttagtaccgacttggcctggtaccagcagaacctggccaggcctccaggctcctcatctatggtgcactccacgagggccacgtggtactcccgaggtccggttcaggtcggcaggtgggtctgggacagagttcacgctcacatcagcacgctgcagagtagaagtagtttcgacttagttttattagttgtctagtactagttaataacgtaacgtggtacccttcggtactacgtttcgggacggtacgggtacgaagggtggagtactaccgtaaagacgtggtacggcctggaccactactcgttagttcttcctgttccccg

SEQ ID NO: 221326 - DNA, 787 bp, Homo sapiens
  misc_feature: GYAE6OF01DTZHK.36.43.D10.1.454.CMB.1.raw
  modified_base (197)..(197): a, c, t, g, unknown or other
  misc_feature (197)..(197): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaanagcccaccctctcctgcagggccagtcagagtgttagtaccgacttggcctggtaccagcagaaacctggccaggctcccaggctcctcatctatggtgcatccaccgagggcccacgtcggtactcccgacgggtcccggttacacggttcggcctagggttcggggttcgtagggggaccaggtacggtttccaacggtccttaccgaacccattccgacggaccaacggccccgttaggacccgtaaggggaacggttagggtaaaacggttacgttttttacccgggaacgttttaaagggtttttttaacttttaagtttttacgggttaaccgtaaggtaacccgttaaaggttttaaacttaaaagtttaaaccgttccggggtacccctttaccccggggtttacccttaccgggtttttaccgggggacccggggtaacgggggtaaccccggtaaagggggttacgggaaggtaaaccgttaaccgaaaaaccgggtaacgttaggggtacgggtcccgttacggtaccctaacccgtaacgtttacccgttaggtttaccctttcacgttttacccccg

SEQ ID NO: 221327 - DNA, 641 bp, Homo sapiens
  misc_feature: GYAE6OF01B9ZFX.36.43.D10.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctccgaaggggaaanagcccaccctctcctgcgagggccagtcagagtgttacgtaccgacttggcctggtaccagcaagaacctggccaggcctcccaggtcctcctcatctagtggtncactccgaccgagggccacgtcggtactcccgagggtccgtcagtgcaggtggtctagggacagtcgttcacgtctaccactatcagcagcctgacagagtagaagtatttcgagttagtttattgttagtcgagtcgtaagttaagtaactaacgtcggtacccgttccggtacttaccggtttcgggaccgggtaacgggaccgtaaagggtcggaacgtaacgtaaacccggtaaaacggtaaccgttagggttacgggtcccgttacggtaccccgtaacccgttaacgtttccgtttaccggttacccttttaccgtcccgtttaccccccg

SEQ ID NO: 221328 - DNA, 846 bp, Homo sapiens
  misc_feature: GYAE6OF01ED3FZ.36.43.D10.1.454.CMB.1.raw
  modified_base (213)..(213): a, c, t, g, unknown or other
  misc_feature (213)..(213): n is a, c, g, or t
tcagtacgctgtctcacgaccggtgctcgatttagactagcagtaagggggaaggaactgacgtacaagttacgacccagacggaaccatcggaagccccagcgcagcttctcttcctcgtgccttactctggctcccagtatatccacgtggagaactagtcgatcgacgtcagtctccgaggcacctgtctgtcgtctaccgaggggaacncgcccacccgtcgtccgtggccgacgggccaggttcgaggtacgttcgttaacgtaccgtagtttcgggcccgttaggtaaccgagtaccgtaaacgtaaacccgtcgggtacccgaacgggtcccttacccggagggtcccttacctacgaacgttccggttaggtcgggttacgcctaacgtcccggaaccggacggggacctacgggtaggtacctacccgggtaccgggttacccggtttacgaggttcgggacgtacgggtttcggggtacgtaacggggtaactacggtacggtttacccgaaccggtctaaacccgacccgtagtacccgacggaccgtaccggtccttacggaccgtaaggtaacggttaacggtaaacgttaccgtttaccggaacgtttaacggttttaacgtttacggttttcgtaccgtacgtacgttaacggttaaacttaaacgttaccggtcggtacccgttaccggttacgttaccggtttaccgggacgggtaacgggaaccggttaacgggtagtacggtaacgttaaccggtaaacggttacgtgggtacggtacgtcgggaacctacgtcgttaaccgtgtttacgttccgtcggttaccccg

SEQ ID NO: 221329 - DNA, 608 bp, Homo sapiens
  misc_feature: GYAE6OF01EU8Y1.36.43.D10.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (412)..(412): a, c, t, g, unknown or other
  misc_feature (412)..(412): n is a, c, g, or t
tcagtacgctgtctcacgaccggtgctcgatttagactagcagtaagggggaggaactgctcagctaggacccagacggaaccatggaagccccagcgcagcttctcttcctcctgctactctggctcccagatatcactggagaaatagtgatgacgcagtctccaggcaccctgtctgtgtctccgaaggggaaancgccaccctntcctgcagggccagtcagtagtgttacgtaccgacttggcctggtaccagcaagaaacctggccaggcctccgaggcctcctcatctatggtgcagtcccaccgagggccctacgtcggtatccccgaggtccggttacaggtggcgtaggtcgggtcgtgggaactaggtacgttccaacttcacaaccatccagcacgtccngctagtacgtagtaagttatttgacttagtttacttacgtagtactaactagttaaccaagtcgtacgtcgtacccttcgtacgtaccgtttcgggacgggacggtaaccggtaaggtggtaacgtaacgtaaccgtaaaacggttaacgtggtcggtacgtacgaccgtacctacttcgtcttccttcgtacccg

SEQ ID NO: 221330 - DNA, 811 bp, Homo sapiens
  misc_feature: GYAE6OF01C0GSX.36.43.D10.1.454.CMB.1.raw
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtcnccaggccacctgtctgtcgtctcgaggggaanacgcccacctctctgcgagggccagtcaaggtagttagttacggtaccgtacgtttcgggacccttggggtaaccaggtaccgaaacggtaaaacccgtcgggaccccgacggtacccttaccccgaagggtcccttacccctacgtaacttccgtaagttcgggtacgtactaccttacccgaaccggtaccggggaccctacgtacgggttaccctaccccggaacgggtcccggttacgacggtcgggtacgtacggtttcgggggtcgttaggggacgtaaggtacggttaccacggtactaccaacgtatacgaacgccgtacggtccgtcgacgtaacggtacggtaagtaacgttacgtttacggtaacgtttaaggtttttaactttagtttagtacgtaacgtacgtaaagtttaacgttaaattaaccgggtcgttacccggttacccgggttacttaaccgggtttacgggaccgggtaaccgggaccggtaagggtaacggtaacgtaccgtaaacggaaaccggttaacggtggtaccggtacgtaccgaaccgttaaccgtacgtttacgttagttacccgttcgtacccgtttaccccgg

SEQ ID NO: 221331 - DNA, 602 bp, Homo sapiens
  misc_feature: GYAE6OF01BFQEE.36.43.D10.1.454.CMB.1.raw
  modified_base (199)..(199): a, c, t, g, unknown or other
  misc_feature (199)..(199): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaaggggaaacngcccaccctctcctgcagggccagtcagagtgttagtaccgattggcctggtaccagcagaaacctggccaggctccaggctcctcatctatggtgcatccacgagggccacgtggtactcccgagggtccgttcaggtcggcgtaggtgggtctggggaccaggtacgtttcgacgtcctaccaccgtatccgaagtcacgcctagcgaagtagtagtaagtacgtttcgacttaagttttattattggtctagtactaagttaataacgtaacgtcggtaccgttccggtactacgtttccgggagggtaacggaccgtaaggtcggaagtacgtacgaaaccggtacgtgtacggtactcggaccacgtacttccgtagttccttcgtacgtttaccccg

SEQ ID NO: 221332 - DNA, 811 bp, Homo sapiens
  misc_feature: GYAE6OF01B34BL.36.43.D10.1.454.CMB.1.raw
  modified_base (197)..(197): a, c, t, g, unknown or other
  misc_feature (197)..(197): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatgtgatgacgcagtctccaggcaccctgtctgtctctaccgaggggaaanacgccaccctctcctgcagggccagtcagtagtggttacgtaccgtacttcggcctggtaccagccaaggaaacctcggacccaggcctcccgaggtcctccgtcattccgtagtcggtcgaccacgtacccgacggaccgggtacctacggtcggtaccgtcccgtagggtcccggtttacagggttcggacgttaggttcggggtacggtcgggaactagggtacgttccaaccggtctacccgaactagtaccgagtccgaaccggtcccgtaggaccgtaaggggtacgttaacggtaaacggtttacgttttacccggaacgtttttaacgggtttttaaccgttacgttaaccgggtaaaccctaaaacggtttacggttaaacgtaaccggtttaacgggttaacccgttcggggttacccctttaaccgggttacccggttttacccgggtccggggggtaaaccgggtacggggtaaacccgttaagggggtacgggtaaagtaacccgttaaccggaaaaacggtccgtttgggtaaccggtccgtaccgtaaccgacccgtttagttacccgtttccgttactttacccgtcgtttacccccg

SEQ ID NO: 221333 - DNA, 698 bp, Homo sapiens
  misc_feature: GYAE6OF01BK1O7.36.43.D10.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaangtcaccctntcctgcagggccagtcagtagtgttacgtaccgattggccttggtaccagcaagaacctggccaggcctcccgaggcctcctcatctagtggtgctatccacgagggcccacgtggtactcccgagggtcccggtttcaggttcggcgtaggttcgggtcgtagggggacagggtacgtttccgaaccgtccttaccgaacctacgttaccgaacggtccgtacggacccgttggaccgtaaggtacggttaggtaaacgttacgttttcggaccgtttaaggttttactttagtttacgtacgtaaggtacgtaagttaacttaaacgttaaccgtcgggtacccgttccgggttaccgttaccggtttcgggacgggtaacgggaccgtaagggtacgggaagtaccgtaaccgtaaacggtaccgttaggacggtccgtacggtaccgtaccgtacgttccgttagttaccgttaccgtcgttaccccg

SEQ ID NO: 221334 - DNA, 650 bp, Homo sapiens
  misc_feature: GYAE6OF01EJ74L.36.43.D10.1.454.CMB.1.raw
  modified_base (193)..(193): a, c, t, g, unknown or other
  misc_feature (193)..(193): n is a, c, g, or t
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctccagatatcactggagaaatagtgatgacgcagtctccaggcacctgtctgtgtctcgaggggaanacgccaccctctcctgcacgggccagtcagagtcgttacgtaccgacgttcggcctaggtaccagcaacgaaaccgtggcccaggcctacccgaggcctcctcagtctagtggtcncactccgaacgcgggccacgtggtaccnccgacgggtccgtttagaggtcggacgtagggtcgggtacgtaggggaccaggtacgttccgacgtctaccaccctaatcgaacgccgacgtccgtaggaccgaaggtaggttaacgtaacgttaacgtttcgtacgtttaagtttttacttagtttcgtacgtacgtactaagttaattaacgtacgtcggtaccttccggtcttacggtttcgggacggtacggtaacgagggtaggacgtacgtaacgtaaacggtacgtaggtacggctacggacctaccgtattcgttagttccttcgtcgttccccg

SEQ ID NO: 221335 - DNA, 641 bp, Homo sapiens
  misc_feature: GYAE6OF01BVQ62.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatgtgatgacgcagtctccaggcaccctgtctgtgtctccgaggggaaacgacgcccaccctctcctgcgacgggccagtcagagtcgttagtccgacttcggcctaggtaccagcaacgaacctggccaggcctcccaggcctcctcatcgtagtggtcaccactcccgaccgaggccaccgtggtacctcccgacggtccggttcgaggtcgcgtaggtcgggtctgggaacagtacgtcgacgctccacgatacacgcacgcccgtagccgaggacgtaggtaagttactttaccgacttagttttatttatcgtactagtactaagttaacttaacgtaacgtcggtaccgttcccggtaccttaccgggtttacgggacgggttaagggacccgtagggtacgaaacgtcgtaaaccgaacgtaacggttggtcggtacgtacgtacccaccgttacgtacctttacgtcctttcgaaccgtttcccccg

SEQ ID NO: 221336 - DNA, 749 bp, Homo sapiens
  misc_feature: GYAE6OF01EP9US.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaagacgccaccctctcctgcgacgggccagtcagtagtgttacgtaccgattggcctggtaccagcaagaaacctggccaggcctccaggcctcctcactctagtggtcgcactcccaccgacgggcctacgtcggtactcccgagggtccgttcgaggtcggcgtaggttcggggtctacgggggactaggtacgttaccgaccggtccttacccgaacctagtccgtaaggtccgtaacggtttccgacggtaccgtaagggtaaggttaaggtaaaacggtttacgttttaccgggtaacgtttaaaggttttttaatttaacggtttcggtaccgtaacggtaccgttaaggttttaaacttaacgtttaaaccggttccgggtaccccggttttaccgggtacctttaacccgggttttccggggaccgggtaacggggtaacccgtaaggggttacggaaacgtacgtaacggaaaacggtacgtagggttacggaccttacggaccgtaaccttacgttacgttacgttacctttccacgtttccccgg

SEQ ID NO: 221337 - DNA, 762 bp, Homo sapiens
  misc_feature: GYAE6OF01DEJOW.36.43.D10.1.454.CMB.1.raw
tcagtacgctgtctcacgaccggtgctcgatttagactagcagtaagggggaggaactgctcagttaggacccagacggaaccatggaagcccagcgcagcttctcttcctcctgctactctggctcccagatatcactggaagaaatagtgatgacgcagtctccaggcaccctgtctgtgtctaccgaggggaagacgccctaccctctcctgcgacgggccagtcagtagttgtacgtaccgacgttcggcctggtaccagacgaacgaaccgtcggccacggccctcccgaggtcctccgtactacttccgtagtcgggtcacctacctacccgaccggacgggccctaacgttcgggtacctccccggaagggtcccggttacgtacgggtcggacgtacgggttcggggtcgtacggggactacggtacgttccgacgttcctaccgaacctagtaccgacgacgacggtccctggaccgtaagggtaagtacggtaaagtttccgttttacggtaacctttaaggttttttaacgttagtttaccggtacgtacgggttaacgttaaacgtttaaacttaaaccgtttaaccggttccggggttaccccgtttacccgggttaacttccggggtttacggggacggggttaacggtaccggtaagggtacgaacgtaacgtaaccggtaaacggtacgttggtacggtctaccgaccgttaacgtctttacgtcgtttacctcgtccgttccccg

SEQ ID NO: 221338 - DNA, 740 bp, Homo sapiens
  misc_feature: GYAE6OF01EXE7R.36.43.D10.1.454.CMB.1.raw
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
  modified_base (308)..(308): a, c, t, g, unknown or other
  misc_feature (308)..(308): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactgganaaatagtgatgacgcagtctccaggcaccctgtctgtgtctcgagggaacncgcccaccctctcctgcgacgggccagtcagtagtcgttaacgtaccgacttggacctggtaccagacacgaacctggccaggcctcccgagtcctcctcatctagtggtacncctactacccgaccgacgggacctacgttacgggtacctccccggtacgggtcccggttacgagggttcggaccgtagggttcgggtacggtagggaccgaggtaccgtttaccgacgtccttacccaaccgtactaccgaacgtcgtacccgtaccgtacggtacccgaaggtacgggttaacggtaacgtttacgtttaccgtaggttttaacgttttagtttagtttacggtaccaagttacgtaacgttaaactaaagttacccggtaacggttccccgttaccgggttaccgtttacccggttacggggaacccgggtaacgggaccggttaagggtacggaagtaaccgtaacggtaaacgtcggttaggtaccgtaccgtgtacccgtacgtacgttgttaccgtttcttcctcgtttacccccg

SEQ ID NO: 221339 - DNA, 598 bp, Homo sapiens
  misc_feature: GYAE6OF01BRM2I.36.43.D10.1.454.CMB.1.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
  modified_base (590)..(590): a, c, t, g, unknown or other
  misc_feature (590)..(590): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaangccaccctctcctgcagggccagtcagagttgttacgtaccgacttggcctggtaccagcaagaaacctggaccaggcctcccgaggcctcctcatctagtggtcgcactcccaccgacgggcctacgtcggtactcccgaggtcccggttanaggttcggcgtaggtcgggtcgtaggggacaggtacgttcacgtctacacctatcagccacgtccgtgaccaggagtagaagtatttcgattagtttattagttgtacagtactaagttaataagtacgtcggaccttcggtacgtacgtttcgggacggtagggacctaagggtcggaagtactaacgaaacgtacgttggacggcgtcgacctaccgtattcgttacgttcttaccgtnttaccccg

SEQ ID NO: 221340 - DNA, 713 bp, Homo sapiens
  misc_feature: GYAE6OF01B3DZL.36.43.D10.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
tcagtacgctgtctcacgaccggtgctcgatttagactagcagtaaggggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaancgcccaccctctcctgcagggccagtcagagtgttacgaccgtacttggcctggtacccagcaagaacctggccaggcctccgaggcctcctcactctagtggtncactcccaccgacgggccacgtggtactcccgacgggtccggttacgaggtcggacgaggttcggggtcgtacggggactaggtacgttccgaacgtcctaccacctatccgagccacgtccgtagacgtaaggacgttaggtaaagttacgttttaccggtaacgtttaacgtttttaagtttacgtttcggttacgtaacgtaccgttaaagtttaacgttaaacgttaacggttccggtaccccgtttaccgggttacccgttaaccgggttttcggggaaccggggtaaccgggtaaccggtaacggggtacggtaacgtaacgttaaaccggaaaacggtaccggtagggtacggtccgtacgtacccaccgtacgttcttacgttccttacgtccgtttacccg

SEQ ID NO: 221341 - DNA, 678 bp, Homo sapiens
  misc_feature: GYAE6OF01B1AM4.36.43.D10.1.454.CMB.1.raw
  modified_base (292)..(292): a, c, t, g, unknown or other
  misc_feature (292)..(292): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaagcgccaccctctcctgcaggggccagtcagagtgttagtaccgattggcctggtaccagcaagaaacctcggccaggcctccaggcctcctcatctntggtgcactcccaccgaggggccctacgtcggtactcccgaggtccggttcgagtcggcgtaggtcgggtctggggactaggtacgttcacgctcgaacctatcacgcacggtcccgtgacgaaggtagtacggaaagttacgtttcggacttacggtttttaatttacgtttacggtacgtaacggacgttaaacggtaatttaaacgtaacgttccggtaccctttccgggtaccttaccggttttccggggacgggtaacggggtaaccggtaaggggttacggaaggtacgtaaccggtaaaaccggtaacggtttaggcgggtacgttcggaacctaccgtaacgttccgttacggtttcctttaccgtcgtttacccccg

SEQ ID NO: 221342 - DNA, 878 bp, Homo sapiens
  misc_feature: GYAE6OF01BC5AR.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctcgaggggaancgccaccctctcctgcacgggccaggtcaggtagtggtttaacgtaccgtacgtttgggccttggtaacccagacctaaacggtaaaaccccgttggggaccccaacggggtcccttacccccggaagggtccccttacccctaccgtaactttccgttaacggttcggggttcgacctaccgttaccccgaacccggtacgggggtaccctaacgtttacggggttaaccctccccggaaggggtccccggtttagacggttcggcgtagggttcgggtccgtaggggacctaggtacgtttccgacgtaccgtccaaccgtatccgagtccacgtccgtacggaccgtaggtaacgtacggtaacgttacgtttacggtacgtttaagttttaacgtttacgtttacggttacgtacggtaaccgttaaagtttaactaaacgtttaaccgttaccgggttacccggtttacccgggtttaaccgttaccgggttttaacccggggacggggttaaccgggtaaccggtaacggggttacgggtaaacggttaaacggttaaacccggtaaaaccgggttaaccggtaggggttaccggtaccgttaccgggtaacccttaaaccgtaccgttttaccgttaccggttttacccgtttaccgttacccgtttacccccgg

SEQ ID NO: 221343 - DNA, 840 bp, Homo sapiens
  misc_feature: GYAE6OF01AIQ9N.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcacgtggaagaatagtgatgacgcagtctccgaggccaccctgtcctgtcgtcctaccgaaggggaaagacgcccacctcctcctgccgagggccagtcgagtagtacgttaacgtaccgtacgttcggaccgtacggtaccgagacgaacggtaaaccgtcggacccgacggtccgtcccgtacggtccttaccgtactattctaacgttggtacgtaccaccgtccgaaccggacggacctacggtcggtacgtcccgtacgggtacccggtagacggtcggcgtacggttacggggacgtaggggaactaggtacgttaccgacgtaccgtacaccgtataccgagaccgtacgtccgtagacaacggggtataacgtaaacgttacgttaccggtaacgtttaaagtttttacgttaactttacggtaccgtaagtaaccggtttaataaacgttaaacgttaaccgtttccggtaccccgttaccggggtttaccgtttaacccgggggtttacccggggtaagggggtaaccccggtaaacggggttaaaccgggggtaggtaaacgtaaaacccggttaaacgggaaaacccgggttaacggtttcgggttaacgggcccttaaccgggaaacccctaccgtttaacggtcccgttttaaagggttacccctttacggttacccggtttaccccccg

SEQ ID NO: 221344 - DNA, 896 bp, Homo sapiens
  misc_feature: GYAE6OF01DSZ8W.36.43.D10.1.454.CMB.1.raw
  modified_base (198)..(198): a, c, t, g, unknown or other
  misc_feature (198)..(198): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaaggggaaancgcccaccctctcctgcagggccagtcagagttgttacgtaccgtacgttggccttggtaccagaccaacgtaacccgtggaccacggcctacccgaggtcctccgtcactctagtggtcgactacgtcccgaccgacgggacctacgtcggtacctcccggagggtcccggttcaggtcggcgtaggttcgggtcgtaggggactaggtacgttcgaccgtcctaccgaaccgtacgtaccgaggtcccaacggtcccgttagggaaccgtaacggggttaaggttaacgggtaaaacgggttttacttttaccgggtaacgttttaaagggtttttttaaccgtttaacggttttacggtaaccgtaacgggttaacctttaaaaggtttaaacgtttaaaaccgttaacccgggtttaccggggttaaccccccggtttttacccggggtttaaccgttttaaccccggggttttaccggggggaaacccgggggttaaaccgggggttaacccggtaaagggggttaccgggtaaaacggtaaaccgtttaaaacccgggaaaaacccgggtttaacggtttcggggggttaaccggtccggttaaccgggtaaccccttaaacccggttacgttttaccccggtttacgggtttttacccccttacgggtttaccccgttttacccccccggg

SEQ ID NO: 221345 - DNA, 750 bp, Homo sapiens
  misc_feature: GYAE6OF01CQQIJ.36.43.D10.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (690)..(690): a, c, t, g, unknown or other
  misc_feature (690)..(690): n is a, c, g, or t
tcagtacgctgtctcacgaccggtgctcgatttagactagcagtaagggggaggaactgctcagttaggacccagacggaaccatggaagccccagcgcagcttctcttcctcctgctactctggcctccagatatcatggagaaatagtnatgacgcagtctccaggccaccctgtctgtgtcctaccgaggggaaacncgcccaccctctccctgacgacggggcccaggtccaaggtagttggttaacgtaacccggtaagtttcggcccgttacgggtaacccagaccaaccgtaaaaccgttgggacccgacgggtacctccccgacggtcctaccgttacaacttcgtaagttcgggttacaccgtacctacccgaaccgaccgggtaccctacgttcggtaacctcccggtaacgggtccggttacgaacggttcggacgtacgggttcgggtaccggtagggtaacgtacgtaacgttcgaccggtacctaccgaaccgtactaccgagtaccgacggcctacggacgagtaggtacgtaaagtcgtttactaacgttagttttaagtttgtttacggactaacgtaagttaacgttaacttaaacgtaccggttacgtcccgttaccgggttaccgtccgggttacgggacgggaacccgggtagtacgggtagaacgtanaaccgtaaacgtcggtagtcgacgtaccgcgtctacgtactggttacctgttccctcccg

SEQ ID NO: 221346 - DNA, 847 bp, Homo sapiens
  misc_feature: GYAE6OF01C7MLD.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggaagaaatagtgatgacgcagtctccaggccacctgtctgtcgtcctacgagggaaacgacgccaccctctcctgcgacggcagtcagtgtagttacgtaccgtagttcgggcctaggtaccagtaccaacggaaaccgtcgggaccgaacggcccgtacccggaacggtcccttaccctataccgtccttaagtcgggtacgacctaccgttaccccgaaccggaccggggtaccctaacgggttcggttaacccgttaccccggtaacggggtcccccgggtttacggaacgggttcgggacggtttacggggtcggggtttaaccgggtacgggggtaacccgtacgggtacgtttaaaccccggacggtacccctaccggtaaccctaaggttccgaacggtaccgtaccgacccgtttaacggaccgtaaagggtaaggttaggtaaacgttcggttttaactaaccggttttaaggttttaatttaacggttttcggaacgttaagtaccgttaaagttaaacgtttaaaggtaacccggttccgggtttaacccgtccggtttaacggttcggtttaccggggaacggtaacggggttaaccgtaaggggtacggtaacggtaacctaaacgggtaaccgtacgggtaggttcggacgttccgactacgttagtcttcggttactaccttcgttacccg

SEQ ID NO: 221347 - DNA, 806 bp, Homo sapiens
  misc_feature: GYAE6OF01A3KTJ.36.43.D10.1.454.CMB.1.raw
  modified_base (201)..(201): a, c, t, g, unknown or other
  misc_feature (201)..(201): n is a, c, g, or t
tcagtacgctgtctcacgaccggtgctcgatttagactagcagtaaggggaggaactgctcagttaggacccagacggaaccatggaagccccagcgcagcttctcttcctcctgctactctggctcccagatatcactggagaaatagtgatgacgcagtcctccaggcaccctgtctgtgtacctccgaaggggaaacncgccccaccctctccgtgacgagggccagtcagagttgttacgtacccgattcggcccgtaggtaacccagacaacggtaaaccgtcggacccaagggtccttaccccgaggcccttccgtactactccgtagtggtcacgtactacccgaaccgtacgggaccctacgttcgggtaaccgtccccgtaagggtccccggtttacgaaggttcgggacgtaggttcggggttccgtaggggaacctaggtaaccgttccgacgtacccgtacaacctactacgacgaccacgaccgtacgaccgaagtagtacgtaagtaacgtttacgtaaccgtttagttttaaaaaacgtttcgtttacgttacgtaacgttaccgtaagttaaacgttaaacgttaaccgttaccggttacccgtttacccggttacccgttaacccggtttaccggggtaacggggtaaccggggtaaccggtaaacgggttaacgggtaaccgtaacgttaaaccgtaaaaccggtaaacgttacgggttacggtacgttaccggaccttaacccgtacgttaccgttaccgtttcccgtttcgttaacccgttccccg

SEQ ID NO: 221348 - DNA, 700 bp, Homo sapiens
  misc_feature: GYAE6OF01B8N07.36.43.D10.1.454.CMB.1.raw
  modified_base (106)..(106): a, c, t, g, unknown or other
  misc_feature (106)..(106): n is a, c, g, or t
  modified_base (199)..(199): a, c, t, g, unknown or other
  misc_feature (199)..(199): n is a, c, g, or t
  modified_base (426)..(426): a, c, t, g, unknown or other
  misc_feature (426)..(426): n is a, c, g, or t
tcagtacgctgtctcacgaccggtgctcgatttagactagcagtaagggggaggaactgctcagttaggacccagacggaaccatggaagccccagcgcagcttcncttcctcctgctactctggctcccagatatcactggagaaatagtgatgacgcagtctaccaggcaccctgtctgtcgtctccgaggggaaanacgcccaccctctcctgcagggccagtcagtagtcgttagtaccgacttggcctggtaccagcaagaacctggcccaaggcctacccaggcctcctcgattctatggtcgcactcccaaccggagggcccaacgttcggtaacctcccgaagggtcccggttacaggttgaccgtacggtgggtctaggggactaggtacgttccaccgtctaccacctacgtcaancgacgccctgacaggtagtacgaaagtctttacgactttagtttaacttagttcgtaccgagtccgaaagtttaataaccgtttaacggtccgtaccccggtttacccggttacgttaccggttttccgggggaacggggtaacgggtaccctaaagggggttcggaaacgttacgggtaaaccgggaaaccgtaaggtttcggacgggtcgttaccggaccccgttaacctacgtttactcccgtttaccgtttacgcccgttttaccccggg

SEQ ID NO: 221349 - DNA, 888 bp, Homo sapiens
  misc_feature: GYAE6OF01C6GXA.36.43.D10.1.454.CMB.1.raw
  modified_base (207)..(207): a, c, t, g, unknown or other
  misc_feature (207)..(207): n is a, c, g, or t
tcagtacgctgtctcacgaccggtgctcgatttagactagcagtaagggggaggaactgctcagttaggacccagacggaaccatggaagccccagcgcagcttctcttcctcctgctactctggcctcccagatactcacgtggaagaaatagtgatgacgcagtctccgaggccaccctgtctgtcgtctaccggaggggaaacncgcccctaccctcctccgtacgacgacgggacctagtcgaaggtacgttacggttaacggtaccggtaccgttcgggacccttagggtaacccgagaccgtaaacggaaacccgttcgggacccgtacggtaccctaccccggaaggtccccttacccttacgtacttccgttaaggttcgggtaccacctacccgtacccgaaccggtaccggggtccctacggtttacgggttaacccctccccgggtaacggggtaccccggtttcgaagggttcgggaccgtaggggtttccggggttagaccgggggtaacgtacggttaacggtttaccaccggttaccctacccggaaacttacgcgaaccggcgtaccgtccgtacgtacgtacgttacggtaagttaacgtttacgttttcggtaactttacggtttttaactaaccgttacgtaaaccgtaacgttaacgttacgtaagttaccgggttacgtttacccggtaccctttacggttaccggttaccgggttaccgggggaaccgggtaaccgggtaacggtaagggtacggtaacgtaaccgtaaacggtaaaccgggtacgtaggttcccggtccgtaaccggtacccgtaaaccgtcgtttaccgtacgtttttacccgtactttccccgtttaccccgg

SEQ ID NO: 221350 - DNA, 725 bp, Homo sapiens
  misc_feature: GYAE6OF01B1KFX.36.43.D10.1.454.CMB.1.raw
  modified_base (201)..(201): a, c, t, g, unknown or other
  misc_feature (201)..(201): n is a, c, g, or t
  modified_base (454)..(454): a, c, t, g, unknown or other
  misc_feature (454)..(454): n is a, c, g, or t
tcagtacgctgtctcacgaccggtgctcgatttagactagcagtaagggggaggaactgctcagttaggacccagacggaaccatggaagccccagcgcagcttctcttcctcctgctactctggcctccagtatatcacgtggaagaaatagtgatgacgcagtctcgaggcctacctgtctgtgtcctacgaagggaancgccaccctctctgcgacggccagtcgagtagttacgttacgtaccgtattcgggccgttaggaacctagaccgaacgtaaccggtcggacccacggtaccctcccgacgtccttccgtcgtacttacgtggttacgccgtacaccgtaccccgacggaccggtcctacggtagtaccttcccggaggtcccgtagaggtcggagtaggtcggtgacggactagtacgtcgactcgtccacgtactaccgacnccgtacgtcccgtagacgtaacggtaggtaacgtagttacgtttccgtaatttacgttttaagtcgttacgtacgtacgtaagtttaacggtaatttaaccgtacggttccccggtttacgtccccgggttaacgtttccgggtaaccggggacgggtaaacgggtccggtaaaggttacggaacgttaccgtaaaccgtaacgggttacttacggtacggtccctagacccctagttccgttacgtcgttaaccttccgtaccgttcccg

SEQ ID NO: 221351 - DNA, 837 bp, Homo sapiens
  misc_feature: GYAE6OF01AC2PA.36.43.D10.1.454.CMB.1.raw
  modified_base (144)..(144): a, c, t, g, unknown or other
  misc_feature (144)..(144): n is a, c, g, or t
  modified_base (206)..(206): a, c, t, g, unknown or other
  misc_feature (206)..(206): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctccagatatcactggaanaaatgtgatgacgcagtctccgagccacccgtgtcctgtcgtctaccgaaggggaaacgtcnccctaccctctcctgccgagggccagtcagtagttgtacgtaccggacttcggacgtcgtaccagtaccgaacggaaaccctggaccctacggtcctaccccggaggtcccttccctcgtaacttgtaacggtcgggtacacctaccgtacccgaacccggacggtaccctacgttccggtaacctcccggtaacggtcccggttcgacggtcgggaccgttaggtcgggtccggttaggggaacctagggtacgttccaaccgtaccgtacccgaacctagttcccgaacgtaccgtaccggtaccgtacggaccgaaggtaggtaacgtaaacgtttacggtttccgttaagtttaacgttttaacgtttacgtttacgtaccgtaaggtaaccggttaaagttaacgtttaaaaccggtttaacccggttaccggttaccccggttacccgggttaaccgtttacccggggtttacccggggaacgggttaaccggggtaacggtaacgggttacggtaagtaaaccggtaaaccggtaaaaaccggtcggttacgggtacggtcccgttaacgtaccgtaccctaaccgttccgttaccggtttactcccgttactttaccccccgg

SEQ ID NO: 221352 - DNA, 679 bp, Homo sapiens
  misc_feature: GYAE6OF01EUW2W.36.43.D10.1.454.CMB.1.raw
  modified_base (124)..(124): a, c, t, g, unknown or other
  misc_feature (124)..(124): n is a, c, g, or t
  modified_base (182)..(182): a, c, t, g, unknown or other
  misc_feature (182)..(182): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
  modified_base (640)..(640): a, c, t, g, unknown or other
  misc_feature (640)..(640): n is a, c, g, or t
tcagtacgctgtctcacgaccggtgctcgatttagactagcagtaagggggagaactgctcagttaggacccagacggaaccagtggaacgcccagcgcagctttctcttcctcctgcttactntggcctccagatatcactggaagaatgtgatgacgctagtctccaggccacctgtctntgtctccgaggggaacgtccacctctctcgctacgggcagtcagtaggtnttacgccgtnttggcctaggaccagacgaagaacccgtggaccgaggcctacccgagcctctacncgttctagtcgcgctaccgtcccaccggcggactacgtcgggttacctcccgggtggacccggttgacggttcggaccgtaggtcggggtttacggacggaacggtctacggttcccacgtccgtaccgacccaatccgagccacggtaccgttcgggactaagggtaggttacgaacggtttctttacggtacgtttaatttacgtttaccgttgtacgtactacgtaattaactaaggtacttccggtccttacggttactaccgggttgggaccgggaggtacgtagggtacgtataaccgaacgaaacgggttagttggtccggtacttccggtaaccnctttacggcgtttaacgtttctacttcccggttaccccg

SEQ ID NO: 221353 - DNA, 524 bp, Homo sapiens
  misc_feature: GYAE6OF02GWUAW.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaacctggccaggctcccaggctcctcatctatggtgcatccaccagggccacgtggtactcccgaggccggttcaggtcggcaggtgggtctgggacaggagttcacgctcacatcagcagcctgcagagtgaagtatttcgctagtttattattgtcagcagtataatactggccttcggtctacgtttcggcggtagggaccaagggtggagatacgaaacggaactggtacggcgtgaccgtacacgtcttcgtcttcattccg

SEQ ID NO: 221354 - DNA, 607 bp, Homo sapiens
  misc_feature: GYAE6OF02IAHAH.36.43.D10.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (406)..(406): a, c, t, g, unknown or other
  misc_feature (406)..(406): n is a, c, g, or t
tcagtacgctgtctcacgaccggtgctcgatttagactagcagtaagggggagggaactgctcagttaggacccagacggaaccatggaagccccagcgcaggccttctcttcctcctgctactctggctcccagatatcactgggagaaatgtgatgacgcagtctccaggccaccctgtcctgtcgtcctccgagggggaaancgccaccctctcctgcagggccagtcagagttgttagaccggattggcctggtaccagcagaacctggccaggctccaggctcctcatctatcggtncatccaccgagggccacgtggtactcccgaggtccgttnaggtggcaggtgggtctggggacaggagttcacgtctcaccatcagcagcctgcagagtgaagtntttcgctagttttattagttgtactagtctaagttactaaattaactgggtaccctccggttactaaccgttttcgggacgggtaacgggtacccgtaaaggggttcgggaagtacgttaccggaaaacggtacgttaggtacgggaccttacggaccgtacccgtagttccgttaggtttacccttccgactttccccgg

SEQ ID NO: 221355 - DNA, 603 bp, Homo sapiens
  misc_feature: GYAE6OF02JERK2.36.43.D10.1.454.CMB.1.raw
  modified_base (197)..(197): a, c, t, g, unknown or other
  misc_feature (197)..(197): n is a, c, g, or t
  modified_base (332)..(332): a, c, t, g, unknown or other
  misc_feature (332)..(332): n is a, c, g, or t
tcagtacgctgtctcacgaccggtgctcgatttagactagcagtaaggggaggaactgctcaagttaggacccagacggaaccatggaagccccagcgcagcttctcttcctcctgctactctggctcccagatatcactggagaaatagtgatgacgcagtctccaggcaccctgtctgtgtctccgaggggaaanagccacctctcctgcagggccagtcagagtgttagtaccgacttggcctggtaccagcagaacctggccaggctccaggctcctcatctatggtgcatccaccgagggccacgtggtactcccgaggtccgttanagtcgcctaggtcgggtctgggactaggtaccttcgacttctaccaccatcgagcacgcctagacgcctagaagtatttgacttactttattactgtacaactacgtaccgtaacctacgtcggacggtacggttacggaccgtaacgggaaccgtaacgggtaccgtaacgggtaaccgaaacgtaacgttcggtacgggtcgtacggaccgtaaccgtacgttccgttgttaccttacgtacgttccgttacccgctacgtcgtaacgg

SEQ ID NO: 221356 - DNA, 505 bp, Homo sapiens
  misc_feature: GYAE6OF02H5UJ3.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaacaataacttagcctggtaccaacagacacctggccaggctccccaggctcctcatctatggtgcatccaccagggccactggtatcccagccaggttcagtggcagtgggtctgggacagagttcactctcaccatcagcaacctgcagtctgaagattttgctagtttattactgtcagcagtataatgacaggcctccgggtaactttggccagggggccaagcgtaggagatacaaacggactgtggctgcaccatctgtcttcattcccg

SEQ ID NO: 221357 - DNA, 515 bp, Homo sapiens
  misc_feature: GYAE6OF02HBDDM.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctctcctgcagggccagtcagagtgttagtaccgattggcctggtaccagcagaaacctggccaggctcccaggctcctcatctatggtgcatccaccagggccactggtactcccaggccggttcaggtcggcaggtgggtctggggacaggagttcacgctcaccatcagcagcctgcagagtgaagtatttcgctagtttattattgtcagctagtataataactggtcctcggtctacgtttcggcggtagggaccgaaggtggagagtacgaacgtactggtggctgcaccatctgtcttctatcccg

SEQ ID NO: 221358 - DNA, 499 bp, Homo sapiens
  misc_feature: GYAE6OF02GZPC1.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtatccaggcaccctgtctgtgtctccaggggaaangccaccctctcctgcagggccagtcagagtgttagtaccgacttggcctggtaccagcagaaacctggccaggctcccaggctcctcatctatggtgcatccaccagggccactggtatcccaggccggttcagtggcagtgggtctgggacagagttcacgctcaccatcagcagcctgcagagtgaagtatttcgctagtttattattgtcagcagtataatactggcctcggtcacgtttcggcggaggaccgaaggtgagatacgaacgactggtggctgcacatctgtcttcattccg

SEQ ID NO: 221359 - DNA, 570 bp, Homo sapiens
  misc_feature: GYAE6OF02IGTJN.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaaacctggccaggctccaggctcctcatctatggtgcactccaccgaggccacgtggtactcccgaggtccgttcagtggcaggtgggtctgggacagtagtcacgctcgaccatcaggcacgcctgcagagtagaacgtatttcgactagtttattagttgtctagctaagttaataagtaacgtcggtacccttccggtacttaccgtttcgggacgggtacgggacccgtaagggtggaagtataccgaaacggtacgtggttaggcctacggctaaccgtagttccgttgtaccctttacgacttcccg

SEQ ID NO: 221360 - DNA, 773 bp, Homo sapiens
  misc_feature: GYAE6OF02ICWFQ.36.43.D10.1.454.CMB.1.raw
tcagtacgctgtctcacgaccggtgctcgatttagactagcagtaagggggaggtaacgtgctcagttaggacccagacggaaccatggaagccccagcgcagccttctcttcctcctgctactctggcctcccagatagtcacgtggaagaaatagtgatggacgcagtctccaggctacccctgtcctggtgtctccgaggggaaagacgcccacccttctccgtgcgagggccaggtacagcgtggttacgaccgagttggcctggtaccagcaaggaacctgggaccaaggcctcccgaggctcctcattctatggtcgactacgtccaccgacgggccacgtcggtactcccgagggtcccgttagaggtcggacgtaggtcgggttccgtagggacacgtacggtttcgaaccggtccttaccgaacccgtagtacccgaaggtccgaacggtaacggtacgggtaccggtaccccggttaagggaaacggttacggttttttaccggacccggtttaggtttaaccgttttaaccggttacggttaaccctaaaccgttaacgtttaaccgttacgggttaacccttaccgtttaccgttaccgtttaaccgtttaccggtttttacggggacccggtaacgggggtaaccctaacggtaccgtaagggtaacgttaacgtacggaaaccgtacggttcggttacggtcgtacggaccgtaccgtacgtcgttacgttacctttacgtaccgttacccttacccgg

SEQ ID NO: 221361 - DNA, 517 bp, Homo sapiens
  misc_feature: GYAE6OF02HOBRI.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctctcctgcagggccagtcagagtgttagtaccgacttggcctggtaccagcagaaacctggccaggctcccaggctcctcatctatggtgcatccaccagggccactggtactcccaggccggttcaggtggcaggtgggtctgggacagagttcacggctcaccatcagcagctgcagagtagaagtatttcgctagttttattaattgttcagtcaagttataataactggcctccggtcacgtttcggcggacgggacaaggtggagatacgaaacgacgtgtggctgccacgtatctgtcttcattcccg

SEQ ID NO: 221362 - DNA, 536 bp, Homo sapiens
  misc_feature: GYAE6OF02GOGN5.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaaacctggccaggcctcccaggcctcctcatctatggtgcactcccaccgagggcccacgtggtactcccgaggccggttcagtggcaggtggggtctgggacaggtagttcacgtctcaccatcagcacgcctgcagagtagaagtatttcgctagtttattattgtacagctagtataattaacgtcggtcctccggtctacgtttcgggcggtaacggacgaaggtggagagtacgaacgtacgtgtggcgtgacacctatcgtgtcttctactcc

SEQ ID NO: 221363 - DNA, 534 bp, Homo sapiens
  misc_feature: GYAE6OF02IMN1I.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaaacctggccaggctcccaggctcctcatctatggtgcatccaccagggccactggtatcccaggccgttcagtggcagtgggtctgggacagagttcacgctcaccatcagcagcctgcagagtgaagtatttcgctagtttattattgtcagctagtataataactggccttaccggtctacgtttcggacggtacgggaccaagggtcggaagtactacgaaacggtaacttaggtgggactggacctaccgacttctggtcctttcattcccc

SEQ ID NO: 221364 - DNA, 550 bp, Homo sapiens
  misc_feature: GYAE6OF02G60P9.36.43.D10.1.454.CMB.1.raw
  modified_base (196)..(196): a, c, t, g, unknown or other
  misc_feature (196)..(196): n is a, c, g, or t
  modified_base (399)..(399): a, c, t, g, unknown or other
  misc_feature (399)..(399): n is a, c, g, or t
  modified_base (439)..(439): a, c, t, g, unknown or other
  misc_feature (439)..(439): n is a, c, g, or t
  modified_base (525)..(525): a, c, t, g, unknown or other
  misc_feature (525)..(525): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcaccggggaagttgtgttgacacagtctccagccaccctgactttgtctccgggggaaanagccacctctcctgcagggccagtcggagtgtttcagtctacttaatgtgtaccaacagaaacctggccaggctccaggctcctcatctatgatacatccaacagggccacgtggcctcccagaccaggttcaggtggcaggtggtctgggacagacttcactctcacatcagcagccgtggactccgtagaagtactttcgngtactagttttacttactgtacacgtcaggttaccgttanaggttcggcctccgtcttcctacgtttcggacggtacggtccgaagggttcgagtactacgaacgacgtgtacgcgtcgactactntctgttctctatccctccgctatcg

SEQ ID NO: 221365 - DNA, 628 bp, Homo sapiens
  misc_feature: GYAE6OF02JBILS.36.43.D10.1.454.CMB.1.raw
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaanagccaccctctcctgcagggccagtcagagtgttagtaccgattggcctggtaccngcagaaacctggccaggctccaggcctctcatctatggtncatccaccgagggccacgtcgtactcccgaggccggttcagtcggctaggtgggtcngggacagacttcactctacaccatcagcagccgtaggacgccgttggaacgtattcgtgtactaagttttacttacgttcgtacgaacgtcgtaacgtccgtttactacgggtttacggcccttcccgggacctttaccgtaacccggttttcggggaccgggtacgggtacccgtaaggggttcgggagtacgttaaccgaaaccggtaaccgttgggttacggtaccgtacggtaccgaacccgtacgttcgttacggtttacctttcgtaacccg

SEQ ID NO: 221366 - DNA, 548 bp, Homo sapiens
  misc_feature: GYAE6OF02IDSCB.36.43.D10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (517)..(517): a, c, t, g, unknown or other
  misc_feature (517)..(517): n is a, c, g, or t
tcagtacgctgtctcacgaccggtgctcgatttagactagcagtaagggggaggaactgctcagttaggacccagacggaaccatggaagccccagcgcagcttctcttcctcctgctactctgactcccagatatcactggagaaatagtgatgacgcagtctccaggcaccctgtctgtgtctcaggggaaangccacctcncctgcagggccagtcagagtgttagtaccgacttggcctggtaccagcaacgaaacctggaccaggctccaggctcctcatctatggtgcatccaccagggcccagtggtactcccgaggcccggtttcaggttcggcaaggttgggtctggggacagacgttcacgctcaccatcagccagctgcagagtgaagtatttcgactagtttatttagttgtacagtctagtaataaacttaaacttcggaccttccggtctacgtttcgggacggtacgggaacgaagggtagagacgtacgaaacgaactggnggtactcgacactatcttgtacttcattccc

SEQ ID NO: 221367 - DNA, 509 bp, Homo sapiens
  misc_feature: GYAE6OF02FYY03.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaangccaccctctcctgcagggccagtcagagtgttagtaccgacttggcctggtaccagcagaaacctggccaggctcccaggctcctcatctatggtgcatccaccagggccactggtactcccaggccggttcagtggcaggtgggtctggggacaggagttcacgctcaccatcagcagcctgcagagtgaagatttcgctagtttattattgtcagcagtataataactgcctcgtctacgtttcggcggtaggaccgaaggtcgagacgtacgaaacgaacgtgtggctgcacatctgtcttcattcccg

SEQ ID NO: 221368 - DNA, 658 bp, Homo sapiens
  misc_feature: GYAE6OF02IYAXF.36.43.D10.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (608)..(608): a, c, t, g, unknown or other
  misc_feature (608)..(608): n is a, c, g, or t
tcagtacgctgtctcacgaccggtgctcgatttagactagcagtaagggggagggaactgctcagttaggacccagacggaaccatggaagccccagcgcagcttctcttcctcctgctactctggctcccagatatcactggagaaatagtgatgacgcagtctccaggcaccctgtctgtgctaccgaggggaaangtccaccctcnctgcagggccagtcagagttgttacgtaccgcttggcctggaccagctagaacctgccaggcnccgaggctcctnatctactggtgacactaccgacccgtaagggccctacgtcggtacacccgtacggcccgtttcgaagtcggtcaaggtttcggggtactacgggggacctaagtacggttccgaacggtcacgtaccagtcgagacncgacgtcgagagnggtagtaagtacgttcgacgttagtttattattcggtactagtactagttaataaaccgtacgtaccgggttccttacccggtacttacccggtttacgggaccgggtaacggggtaaccgaacggttgggaactacgtaaccggtaaaacgtaccggtaagtccgggttaacnccgggtaactaaccgtattccgttacggtcgttacccttattacccccgg

SEQ ID NO: 221369 - DNA, 728 bp, Homo sapiens
  misc_feature: GYAE6OF02IU2Y7.36.43.D10.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagtacgctgtctcacgaccggtgctcgatttagactagcagtaagggggaggaactgctcgagttaggacccaggacggaaccatcggaagccccagcgcagcttctcttcctcctgctactctggctacccagatatcactggagaaatagtgatgacgcagtctcaggcaccttgtctgtcgtctcgaggggaangccacctctcctgcagggccgagtcagagtgttacgaccgacttggcctggtaccagcaagaacctggccaggtcctccgagtcctcctnatctatggtnctatccacgaggcctacgtcggtactcccgaggtacccggttnagggtcggactagggttggtcgtagggactaggtacgttacaccggtcttacgaacccgtataccgtaggcctacgacccgtagaccgtaagtacggtagggaaactacggttttaccgacgtttaagttttttaagtttacggttcggttaaccaaggacctttaaagttaaactttaaacgttaaccgtttccggggtaccccgttaccgggtttacttaaacccggggttttccggaccggggtaaacggggtaacccgtaaggggtacgggtaaacgtacgtaaccggaaaccggttaacggttcgggtaacggtccgttacggacccgttaaccggtaacgtttccggttaccgtttaccttacgttacccgtttaccccg

SEQ ID NO: 221370 - DNA, 625 bp, Homo sapiens
  misc_feature: GYAE6OF02F3OGD.36.43.D10.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (614)..(614): a, c, t, g, unknown or other
  misc_feature (614)..(614): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaanagccaccctctcctgcagggccagtcagagtgttacgtaccgacttggcctggtaccagcagaaacctggccaggctccaggcctcctcatctatggtcncactcccaccgagggccacgtggtactcccgaggccgttcaggtggctaggtgggtctagggacaggtacgttcacgctacaccatcagcacgcctagacaggacgtagaagtacgtttcgacttaaggttttattagttcgtacgtagtactaaagttattaaacgttaccgttcggtacccgttaccggttaccgttaccggtttacgggaccgggtaacggtaaccgtaaggggtacgagtacgtaaccgaaacggtacggtaggtacggtccgtacggaccaacccgtattcccgttacgttaccgtttaccncgtttaccccg

SEQ ID NO: 221371 - DNA, 707 bp, Homo sapiens
  misc_feature: GYAE6OF02I12ZR.36.43.D10.1.454.CMB.1.raw
  modified_base (199)..(199): a, c, t, g, unknown or other
  misc_feature (199)..(199): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcacgtggagaaatagtgatgacgcagtctccaggccaccctgtctgtgtctccgaggggaaancgcccaacccttctccgtgcagggccagtcaagtgtgttacgtaccgacttggcctggtaccngcagaaacctggccaggctccagctccnatctagtggtcgcactaccaccgaggccaacgtcggtaactccccgaagccctaacgttttagcggacgtacgtcgggtccgtaggggacctaggtacgttccacgtacctcctaaccccgtatccgaacggtacctacggtccctacgggtacctacgggttaccttaagggtaacgtttaacgtttttcgaacgtttaacggttttacgtttaacgttacggttaacctaaacggtaacgttaaaccgtaagttacggtaacccggttacgtcccgttaccgttaccgtaccggttttacgggaccgggttaacgggaccgtaaggttcgggaacgtagtaaccgtaaacggtacggtcgtacgggtacctagacccgtaactcgttcgtacggttctttaccgatttacccccg

SEQ ID NO: 221372 - DNA, 593 bp, Homo sapiens
  misc_feature: GYAE6OF02JIBIE.36.43.D10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
  modified_base (574)..(574): a, c, t, g, unknown or other
  misc_feature (574)..(574): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaancgcccacctctcctgcagggccaggtcagagtgttacgaccgtattggcagtggtaccagcaagaaaccgtggaccaggcctccgaggcctccncatctagtggtgcactcccacgacggccagtgtacctccgaggtccgttnaggtcgcgtaggtcgggtcgtagggactaggacgttcacgtcctacaaccagtccagccgtacgcctggacaggtagtagaagttattccgagttacgttttattattcgtacagtacgtaagtaattaacgtacgtacggtcccgttaccggttacctacggtttcgggacggtacggaaccgtagggaggtactataccggaaacgtagttggtcgacgtcgacctacgtnttcgtacgttctccgtacg

SEQ ID NO: 221373 - DNA, 705 bp, Homo sapiens
  misc_feature: GYAE6OF02F7J0K.36.43.D10.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactgganaaatagtgatgacgcagtctccaggcaccctgtctgtgtctccgaggggaaangccaccctctcctgcagggccagtcagngtgttagaccgattcggcctggtaccagtccaagaaaccctggccagggcctacccgaggtcctcctcgattctagtgggtcncactcccaccgaggggccctacgtcgggtacctcccgagggtcccggttgaggttcggactagggtcggggtctggggaactagggtacgtttcgacgtctaccaccgtagtccagcgacgtccctaggacctaaggacgtacgtaaagttactttcggactttaaggttttaacgtttagttacggttctaaggtactaaggtttaactaaacttaaccgttcggtacccgttaccggttaccgttaaccggtttcggggaaccggtacgggtaaccgtaagggtacgggaacgtacgtaaccgtaaacgggtaacgttacgggttacggtccgtaacggtaccctaaccggttacttaccgttacggtaccctttacggtaccctttaaccccgg

SEQ ID NO: 221374 - DNA, 623 bp, Homo sapiens
  misc_feature: GYAE6OF02IL2FQ.36.43.D10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaangcccaccctntcctgcagggccagtcagagtgttagtaccgacttggcctggtaccagcaagaaacctggaccaggctccaggctcctcatctatggtgcatccacgagggccacgtggtacncccgaggtccggttnaggtggcaggtgggtctgggacagagttcacgctcaccatcagcagcctgacgagagtagaaagttacgtttcgcttaagttttattaagtttgtacagactaagttaataaagtaacgttcggtacccgttccggtacttaacggtttcggggacgggtaacgggaaccgtaaagggtacgggaagtacgtaaccgtaaaaacggtacgttacgggtacggtaccgtacggtaacccgtaaccgtacgtttccgttacggttaccctttacgtaaccgtttcccccg

SEQ ID NO: 221375 - DNA, 748 bp, Homo sapiens
  misc_feature: GYAE6OF02HOOER.36.43.D10.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagtacgctgtctcacgaccggtgctcgatttagactagcagtaagggggaggaactgctcagttaggacccagacggaaccatggaatccccagcgcagcttctcttcctcctgctactctggctccagatatcactggagaaatagtgatgacgcagtctccaggcaccctgtctgtgtctccgaggggaaagngccaccctctcctgcagggccagtcagagtgttacgtaccgacttggcctggtaccagcagaaacctggccaggcctccaggctcctnatctatggtncatccacgagggccacgtggtactcccgagggtcccggttcaggtcggcgtaggttcggggtactggggaacctaggtaacggtttccaaccggtccttaccgaacccgtagtccaacggcccgacggtcccgtcggacgtaaggtaacggtacggtaaagttacgtttttaccggactttaacggtttttaagtttaacgttttcggtacgtaagtaccgtaaagttaaattaaacgttaaccgttacgggttacccgtttacccgggtttaccttaaccgggtttttaccggggaccggggtaaccgggggtaacccggtaaaggggttacggggaaggtaacgttaaccggaaaaccggtaacggttacgggttacgggtaccgttaccggaccgtaacccgtacgttacccgtttacggtttacccgtttaccgtaacgtttcccccgg

SEQ ID NO: 221376 - DNA, 759 bp, Homo sapiens
  misc_feature: GYAE6OF02J254C.36.43.D10.1.454.CMB.1.raw
  modified_base (198)..(198): a, c, t, g, unknown or other
  misc_feature (198)..(198): n is a, c, g, or t
tcagtacgctgtctcacgaccggtgctcgatttagactagcagtaagggggagggaactgctcagttaggacccagacggaaccatggaagccccagcgcagcttctcttcctcctgctactctggctcccagatatcactggagaaatagtgatgacgcagtctccaggcaccctgtctgtgtctccgaggggaaancgcccaccctctccgtgcaggggtccagtccagagttgttacgtacccgatttgggaccctggtacccagccaagaaacctcggccaggcctcccgaggtcctcctcattcctagtcgggtcaccactccgaccgtagggcccacgttcggtaactcccgaagggtcccggttacaggtggcctagggtcgggtcgtacggggactaggtacggtttaccgacgtccgttaccgaaccctacgttcccgaacgggtccctaaccggtacccgttcggaccgttaaagggtaacggttacggtaaacggttaccgtttttaccggacgtttaaacggtttttaacgttacggtttacgttaccgtaacgttaccgttaacggttaaactttaaaccgttaaccggttccggtaacccgttcccgggtttacctacggttttaccgggaacgggtacgggtaacccgtaaggggttagaacgacgttaacggaaaccgtacggtgtacggtccgttacgacccgtacgttacgttacctcggtttaccttcgtaccgttcccg

SEQ ID NO: 221377 - DNA, 696 bp, Homo sapiens
  misc_feature: GYAE6OF02JKWMM.36.43.D10.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaangccaccctctcctgcagggccagtcagagtgttacgtaccgacttggcctggtacccagcaagaaacctggcccaggcctcccaggcctcctcatctatgggtncactcccgacgacgggcccacgtggtaacctcccgaagggccccggtttagacgttcgggcgaggtggggtccgtaggggaacaggtacgttccacggtcctacccgaaccattccaggtcctacggtccgtagccaggaaggtcgtaagtacgtttacgtacgttaacgttttaattacgtttcgtacgtacgtacgtaagttaactaaacgttaaccgtacggtcccttacccgggttctaaccggtttcgggaccggggtaacgggtaacccgtaaggggttacggaagtacggtaacgaaaccggttaacgtcgggttaccggtaccgtaccggtaccgaacccgttacggttaccgttacggttacccgttttacgaccgtttcccccgg

SEQ ID NO: 221378 - DNA, 639 bp, Homo sapiens
  misc_feature: GYAE6OF02JG0WB.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtccagagtgttagtaccgacttggcctggtaccagcagaaacctggccaggctccaggctcctcatctatggtgcactccaccgagggccacgtcgtactcccgagggtccgttcaggtcggccaggtcgggtctggggactacggagttccacggtctacgaccctagtcgagcacgtccgtgacgagagtgtaagtactttacggacgttaggtttactttagtttcgttactagtaccgtaagttaataaacgttaacgtccggtacccgttccggttaccgtaccgttttaccggggacggtaccggggtaaccgtaagggtacggaagtactaccggaaaccggtaacgtggttacggaccgttacgccgtaaccgtacgtacccggtttagtccgtttaccacgtttaccccg

SEQ ID NO: 221379 - DNA, 696 bp, Homo sapiens
  misc_feature: GYAE6OF02GSGC3.36.43.D10.1.454.CMB.1.raw
  modified_base (197)..(197): a, c, t, g, unknown or other
  misc_feature (197)..(197): n is a, c, g, or t
  modified_base (348)..(348): a, c, t, g, unknown or other
  misc_feature (348)..(348): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaanagcccaccctctcctgcagggccagtcagagtgttagtaccgacttggcctggtaccagcaagaaacctggaccaggcctcccgaggcctcctcattctagtggtgccatcccaccgagggcccacgtggtactcccgagggtcccggttnaggtggctaggtcggggtctggggacaggtacgttcgacgtctaccgacctatccgacgccacgtcccgtagaccgaagggtaacggttaggtaaacgttcgttttaccggacgtttaaaggttttttaactttaagtttcggtaacctaaggtacctaaggtttaaacttaaacgttaaccggttcgggtaccccgtttacccgggttaccttaaccgggtttccggggacgggtaaccgggtaaccgtaaggggttcggaagtacttaaccggaaacggtcgttagggtacggccgttagaccctaaccgttagttccgttacgtcctttacgtacgtttcccccg

SEQ ID NO: 221380 - DNA, 568 bp, Homo sapiens
  misc_feature: GYAE6OF02HNDZE.36.43.D10.1.454.CMB.1.raw
  modified_base (347)..(347): a, c, t, g, unknown or other
  misc_feature (347)..(347): n is a, c, g, or t
  modified_base (394)..(394): a, c, t, g, unknown or other
  misc_feature (394)..(394): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagataccagatgtgacatccagatgacccagtttccatcctccctgtctgcatctgtaggagacagagtcaccatctcttgccggcaagtcagggcattaacatcatttagctggtatcagcagaaaccaggaaagttccgtaagctcctgatatatgctgtattcatgtgacaagtcggggtcctagtcgtcggttcagtggcagtgatagtgganagtatttcgactctcaccatcagcagtcctgccacgccgtagaagtntggttcgtacgtaactttattattagtaactaaaagttaactaaacgtagtccgacccgtacttccgtaacgtttcgggacgggtaacgggtaccgtagggtcggtaacggtaacgtaaccgaaacggtaacgtacggtgtacgttacgacctaccgtacttcgttacgttacc

SEQ ID NO: 221381 - DNA, 625 bp, Homo sapiens
  misc_feature: GYAE6OF02I5IN7.36.43.D10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaanagcccaccctctcctgcagggccagtcagngttgttacgtaccgacttggctggtaccagcaagaaacctggccaggcctccgaggctcctcatctagtggtnctactcccacgacgggccacgttggtactcccgagggtcccgttnaggtcggctaggttcgggtcgtggggacaggtacgttccacggtcctacacctatcgacgcacgcctcggacaaggtaggtagaaagttagtttcggatttaagtttttattattcggtactacgtactaaagttataaacgttacgtcggtacccttcgggttacctaccggtttcgggacgggtaacgggaccgtaagggtagaacgtataaccggaaacgtacggtcgtagggccttaggacctacgtacgttccgtcgtccttctaccgtttcccg

SEQ ID NO: 221382 - DNA, 935 bp, Homo sapiens
  misc_feature: GYAE6OF02JG697.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggagggaactgctcagttaggacccagacggaaccatggaatccccagcgcagcttctcttcctcctgctactctggctccagatatcactggagaatagtgatgacgcagtctccaggcaccctgtctgtgtctccgaggggaaanagcccaccctctcctgcagggccagtcagagttgttagtacccgacttcgggcccttgggtaaccccaggtcctaacggaaaacccttcggggacccctaagggccccttacccccgaagggtccttccccctttaccaagtttccttaggtggggttcgcctaaccgttaccccaccggaacggggccctaacgttcgggtaaccgtcccccggtaaggggtcccccgggttttacgacgggttcggggcccgtaacgggtttcggggggttacccgttacggggggaaaccctacgggggtttaacggtttttacccgaaaccgtttcccccttaacccggaaaccccaaacggttttcccggaaaccgggacccggttaacggtaccccggttcggtaccgttaacccgggtttacccgttaaggggtttaaacggtttaacggttttttaccgggtaaccgttttaacggttttttaaaccgttttaccgttacgggtttaaaccctaaacgttaaaccgggttaaccttaaacggttacggttaacccgttcggttaaccccttccgtttaccggttaccggttttaccggggaccgggggtaaacgggtaacccggttaaagggggttacggtaacgggttaccttaccggaaaaccggtacggttacggtcgggtaccgtacgtaccgtacccgtagttacctacggtttccgttacgtacctttaccccgg

SEQ ID NO: 221383 - DNA, 682 bp, Homo sapiens
  misc_feature: GYAE6OF02FJZG1.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaancgccaccctctcctgcagggccagtcagagtgttacgtaccgacttggcccttggtacccaggccaagaaaccgtggccagggcctcccgaggcctccgtacagttcctaagtcggtgacctacttcccgaacccgagggtccccaacgttcgggtaacctcccccggaagggtccccggtttcgaaggtcgggccgtaaggttcggggtccttaggggaccaggtacggttcacggtcctaccgaccacgtccgaagccacgtcctagacaaggagttacgaagtacgtttccgacttagtttaactttagttcgtccgtaagccgtaagttaataaacgttaacgttcggacccttccggtacttaccggtttcgggacggaacgggaccgtaagggtcgaacgtacgtaccgaaacggtactcgggtacggtactacggtacccacgttacgttaccgtcggtttacttaccgtacttccccg

SEQ ID NO: 221384 - DNA, 631 bp, Homo sapiens
  misc_feature: GYAE6OF02IO3Q9.36.43.D10.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctcaggcaccctgtctgtgtctccgaggggaaancgccacctctcctgcagggccagtcagagtgttacgtaccgacgttggcctggtaccagcaacgaaacctggccaggcctcccgaggtcctcctcatctagtggtnctactccgaccgacgggccacgtcggtactcccgaggtcccggtcaggtcggcgaggtcgggtcgtggggacaggtagttcacgtctcgaccagtcagcacgctgacagagtaggaagtcgtttcgactagttttaattagttcgtactagtacgtaaagttactaaacgttacgtcggtacccgttccggtacgttaaccggtttccgggaacgggtaacgggtaccgtaagggtacggaagtacgttaaccgaaaaccggtacgttacggcgggtactacggtaccgaacctagttaccgttacggttcttacccgtacttccccgg

SEQ ID NO: 221385 - DNA, 800 bp, Homo sapiens
  misc_feature: GYAE6OF02F4TF8.36.43.D10.1.454.CMB.1.raw
  modified_base (203)..(203): a, c, t, g, unknown or other
  misc_feature (203)..(203): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctccagatatcactggaagaaatagtgatgacgcagtcctccaggccaccctgtctgtcgtctacggaaggggaaacncgccctaccctctccgtgcgacgggccagtcaggtagttgttaacgtaccgtacgttggcccgttagggtaacccacggaccaacggtaaacccgtcgggacccgtacggtccctacccgaaggtcccttacccgtacgtacttacgttaggttacgggtacgtaccctacgtaccccgaaccggtaccggggtaccctaacggttaccggtaaccgtccccgggtaacgggttcccggttacgaacgggtcggtacggtagggttcgggtcgtagggacgtacggtacgtacgaccgtctaccgacctagtacgacgtccgcgtaccgtagagacggtacggttaagacgttacgtttcgtacgttaagttttacttacgttcgtacgtacggtacttaacgttaacgttaaaccgttaccggtcggttacccgttccggtaccgttacgggttaccgggacgggtaaccggaacgggttaacgggtacggtaacgttaccgtaaaaccggaacggttcggtacggttcggtaaccgtcgtaaccggtacccgttagttcccgttacgttacccgtttaccttacccggttcccgg

SEQ ID NO: 221386 - DNA, 829 bp, Homo sapiens
  misc_feature: GYAE6OF02JMFX4.36.43.D10.1.454.CMB.1.raw
  modified_base (201)..(201): a, c, t, g, unknown or other
  misc_feature (201)..(201): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcacgtggaagaatagtgatgacgcagtctcgaggcaccctgtctgtcgtcgtacggaagggaaanacgcccacctctccgtgacgacgggccagtcaggtagttacgttacggaccgtagttcggccgtagtaccagacaacgaacctggaccgacggccctaccgacggtccttcctacacgttacgttaggtcggtacgccgttacaccccgtaaccggacgggtacctaccggttacggtacctaccccgggaagggtccggttacgaacggttcggacgtacggttcgggtacgtacgggtaactaagggtacgttacgaccgtacctaacctacgtaacgtacgaacggtacccgacgttcccgaaggactaaacggggttaagtaacggttaaacggtttacgtttacgtaaccgtttaaggttttaacgttagttaccggtacgttaacggtaagttaaacgttttaaactaaccggttaacggttcccggttaacccggtttaccggttaaccggttaacggttccgggggaaaccgggtaacggaaccgggtttaagggacggttaacgaacgtttaacggtaaaaccggttgggttaacggttacggtaccgttaaccggtaccgtaccgtttaacggttaccggtttacggttccctttaaccgggtaccctttaccccggg

SEQ ID NO: 221387 - DNA, 755 bp, Homo sapiens
  misc_feature: GYAE6OF02IEKBH.36.43.D10.1.454.CMB.1.raw
  modified_base (197)..(197): a, c, t, g, unknown or other
  misc_feature (197)..(197): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctccagatatcactggaagaaatagtgatgacgcagtctccaggccaccctgtctgtgtctccgaggggaanacgcccaccctctccgtgcgagggccagtcaggagttgttaacgtaccgtagttcggccttaggtaaccaggtaccaaacggaaaccgtcgggaccgacgggccctccccgaaggtcccttccctactaacttccgttaagttcggtacgcctaaccgttaccccgaaccggtaccggggtaccctaacggttaccgggttacctacccccggtaacggggttcccggtttacgacgggtcggtaccgtacggggttcggggtccgtaggggaccgtaaggttacggttccgaacgtcctacgaacctacgtacgacgccgtaacgtccgtgacgtacgtagtaacgtagttacgtttcgactttaagttttacttagttacgtatagtacgtaagtaactaagttaccgtcggtcccgttaccggtacttacgggtttccgggaacggtacgggtaacgtagggtagtacgaccgttaaccgaacgtaacggttcggtcggtaacgttccgaccgttaccgtagttccgtttacgttaccttcctaccgtttccccg

SEQ ID NO: 221388 - DNA, 803 bp, Homo sapiens
  misc_feature: GYAE6OF02G63U3.36.43.D10.1.454.CMB.1.raw
  modified_base (198)..(198): a, c, t, g, unknown or other
  misc_feature (198)..(198): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggaagaaatagtgatgacgcagtctccaggcaccctgtctgtgtctccgaaggggaancgcccaccctctccgtgccgagggccagtcaggtagttcgttaacgtaccgacgtttcgggccttacggtaacccaggtaccaaacggtaaaacccgtggggacccctaacggggccccttaccccgaacggccctttaccccgtactaaccgtttcgttaagttcggggttaccgccttaaccgtcccgaaacccgggacgggtaccctacgttacgggtacctccccggtacgggttccgttacgaggtcggcgtaggtcgggtcgtaggggacagtcgtccgaacgtctaccacgtatcgacggactacggccgtagacgtaagtaggtacgtaaggttacgttcggttaagtttaagttttacgtttagttacgtaaccgtaggttaactaaacgttaagttaaaccttaaccggttcgggtacccgtttaccggtaccgttaaccgggtttaccggggaacgggtaaccggtaaacggtaacggggtacgtaaacgtacgtaaacccggtaaacgggttacgtcgggttaaccggtcctaccggtaacctacccgttaggttacccgttaccggtttaccttacgtaccctttcccccgg

SEQ ID NO: 221389 - DNA, 644 bp, Homo sapiens
  misc_feature: GYAE6OF02FPSCZ.36.43.D10.1.454.CMB.1.raw
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctccgaggggaaangccaccctctcctgcacgggccagtcagagtgttacgtaccgacttcggcctggtaccagccaagaaacctggccaggcctacccgaggcctcctcatctagtggtgcatcccacgaggccagtggtactcccgagggtcccggttnaggttcggagacggttggggttacgtaggggacctaggtacggtttaccacggtccttaaccgaaccctatccgaacgccgacgtccgtgaccgaggtacgtagaacgtatttccgacttagtttattacgttgacagtacaagttaataaacgttaaccgtcgggtaccttaccgggttattaacccggtttcgggaaccgggaacggtaaccgtaaggggtgaacgtacgtaacgaaacggtactgggtacggtctaccgacgtaccgtactcgttcgttacttccgtattaccccg

SEQ ID NO: 221390 - DNA, 630 bp, Homo sapiens
  misc_feature: GYAE6OF02GQWTX.36.43.D10.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaaanacgcccaccctctcctgcagggccagtcagagtgttagaccgacttggcctggtaccagcagaacctggccaggctcccgaggcctcctnactctatggtgcatcccacncgggccacgtcggtactcccgagggtcccgttnaggtcggctaggtgggtcnggggacnggtacgttcgacgtctacacctntccgagtccgacgcctgcaggagtagaagtcttcgacttagtttacttagttgtctagactagttaacttaagtaaccgttcggtacccgttccggttaccgttaccggttttaccggggacgggttaacgggtaaccgtaagggtcgggaacgtacgtaaccgaaacggtaacggttggttacggtacgttcgtactaaccgtacgttccgttacggtttcttacgtacctttaccccgg

SEQ ID NO: 221391 - DNA, 733 bp, Homo sapiens
  misc_feature: GYAE6OF02JWEYO.36.43.D10.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (338)..(338): a, c, t, g, unknown or other
  misc_feature (338)..(338): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggaagaaatagtgatgacgcagtctccaggcaccctgtctgtgtctaccgaggggaaancgccnccctntccngcagggccagtcaggagttgttacgtaccacgttcggcctggtaccngcaagaacctggccaggcctacccgaggcctcctcgactntacgtggtcacactcccaccgcggaccacgtcggtacnccccggtaggtcccggttacacggttcggacgtaggttcgggtcgtacgggactaggtaccgtttccgacgtcctccaaccgtcgtcaaggtccacgtccgtcgacgtacggtaacgtaggtacgtaacgtttcgtacgttaacgttttattacgtttcgtaccgtagtacgtaacgttaaagttaaccgttaacgttccgggttacccgttaccggttaaccgttaccgggttacgggtaccgggtaacgggaaacccggttagggtaacgggtacgttaacggtaaccgtaaaccgggtacggttaaccggtacgggtacccgttaccgtttaccggaacccgttacggttacccggtttacgtttaccgttaccgttaccgtttaaccccgg

SEQ ID NO: 221392 - DNA, 674 bp, Homo sapiens
  misc_feature: GYAE6OF02JLXKO.36.43.D10.1.454.CMB.1.raw
  modified_base (197)..(197): a, c, t, g, unknown or other
  misc_feature (197)..(197): n is a, c, g, or t
  modified_base (622)..(622): a, c, t, g, unknown or other
  misc_feature (622)..(622): n is a, c, g, or t
  modified_base (628)..(628): a, c, t, g, unknown or other
  misc_feature (628)..(628): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (670)..(670): a, c, t, g, unknown or other
  misc_feature (670)..(670): n is a, c, g, or t
tcagtacgctgtctcacgaccggtgctcgatttagactagcagtaaggggggaggaactgctcagttaggacccagacggaaccatggaagccccagcgcagcttctcttcctctgctactctggctccagatatcactggagaaatagtgatgacgcacgtctccaggccaccctgtctgtgtctcgaaggggaanacgccaccctctcctgacaggccaggtcagtgtagttcgtaccgacttcggcctaggtaccaggcaacggaaccgcgccgaaggcctccaggtcctcctcactcgtcgtaggtcgccataccccgacgtacgggcccacgttcggtaccgtaccccgagggttcccggttagtacgggttcggacggtcggtaggggtccgttacgggacgtacgggtacttccggacggttaccctaccgtacccgtaacgtacccgtaacggtaccgccggggtaaccctagggaccggaaacgtttaacgggtacggttaaacgttacgtttaaccgttacgtttaacgttttaatcgtttacggtacgacgttataaccggttaattacctaacgtcggtacctcgggtctacgtcgtagtgacgtaacgnggtacngtactagtaactggtctaggccttgactcgnttacgntactntacg

SEQ ID NO: 221393 - DNA, 735 bp, Homo sapiens
  misc_feature: GYAE6OF02FQE5F.36.43.D10.1.454.CMB.1.raw
  modified_base (196)..(196): a, c, t, g, unknown or other
  misc_feature (196)..(196): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaancgccaccctctctgccgagggccagtcagagttgttacgtaccgtacgttcggcctggtaccagacaacgaaacccgtggacccaggcctaccccgaggtccctccctcacttctagtgggtcgactactacccgaccgacgggtccctaacgtcggtaaccgtcccgacgggttccgttacgacggtcgtacgtagggttcgggtacgtacgggtacaggtacgtccgtacggtcctaccaacccgtagtaccgacgtaccacgtcccgtagaccgtaaggtacgttaacggaaacgttctttacggtactttaacgttttatttaacgtttggaccgtagtacgtaagttaaactaacgttaacgtccgggtacccgttaccgggttactttaccggtttaccggggaccgggtaaacggtaacccggtaaggggttacgaacgtacgtaacccggtaaacggttacggttaccggtacgtaccgtaggacccttaacgttcgttacgttacttcccgtttactcccgtttaccccg

SEQ ID NO: 221394 - DNA, 941 bp, Homo sapiens
  misc_feature: GYAE6OF02FTACK.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtgtctccgaaggggaagcgcccaccctctcctgcgagggccagtcgagagttgttacgtacccgtacttcggcccttagggaacccaggccgtaaacggaaaccccgtggacccagggcccctaccccgaggcccttccctcgacttacttagtcgggtcacctactaccccgaaccgacggggccctaccggttggtacctccccggtagggtcccggttacgaggtcggacgtacgggttcgggtccggtaggggacctagggtacgttcccgaacgtccctaccgaaccctagtaccgacgtacccgtaccggtacccttacggccgtaagggtaacgggttaacggtaaacggttaaccggttttaccggttaaccgttttaaccggttttttaaaggttttaaccgtttacggttaccggttaacggtaaccgtttaaaggtttaaaacgttaaaacgtttaacccgttacccggggtttaccccggttaccccgggttaacccgtttacccggggtttttacccgggggaacccgggggttaaacggggtaaaccccgggttaaagggggttaacccgggtaacggttaaacccggttaaacccggtaaaaacccgggttaaaccgggttaacggggttaccccgggttaaccggtaaccgggtacccccttaaacccggtttaacccgtttacccggtttaaccgggtttttaccccttttacccgggtttacccccgtttttaaccccccgg

SEQ ID NO: 221395 - DNA, 777 bp, Homo sapiens
  misc_feature: GYAE6OF02FXP54.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggccaccctgtctgtcgtctccgaggggaagacgcccaccctctcctgcgacgggccagtcagtagttgttacgtaccgtacgttggcccttggtaccaggccaacgtaacccgtggcccgaggcccttaccccgaggtccctcctctacttctagttcgggtcacctacgtcccgaaccggacggggcccctaaggttacggtacctcccggtaacgggtccccggtttacgagggttcggccgtagggttcggggcgttacggggacgacggttacgttcgaccgttctaccgtaaccgttaagttacgtccgaacgtcccgtacggacgaaggtaagtaacggtaagttacgtttccggtacgtttaacgttttagtttacgtttacgtacgtacgtacgtaaagttaacgttaaacttaaccgttcggtacccgttaccggttacgttaaccgggttttccgggaacggggtaaccggggtaaccggtaagggttaacgggtaacgttacgtaaccgtaaacggtaccggttcggtacggtccgttacgtaccgtaaccgttacgttaccgttacgttccgttaccgttaccgttcccgttacccg

SEQ ID NO: 221396 - DNA, 641 bp, Homo sapiens
  misc_feature: GYAE6OF02GRB2L.36.43.D10.1.454.CMB.1.raw
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctcgaaggggaaagcgcccaccctctcctgcgacgggccagtcaggagttgttacgtaccgtacgttcggccttgggtaccagaccaacggaaaacctcggaccgacggcctcccgacggcctcctcacttctagtggtgcactacccaccgacgggccacgtcggtacctcccgcggtccggttacaggtcggcgtaggtcgggtcgtagggacgagtacgtcacgctcactatcacgcgcgctgctagagtagagtattcgacgttatttattagttntacgtagtntagttataatacgtggtcccgttccggtactaccgtttcgggacggtacgggtaacgtaaggggtacgagtacgtaaccgtaaacggtacggttacggtacggtccgtaacgtacccgtaccgttacgttacccgttcggtttacccgtttaccgtacctttcccccgg

SEQ ID NO: 221397 - DNA, 803 bp, Homo sapiens
  misc_feature: GYAE6OF02JE6N3.36.43.D10.1.454.CMB.1.raw
  modified_base (146)..(146): a, c, t, g, unknown or other
  misc_feature (146)..(146): n is a, c, g, or t
  modified_base (203)..(203): a, c, t, g, unknown or other
  misc_feature (203)..(203): n is a, c, g, or t
tcagtacgctgtctcacgaccggtgctcgatttagactagcagtaaggggggaggaactgctcagttaggacccagacggaaccatggaagccccagcgcagcttctcttcctcctgctactctggcctcccagatatcactgganaaatagtgatgacgcagtctccgaggccaccctgtctgtcgtctccgaaggggaaanacgccctaccctctccgtgacgacgggccagtcgagtacgttagttaacgtaccgtacgttcgggaccgtaggtaccagtaccgaaacgtaaaccgtggaccgacggtcctacccgacggtccctcctactaaccgtacgttacggtggtagacctaccgtaccccgaccggacggcctacgtacggtacctacccgggacgggtaccggttcgtaagggtccggtaacggtacgggtttacggggtacggttacgggaacgtaacggtacggttacccgaacgttccaacgaaccctagtaccgacggaccgtcggacccgtagacgtaaggtacgggttaagaacgttcgtttaccggtaatttaacgggttttattacgggttaacgtaccgaaattaaccgggtaattttaaacgaaaccgtttaccgggttcccggggtaaccccgttttacccgggtatttacccgggggttaaccgggacggggtaaacgggtaaacgtaaggggtacgaacggtaacttaccgggaaacttgggtacggtcgaacgttcgaaccctggttaatcccggttactccttagtaccccttaccgg

SEQ ID NO: 221398 - DNA, 662 bp, Homo sapiens
  misc_feature: GYAE6OF02GXQ2T.36.43.D10.1.454.CMB.1.raw
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtctgtgtctccgaggggaagagcccaccctctcctgcgagggccagtcagagtgttacgtaccgacgttggcctggtaccagcagaaacctggaccaggcctcccgaggcctccgtcactctagtgggtcgcactcccaccgacgggcctacgtggtactcccgacgggtcccggttcgaggtggacgtaggttggggtcgtggggactaggtacgttcgacgtctaccgacctatccgagccgacgccgtgacgagtaggtacgaagttacgtttacgtacgttaagttttatttacgttagtaccgaggtactaagttaaacttaacgtaaccgtacgggttacccgttaccggttccttaacggtttcgggaccgggtaacgggtaccgtaagggtcggaagtacgtaacgtaaacggtacgtacggttacggcgtacgaccgtaccgtacgttccgttacgttccgttaccgtacttccccg

SEQ ID NO: 221399 - DNA, 654 bp, Homo sapiens
  misc_feature: GYAE6OF02IDKTQ.36.43.D10.1.454.CMB.1.raw
  modified_base (158)..(158): a, c, t, g, unknown or other
  misc_feature (158)..(158): n is a, c, g, or t
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagtacgctgtctcacgaccggtgctcgatttagactagcagtaagggggaggaactgctcagttaggacccagacggaaccatggaagccccagcgcagcttctcttcctcctgctactctggcctccagatatcactggagaaatgtgatgacgnagtctcaggcaccctgtctgtgtctaccgaaggggaaactcgcccaccgtctcctgcacgggccagtcagtacgtagtacgtaccgnttcgggaccttagggaccagccaagaacctggaccaggcctaccgaggctcctnactctaagngtacgctacnccgaacgcggtaccncgtacgtctacccgaggtccggttacaggtcggacgtaggtcgggtcgtggacgtaacggtcgttcaacgtcgtacaccgtactagacgtcgacgtccgtgaccgaggagtacgaatcgttcgactagtttacttagttcgacagtacgtaatactaacgtacgtacggtccgtaccgtcgtaccgtttcgggacgggaaccgtaacggtaaggttaggaaccgtacgtaaccgtaaaccgggttactcggttacggtctacccgggtaactaaccgttacgttaccgttacggtttaccttaccgttaccgtttccccgg

SEQ ID NO: 221400 - DNA, 798 bp, Homo sapiens
  misc_feature: GYAE6OF02I10RR.36.43.D10.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactggagaaatagtgatgacgcagtctccaggcaccctgtactgtgtctaccgaggggaaancgcccaccctctccngcgaggccagtcagngttagttaacgtaccgacgttcggcctaggtacccagaccaacggaaaccgtcggaccaacggccttacccgaacggtcccttccctacgaacttccgtagttacggttcgactacgttccccgaacccgaaccggggtacctaaccgttacgggtaacccgtccccggtaacgggtcccggttacgtacgggttacggacgtacggttacggggtccggttaggggaaccgtaagggtacggtttaccgaaccggtcccttaacccgaacccgaacttacggaaccggtaacctaccggtacccttacggaccctaagggtaaacggtaacggtaaacgttacgtttaccgacgtttaagtttttagtaacgtttgttaccacggttacgtaaattaataacgtttaaccgtcggtaccccgttaccggtacctttacggtttaccgggacggaaccgggtaaccggtaaaggtacgggtaataaccgtaccgaaaacggttaagttcggtacggccttacggacccttaagtccgttccgttacgttcttaccggtccctttacccg

SEQ ID NO: 221401 - DNA, 767 bp, Homo sapiens
  misc_feature: GYAE6OF02F6IV1.36.43.D10.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcactgganaaatagtgatgacgcagtctccaggcaccctgtctgtgtctccgaggggaaangcccaccctctcctgccgacgggccagtcaggtagttcgttacggtaccgtacttcggtccgtaggtaccagccaagtaaacctcggaccgacggtcctaccgacggcctaccctcacttactattggtcgacaccgttacccgaccggtacggacctacgtcggtaacctcccggacgggtcccgttacgacggttggaccgtaggttcgggtcgtacgggacaacggtcgtacgacgctaccacctataccgacgccgacgtccgtagaccaaggtacgtaaggaggtaattcggttacgtaacgttaaacttttagtttaacgttaaggttaaacttaaaacggttaaccttaaaccggacgggttacctaccccgggttactttacccgtaaccggttttaccgggaaccggggttaacgggtaaacccggtaaaggggtacggttaaagaccgggttaaactaacccgggtaacggtttcgggtaacgggttcccgtaccgtaacccgaccgttacgttaccggtttaccgttacccttaacgttacccgttcccgtttaacccc

SEQ ID NO: 221402 - DNA, 830 bp, Homo sapiens
  misc_feature: GYAE6OF02JKQU2.36.43.D10.1.454.CMB.1.raw
  modified_base (146)..(146): a, c, t, g, unknown or other
  misc_feature (146)..(146): n is a, c, g, or t
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
  modified_base (542)..(542): a, c, t, g, unknown or other
  misc_feature (542)..(542): n is a, c, g, or t
tcagtacgctgtctcacgaccggtgctcgatttagactagcagtaaggggaggaactgctcagttaggacccagacggaaccatggaagccccagcgcagcttctcttcctcctgcttactcgtggcctccagatactcactgganaaatgtgatgacgcgagtctcgaggccaccgtgtctgtctactcgaagggaaacngccctaacctcgtccgtaggcctacgggccctaggcctaaggtacgttacggttaccgtacccgaacttcggcctacggtaccaggtaccaacgtaaacccgnggtcccaacggtcccctaccggacggttacccttaccgtacctaacggttaccttacggtacgggttcgaaccctaaccgttaccccggaaccggtacggtaccccacggtttacgggtaccccttaccgggtacgggttaccccggtagtacggggtccgtaacggtacgggttgggtacccgttacgggaacttcggggtacttacccggtaaccgccttaacccggtaaccctanacccggtacgtaccgaaccggttccgaacggttacgaacggtacgtaaggtaaccgtacgtttacgacgtttacgttttaacgttgttaccgacgttacgtcgttaagttaactaaccttacgtacggtacccttggttaaaccgttccggttaacggggccgttaaacgggttacgaacgggttcgtaacgttcgaaaccgtaaggttaacccggtagttaaccggtacgtaccggacgttacctacgtttacccgttacgtaacccgtttatacccggtttacccg

SEQ ID NO: 221403 - DNA, 787 bp, Homo sapiens
  misc_feature: GYAE6OF02H0FRJ.36.43.D10.1.454.CMB.1.raw
  modified_base (158)..(158): a, c, t, g, unknown or other
  misc_feature (158)..(158): n is a, c, g, or t
  modified_base (202)..(202): a, c, t, g, unknown or other
  misc_feature (202)..(202): n is a, c, g, or t
  modified_base (664)..(664): a, c, t, g, unknown or other
  misc_feature (664)..(664): n is a, c, g, or t
  modified_base (744)..(744): a, c, t, g, unknown or other
  misc_feature (744)..(744): n is a, c, g, or t
  modified_base (773)..(773): a, c, t, g, unknown or other
  misc_feature (773)..(773): n is a, c, g, or t
tcagtacgctgtctcacgaccggtgctcgatttagactagcagtaagggggaggaactgctcagttaggacccagacggaaccatggagccccagcgcagcttctcttcctcctgctactctggcctcccagatatcactggagaaatagtgatgacnctagtctcgacggcctacccgtgtctgtgtcctacgaggggaanacgccacccgtcgtccgtggcgacgggccagtcgagtgtacggttacgtacgacgttggtccgttacggtaaccaggtaccgaacgtaaaccgtcgggaccacggtacctaccccggaaggtcccttacccactacgtacgttacgttcgggtacgacctaccggtacccgaccggaccggtccctaacggttaccggttaacccgtaccgggtaaccgggttcccggttacgtacggtcgggtactacggggttaccggggttccggagggtaaccgtacgttaacggttcccgaacgggttacctaacccgaacctacgttacgaccgtacggtacggtaccgtaaggtacccgaggtaacggtaacggtaaacgttcgtttaacgacgttttacgtttaaagttgttacgtacgaagttacgtaaattaacgttacgtacggtacgtaccgttaccggngtttaccgggtaggaccgggtaacgacgttaacgggacgtaaccgtagttaaacgacggttaaagcggttacgacgtacncccgtagttacgaccggttacgtctttanacccggtttacccg

SEQ ID NO: 221404 - DNA, 725 bp, Homo sapiens
  misc_feature: GYAE6OF02H8XL6.36.43.D10.1.454.CMB.1.raw
  modified_base (205)..(205): a, c, t, g, unknown or other
  misc_feature (205)..(205): n is a, c, g, or t
tcagtacgctgtctcacgaccggtgctcgatttagactagcagtaagggggaggaactgctcagttaggacccagacggaaccagtggaagccccagcgcagcttctcttcctctgctactctggcctccagatatcgactggaagaaattaggtgatgacgctagtctccgagccaccctgtctgtgtccgacggaaggggaancgccctacctcgtactggcgacgggcaacgtcgaggtattcgttaacgaccgtacgttcggacgttaccggaccagtacgtaacgtaaaccgtcggacctaggccgtacccgaacggtcctaccctacgtacgttaccgtacgtcggtacctacctaccgtaccgaccggacggtacctacgtacggtacctacccggtcggttacccggtgtacggtacggtcggtaacggttcgggtacgtacggacggtagtacggttccgaccgtacctacgtaccgacgttacgacgtacgaccgtacgtacgtaaggtaacggtaagtaacgttcgttacggtacgtttaagtttattacgttacgtacgtactacgtaaggttaactaacggtacctggtaccctcggtactacggttacgggacggtaacgtcggaaggtcgaacgttacgaacgtacgacgtcggtactcgtaacgtccgaacttacgttcgttacgttaccgtcgtacctaccgtcccgg

SEQ ID NO: 221405 - DNA, 695 bp, Homo sapiens
  misc_feature: GYAE6OF02GWDH2.36.43.D10.1.454.CMB.1.raw
  modified_base (198)..(198): a, c, t, g, unknown or other
  misc_feature (198)..(198): n is a, c, g, or t
  modified_base (268)..(268): a, c, t, g, unknown or other
  misc_feature (268)..(268): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatatcacgtggagaaatagtgatgacgcagtctccaggcaccctgtctgtgtctccgaggggaaancgccaccctctccgtgccagggccaggtcagtagtcgttacgtaccgactttgggcccttagggtacccnggtcagaaaccctggcctacggctacccgaggcctcctcatcctatggngcatccgaccagggccaacgtggtactcccngggccgttcagtggctacggtgggtcctaggggaccagacgtttcgacgtctacaccatcaacggtcaacgtccgttcgacctaggacggttaggaacgttacgtttacggactacggtttttaactttaggtttagtacgtagtacgtaagttaactaaacgttaacgttcgggtccccttaccggggttcctaaccggtttttacggggacgggttaacggggaacccgtaaggggttacgggtaacgtaggtaaccgaaaacggttaaccgtgggttaacggtccgttacggaccgtaccgttaacgtcccgtttagggttccctttaccgaacgtttccccgg

SEQ ID NO: 221406 - DNA, 770 bp, Homo sapiens
  misc_feature: GYAE6OF02F2SR9.36.43.D10.1.454.CMB.1.raw
  modified_base (208)..(208): a, c, t, g, unknown or other
  misc_feature (208)..(208): n is a, c, g, or t
  modified_base (374)..(374): a, c, t, g, unknown or other
  misc_feature (374)..(374): n is a, c, g, or t
tcagtacgctgtctcacgaccggtgctcgatttagactagcagtaagggggaggaactgctcagttaggacccagacggaaccatggaagccccagcgcagcttctcttcctcctgctactctggctcccagatactcactggaagaaatacgtagatgaccgctagtcctccgaggcacccttgtctggtctcctcgaaggggaaancgcccacctctacctgccgagggtccagtcagtagttgttacgaccgtagttcggaccgtaggtaccaggaccaacgtaaaccgtggaccacgggtcctacccgaggccttaccgtacagtctagttggtcgtaccgactccgaaccgcggcctacgtcggtaccnccggtagtccggttagacggtcgcaggttcggtacgtggaactggtacgttcacgtacgactactagagtacgctacgtccgtagacgtaggacgtaacgtagttacgttacgtacttaacgttttagttacgttacggtcgttaacggtacttaaacgttaaacttaaacggttaacccggttaccggttaccccgtttaaccgggttacccgttaacgggttacccgggtaccggggtaaacgggtacccggttaaagggttaccgggtaacggttaccgtaaaacggtaaaccggttaacggttccgggtaaccgggttaacgtacgggtacccaacccggttccttaaccggttaccggttttacccttaacccgttcgtttaaaccccccg

SEQ ID NO: 221407 - DNA, 614 bp, Homo sapiens
  misc_feature: GYAE6OF01CR0WK.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaagtggggtgagaaagatccagtgtagagattgtgatgacccagactccagtctcttgtctctccaccctggagagcaggcctccatcgtcctgcaggtctagtctgcgcctcctgcatacgtgacggatcgtcttccttttgtatttggtttctgcaggagaggcaggcccagtcctaccactaactcctagacttactatgaacgttcgcccgacccgtctctcgtggacgtcgaccagtacttagttcgttacgaggtcggtcgtcggtcgggtacgacggtaccgaacacggtaactccgtaaccgaacctaacgtaacgaaaaaccggacgggtacccggggtagggtaacggtaaccggtcggtaaaccgtacgtttacgggtttacggtaaacccgttttagttacccgttaggaccctaaggtcggtaacgtaaacgg

SEQ ID NO: 221408 - DNA, 499 bp, Homo sapiens
  misc_feature: GYAE6OF01BYN3Y.12.39.D06.1.454.CMB.1.raw
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (444)..(444): a, c, t, g, unknown or other
  misc_feature (444)..(444): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgcttcccttttgtattggtttcngcagngaggcaggccagtctccacaactcctgatctatgaagttcgccacccggctctcgtggagtcgcagatagtgttcagtggcgtggcggtcgaggcacagactctacacactagaaaacgnggaccgggtaggagagtacgacagtcgttagaactttatactgacagtgctaacg

SEQ ID NO: 221409 - DNA, 496 bp, Homo sapiens
  misc_feature: GYAE6OF01D5HCG.12.39.D06.1.454.CMB.1.raw
  modified_base (445)..(445): a, c, t, g, unknown or other
  misc_feature (445)..(445): n is a, c, g, or t
tcagatacgacgtacacgaccggtgctcgattttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtcctctcacccctggagagcaggcctccatgtcctgcaggtctagtctgcgcctcctgcatagtgacggatgccttccttttgtatttggtttctgcagagaggcaggccagtctccacaactctgatctatgaagttcgcccacccggctctctgggagtcgccagatatgttcagttggctggcgggtcaggcaacagatctcacactagaaaacnggccgggtagagaggtcgacatgttagaactttattactgacatgactaag

SEQ ID NO: 221410 - DNA, 511 bp, Homo sapiens
  misc_feature: GYAE6OF01DKO8Y.12.39.D06.1.454.CMB.1.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (430)..(430): a, c, t, g, unknown or other
  misc_feature (430)..(430): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctgtagagcaggcctccatgtcctgcaggtctagtctgcgcctctgcatagtgacggatgcttccttttgtattggtttcngcagagnggcaggccagtctccaacactcctgatctatgaagttcgcccgacccgtctctcgtggagtcgccagattatgttcgagtggcgtggcgggtcgaggcacagatcncacactagaaaacgacggaccgggtaggaggagtacgaccgtagtgttaggtaactttaagttactagactatgcgtaaag

SEQ ID NO: 221411 - DNA, 618 bp, Homo sapiens
  misc_feature: GYAE6OF01CAASP.12.39.D06.1.454.CMB.1.raw
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatgacccagactccagtctcttgtctctcaccctggagngcaggccctccatcgtcctgctaggtctagtctgccgtcctcctgcatgtgacggntcgtcttccttttgtattgttcngcagagngcaggccagtcctccaactactcctagtatctatcgtaagttccgacccgtacccggtcttacgtcgtgggacgtcgaccgtagtacttattcggttacgtaggtcgggtccgttcgggaccggggttacaacggggacctaacgtacggtaccttcctaaccgaaccgtaacgtaaaggaaaaacccgcggggtaccggggttagggaaacggtacggtacgaaccgttaggtttcggttaaacggttaaactttaacgttacgtaggactaacggtgaaccgtaaagg

SEQ ID NO: 221412 - DNA, 532 bp, Homo sapiens
  misc_feature: GYAE6OF01ESF7Y.12.39.D06.1.454.CMB.1.raw
  modified_base (519)..(519): a, c, t, g, unknown or other
  misc_feature (519)..(519): n is a, c, g, or t
tcagatacgacgtacacgaccggtgctcgatttagtgacatctcgcagttctttgggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatgacccagactccagtctccttgtctctcaccctggagagcaggcctccatcgtcctgcaggtctagtctgcgcctcctgcatagtgacggatgccttccttttgtatttggtttctgctagagaggcaggccagtcctccacactctgatctatgaagttcgccgacccgctctcgtggagtcgccagtatagttgttcagtggcgtggcgggtcacggcacagactctacacacgtaacgaaaacgcgggaccgggtaggaaggacggtacgaaccgtagttcggttaaggtaaactttagttacgtcgtanagttgacgtaaag

SEQ ID NO: 221413 - DNA, 498 bp, Homo sapiens
  misc_feature: GYAE6OF01CBTS9.12.39.D06.1.454.CMB.1.raw
  modified_base (318)..(318): a, c, t, g, unknown or other
  misc_feature (318)..(318): n is a, c, g, or t
  modified_base (438)..(438): a, c, t, g, unknown or other
  misc_feature (438)..(438): n is a, c, g, or t
  modified_base (487)..(487): a, c, t, g, unknown or other
  misc_feature (487)..(487): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcaccctggagagcaggcctccatgtcctgcaggtctagtctgcgcctcctgcatagtgacggatgctcccttttgtatttggtttcngcagagaggcaggccagtctccacaactctgatctatgaagttcgccaccggctctctggacgtgccagatatgttcagtcggctggcggtcgaggcacagatctacacactagaaaacncggacgggtaggagaggtgacctagtggttagtaacttagttactaganatgcgtaaacg

SEQ ID NO: 221414 - DNA, 561 bp, Homo sapiens
  misc_feature: GYAE6OF01AHA9P.12.39.D06.1.454.CMB.1.raw
  modified_base (294)..(294): a, c, t, g, unknown or other
  misc_feature (294)..(294): n is a, c, g, or t
  modified_base (324)..(324): a, c, t, g, unknown or other
  misc_feature (324)..(324): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactcagtctccttgtctctcacccctggagagcaggcctccatgtcctgcaggtctagtctgccgcctcctgcatgtgacggntgccttccttttgtattggtttctagcagngagcaggccagtcctcacactcctgtatctatagaacgtttcgcccacccggtcttcctcgtgggattcgaccagtattacgttgtttcgacggtggcgttcggcggggtccagggcctaacgagtctacgtaccaacaacgtaacgaaaaaccggcggtaccgggttaggaaggtacgttcgaacctaggtttcgttaaggtaacgtttattaacgtcgactagttgacgtaaacg

SEQ ID NO: 221415 - DNA, 556 bp, Homo sapiens
  misc_feature: GYAE6OF01B00D4.12.39.D06.1.454.CMB.1.raw
  modified_base (322)..(322): a, c, t, g, unknown or other
  misc_feature (322)..(322): n is a, c, g, or t
  modified_base (393)..(393): a, c, t, g, unknown or other
  misc_feature (393)..(393): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgaccagactcagtctcttgtctctcaccctggagagcaggcctccgatgtcctgcaggtctagtctgcgcctctgcatagtgacggatcgcttccttttgtattggtttctgcagagnggcaggccagtctccacaactcctgactctatgaacgttcgacccaccggctcgtcgtggacgtcgccagntattgttcgagtcggctggtaccgggtcgaggtccacgacggtacttcctacaacgtaacctaggaaaaaccgcgggtaccgggtagggaagacggtcggaaccgtacgttgggttaggttaaacctttacgttacgtaggtacctaagttgacgtaaaacgg

SEQ ID NO: 221416 - DNA, 649 bp, Homo sapiens
  misc_feature: GYAE6OF01BZ4PK.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatgagggaggggaatggggtgagaaagatccagtgtagagattgtgatgacccagactccagtctccttgtctctccaccctggacgagcaggcctccatcgtcctgctaggtctagtctgccgcctcctgctataggtgacggatcggtcctttcccgttttgtagtttcggtttctgcaggtaggacggcgacggccgtacgtcctaccccgaactaacctccctagtacttctagtgtaacgttcgaccccgacccggtccttcgtacgtgggtacgtcgtacccgtagtacgttagttcggtttaccgagggttcggtccgtacgggtccgggtaccgacgggtacctaacggaagtacttacccgtacaaccgtaccgtaaagaaaaccgcgggtacccgggtaggaacggtacgtacggtaaccgtagttcgggtttaacgtaaacctttaacggttaccgtagttaacctagtagtaccgtaaaagg

SEQ ID NO: 221417 - DNA, 630 bp, Homo sapiens
  misc_feature: GYAE6OF01DUOTR.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctccacccctggagagcaggcctccatcgtcctgcaggtctagtctgccgcctctgcatagtgacggatcgtcttccttttgtatttggtttctgctagagaggcgaggccagtcctccaacactcctgatctatgaagttcgccgacccggctcgtcgtggtagtcgaccgtaagtacttagttcgttcgtaaggttcgggtccgttcgggccggggttacgacgggtaccaaccgtaaggtaccttcctaaccaaccgtaaccgttaacggaaaaaaccggtaccgggtacccggggtaggaacggtaacggtaaccggtaaacccgttaggtttacgggtttaacggtaaaccttttaagtttaaccgttacggtactaacggttcgacgtaaaacgg

SEQ ID NO: 221418 - DNA, 664 bp, Homo sapiens
  misc_feature: GYAE6OF01CK72H.12.39.D06.1.454.CMB.1.raw
  modified_base (242)..(242): a, c, t, g, unknown or other
  misc_feature (242)..(242): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggagggaatggggtgagaaagatccagtgtagagtattgtgatcgaccagactccagtctcttgtctctcaccctggagngcgaggcctacatcgtcctgcaggtctagtctcgccgtcccctcgtcgactagtaggtcgacggtacttcgtaccttttcccgttttagttacgtttcggtttctggtacgaggtaggaggccgacggcctacgtcctacccgaacctaaccgtccctagtaactacgttacgtacgtaacggttccgtacccgtaccccggtccttccgtacgtacgggtacggtacgaccgtaagtattacgttcggttacgtagggttcgccggttcgggtccggtacgacggtccaacgtagtacttacctacgaacctaacggtaacgaaaaaccgcgggtacgggtagggaacggtacggtacggtaaccgtaggttacggttaacggttaaactttacgtacgtacgacgtaacgtgaacgtaag

SEQ ID NO: 221419 - DNA, 584 bp, Homo sapiens
  misc_feature: GYAE6OF01DBTRJ.12.39.D06.1.454.CMB.1.raw
  modified_base (323)..(323): a, c, t, g, unknown or other
  misc_feature (323)..(323): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatgacccagactccagtctccttgtctctcacccctggagagcaggcctccatgtcctgcaggtctagtctgccgcctcctgcatagtgacggatcgccttccttttgtatttggtttcngcagagaggcgaggccagtcctaccaacaacctcctgtactctatgaagttcgcccgacccggtctctcgtggtagtcgccaagtattagttcgttacgtagtcgggtcgtcggccgggtacgacggccaacgagactcctacaactaacgtaacgaaaaacgcgggtaccggggtaggaggtaacggtacggaacctaggtttacggttaacgggttaaactttaacgttaacgtacgtactaagtcggaacgtaaacgg

SEQ ID NO: 221420 - DNA, 547 bp, Homo sapiens
  misc_feature: GYAE6OF01DGZKG.12.39.D06.1.454.CMB.1.raw
  modified_base (195)..(195): a, c, t, g, unknown or other
  misc_feature (195)..(195): n is a, c, g, or t
  modified_base (400)..(400): a, c, t, g, unknown or other
  misc_feature (400)..(400): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagngattgtgatgacccagactccagtctcttgtctctccaccctggagagcaggcctccatcgtcctgcaggtctagtctgcgcctcctgcatagtgacgatcgtctttccttttgtactttggtttcctgcgagtaggcggcacgggccagttcctaccaccaacttcctgtactctatcgaacgttcgcccaccgctctcgtggntcgcagtattatgttcaggtggcgtggcggtacgacggcacgagtctcctacacctaacgtaacgaaaacgcggtaccgggtaggagacgtacggaacctaggttgttaacgggtaactttacgttacgtagctaagtcgctaaagg

SEQ ID NO: 221421 - DNA, 649 bp, Homo sapiens
  misc_feature: GYAE6OF01A3MLQ.12.39.D06.1.454.CMB.1.raw
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatggagggaggggaatggggtgagaaagatccagtgtagagattgtgatgacccagactccagtctccttgtctctcacccctggagagcaggccctccatcgtcctgcaggtctagtctgccnccctcctgcatagtcgacggntcgtcttccttttgtattggtttctgctaggaggaggcgacggcctagtcctaccaactaacctcctagtacttcgtattacgtaacgtttccgaccccgtacccggtcttccgtcgttagggacgtccgacctaagtacttagttcggttacgacgggttcgggtcggttacgggtcccggggttacgaacgggtaccctaacgtacggtaaccttcccgttaaccgaaacccttaacggtaaacggaaaaaccggtcggggtacccggggtagggaaacggtacggtcgaaccgttaggttcggttaagtaactttacgttactcgtactaggttcgacgtaaacgg

SEQ ID NO: 221422 - DNA, 635 bp, Homo sapiens
  misc_feature: GYAE6OF01C39RW.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatgagggaggggatggggtgagaaagatccagtgtagagattgtgatgaccagactccagtctccttgtctctcacccctggagagcagcctccatcgtcctgcaggtctagtctgcgcctcctgcagtagtgacggatcgtcttccttttgtattggtttctgcagagaggcaggccagtcctaccacaacctcctgtactctatagaagttcgcccgtacccggtcttccgtcgtcggtagtcgaccgagtattacgttgttacgaggttcggtccgttgggcccggggttacgacgggtaccaaccgtaaggtaccttccgtacctaaaccgtaaccgttaacggaaaaaaccggtaccggggtaccccgggggtagggtaaagggtacggttaacggaacccgttaaggttacgggttttaacggttaaaccgttttaagttaaccgttacgaccgtaagtacgtacgtaaaacgg

SEQ ID NO: 221423 - DNA, 537 bp, Homo sapiens
  misc_feature: GYAE6OF01DATO5.12.39.D06.1.454.CMB.1.raw
  modified_base (332)..(332): a, c, t, g, unknown or other
  misc_feature (332)..(332): n is a, c, g, or t
  modified_base (527)..(527): a, c, t, g, unknown or other
  misc_feature (527)..(527): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatcagtgtagagattgtgatcgacccagacctccagttctccttgtcctctccaccccgtggagagcaggcctccatgtcctgcaggtctagtctgcgcctcctgcatagtgacggatgtccttccttttgtattggtttctgtcagngaggcacggccagtcctaccactaactctgatctatagagttcgccacccgctctcgtggagtcgcagtatagtgttcgaggtggtcgtacggcgggttgacgggtcacaggtactctacaactaacgtaagaaaacgacggcgggtaggagaggtacgaactagttaggttacgtaatttacgttactacgtanatgagtaaag

SEQ ID NO: 221424 - DNA, 720 bp, Homo sapiens
  misc_feature: GYAE6OF01EAPV0.12.39.D06.1.454.CMB.1.raw
  modified_base (188)..(188): a, c, t, g, unknown or other
  misc_feature (188)..(188): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagagtggaggggaggggaagtggggtgaagaaagntccagtgtagagtattggtgatcgacccagtacctccagttcttccttgtcctcctccacccgtggagcgcgacggtccctaccatcgtcctgaccgtaggtctacgtcgtcgccgtccctctcgactagtaggtcggacgtactcgtcctttccgttttgttatttggttctgcgaggagtacggcgaggccctaggtcctacccaaacttacctacccgttagatttacctaagtcggttaacgttcccgacccggtacccgtcccgtacgttcggtacgggtacgtaccgtacccgtaaggttaaccttagttccggtttacggacgggtttacggggtccggttacggggtacccggggttacaagggtacccggttaacaacgggttaccttaccggtaaacctaaccggtaaaccgtaaacgggaaaccgtacggggtacccgggtaggtaacggtaaggtaacccgtaagtacggttacggttaacgtaactttaacgtcgtaacgtactacgtgtactaaacgg

SEQ ID NO: 221425 - DNA, 580 bp, Homo sapiens
  misc_feature: GYAE6OF01EOAH0.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaggagatgagggagggaatggggtgagaaagatccagtgtagagattgtgatgacccagactccagtctccttgtctctcaccctgtagagcacggcctccatgtcctgcaggtctagtctgcgcctcctgcatagtgacggatcgtcctttccttttgtatttggtttctgctagagaggcacggccagtcctcaactaacctcctagattctatgtaacgttcgcccgacccggcttctcgtcggtagtcgactagtaattagtcgtttacgaggtttcggccgttggtccttgggtcgaccgggacaacgtagtactaccgtaccctaacgaacgttaaacggaaaaacgtcgggacccggggtaggaaggtaacggtacgacccgtagttaggttacgtaaacgttattaacgtagctagtgaacg

SEQ ID NO: 221426 - DNA, 490 bp, Homo sapiens
  misc_feature: GYAE6OF01BY0WB.12.39.D06.1.454.CMB.1.raw
  modified_base (437)..(437): a, c, t, g, unknown or other
  misc_feature (437)..(437): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttcgccacccggctctctggagtgccagatatgttcagtggctggcgggtcaggcacagatctcacactagaaaacnggaccgggtggagagtgaccagtgttaggaactttattactgacatgctaaag

SEQ ID NO: 221427 - DNA, 577 bp, Homo sapiens
  misc_feature: GYAE6OF01C6CHV.12.39.D06.1.454.CMB.1.raw
  modified_base (189)..(189): a, c, t, g, unknown or other
  misc_feature (189)..(189): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagatacgacgtacacgaccggtgctcgatttagtgacatctcgcagttctttggggactgatcaggactcctcagttcaccttctcactatgaggctccctgctcagctcgttggggctgctaatgctcgtgggtccctcgtaaggacagaaggagatggaggggaggggaatggggtagagaaagntacagtgagagattgtgatcgaccagactcatctctgtctctcaccctggagagcaggtcctccatcgtcctgcgtaggtctagtctcgcgcctcctgcaagtgtagacggtatcgtcttcccttttgtattcggttctgcagagaggctacgggacctgtccacacaactctagatcgtanagaagttcgaccacccggtntctcgttaggagtcgactaaggtatagttgttacgagtggcgttcggcggtcgacggcaacggatacgttccagaaccaacgtaacgaaaaacggcggtaccggggaggtaacgagggtaccaaacgttaggttacgggtttaaacgttaacgttaacttacgtacgataacgtagaacgtaaagg

SEQ ID NO: 221428 - DNA, 653 bp, Homo sapiens
  misc_feature: GYAE6OF01DFGOL.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggaggggaggggaagtggggtgaagaaagatccagtgtagagtattgtgatgacccagactccagtctcttgtctctccacccgtggagagcacggccctccatcgtcctgcgtaggttctagtctcgccgtcctacctgctagtagtcggacgtatcgtccttccttttgtatttggtttctgcagagacggtcgacggtccacgttccaccaacaaccttctacgtacttcgtagtacggtaacgttccgacccgtacccggtcttccgtcggtacgggtagtccgaccgtaagtagttacgttcggttacgtacgggttcggtaccggtcgggtaccgggtacgacggtaccgtaacgtacgtaccgttacctaaccgtaaccgtaaaccgtaaacggaaaaccggtcgggtaccggggtaggaacgtacggtacgacgttaggttcggttaacggtaactttacgtacgtagtacgtagtagacgtaacgg

SEQ ID NO: 221429 - DNA, 698 bp, Homo sapiens
  misc_feature: GYAE6OF01BKGDK.12.39.D06.1.454.CMB.1.raw
  modified_base (326)..(326): a, c, t, g, unknown or other
  misc_feature (326)..(326): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatcagtgtagagattgtgatgacccagactccagtctccttgtctcctccacccctggagagcaggcctccatcgtcctgctaggtctagtctgccgcctcctgcatagtgacggatcgtcttccttttgtactttggtttcngcaggtagacggcgaggcctacgtcctacccgacaaccttcctagacttccgtaagtggtaacgtttccggacccctaccccgggtccttccgttcgtacgggtacgtaccggtcccgtaaggtaattacgttcgtttcgtaacgggttcgggtccggttacggggtccggggttaccgtaacggggaccctaacggtaacggtacgttaccccgtaaccgtaaaccgtaaaccgtaaacggtaaaaaacgccggggtacccgggggttagggaacgggtaacggtaccggtaacccgtaaggtttacggtttaaacggttaaaccttttaacgtttaccgtaggtaccgtaacgttacggaacgtaaacgg

SEQ ID NO: 221430 - DNA, 682 bp, Homo sapiens
  misc_feature: GYAE6OF01DWUEC.12.39.D06.1.454.CMB.1.raw
  modified_base (272)..(272): a, c, t, g, unknown or other
  misc_feature (272)..(272): n is a, c, g, or t
  modified_base (327)..(327): a, c, t, g, unknown or other
  misc_feature (327)..(327): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggagggaagtggggtgagaaagatccagtgtagagattgtgatgacccagactccagtctcttgtctctcaccctggagagcaggcctcatcgtcctgcaggtctagtcngccgtcctcctgcagtagtcgacggatcgtccttcccttttgtagtttggtttcngtacgaggaggacgcgaacgggcctacggtcctaccaaactaacctccgtagtacttactaagttacgtaacggtttccgacccgtacccggtcttccgttccgtagggtacgtcgtacccgaagtaacgttacgttcgtttacgtagggttcgtcggtttcgggtaccgggttacgacgggaacctaacgtaacggtacctttaccgacctaaaccgttaaccgtaaacggaaaaaccgtaccggggtaccggggttaacggaaaggtacggtaccggttaaacccttaggtttaacgggttacgttaaacgtttacgtttaaccggtacggtactaacgtacgtaggtaaacg

SEQ ID NO: 221431 - DNA, 685 bp, Homo sapiens
  misc_feature: GYAE6OF01DJ6M4.12.39.D06.1.454.CMB.1.raw
  modified_base (342)..(342): a, c, t, g, unknown or other
  misc_feature (342)..(342): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggaagggagggaatggggtgagaaagatccagtgtagagattgtgatcgacccagacctccagtctccttgtctcctccacccgtggagagcacggcctccattcgtcctgctaggtctacggtctgccgccttcctgctataggtcgacggtatcgtcctttccttttgttatttcggtttcngctaggaggaggccgtaaggcccaacgttcctaccgaactaacctccctagacttctaacgtgtaacgttcgccccgtacccggtctccgtcgtcgggtacgtcgaccagtagttattcggttacgacggtggtccgtgggtccgggtcgaacgggcaacgtaggtacttaccgtacgtaaacctaacgttaacgggaaaaacgtacggggtacccgggggttagggtaacgggtaacggttaccggtaaacccgttaaggtttaacggggtttaaacgggtttaaaccttttaaacggtttaccgttaacggtaacctacggttacggaacccgtaaaaggg

SEQ ID NO: 221432 - DNA, 858 bp, Homo sapiens
  misc_feature: GYAE6OF01CUSIM.12.39.D06.1.454.CMB.1.raw
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgaagaaagatccagtgtagagtattgtgatcgacccagacctccagttcctcttgtctctccaccctggagagcagcctccagtcgtcctgcgtaggtctagtctcgccgtcctcctgctagtacggtcggaacggtntcgttcctttccgttttgttagtttcggtttctgacaggacgnggcgacggcctacgtccacctacaacttccgtatacttcttaatacggtaacggttcccgacccgtaccccggtccttaccgtcggtacgggtacgttccgggaaccgttaagtacgttttacgttacggtttaccggtaacggggttcgggtaccggttaccgggggtaccccgggggtttaaccgggaaccgggggttaaccgtaaacccgggtaacggttaaacccgtttccccggttaaacccgtaaacccgttaaaaacccccgggtttaaaagggaaaaaaaacccccggggttcggggggtaaaccccggggggtaaggggaaaaccgggttaaccggtttaaacccggggtaaacccggtttaacggtttttaaaccggggggttttaaaacccgggtttttaaaaaccgttttttaaccgggttttaaacccgtttaaccgggtaaggttttaaaaacccgggtcgggtaaaaccccggttaaaaacgggg

SEQ ID NO: 221433 - DNA, 599 bp, Homo sapiens
  misc_feature: GYAE6OF01DB2LP.12.39.D06.1.454.CMB.1.raw
  modified_base (184)..(184): a, c, t, g, unknown or other
  misc_feature (184)..(184): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
tcagatacgacgtacacgaccggtgctcgatttagtgacatctcgcagttctttggggactgatcaggactcctcagttcaccttctcactatgaggctccctgctcagctcttgggctgctatgctctgggtccctcgtaaggacaggaaggagatggagggaggggaatggggtgagaaagntccaggtgtagagtattgtgatcgacccagactcagtctcttgctctccaccctggagagcagcctccatgtacctgcgtaggtctagtctcgcgcctcctgcagtgtggacgatcgtacttcctttgtattggttcngctagagngcacggtacctagtccgtaccactaacctccgtagtatcgtatacgtaacgttccgcccgtaacccggcttcgttcggtaggtacgtcgacctaagtacttattcggttacgaggtcggtcgtcgggcgggttacgaccggtactaacgtacgtaccttccgacgtaactaacgtaaacggaaacgtacggtacggggagtacggaggtacgaaccgttaaggttcggttaacgttaacttacgttacacgtatacgcgtacgtaaacg

SEQ ID NO: 221434 - DNA, 621 bp, Homo sapiens
  misc_feature: GYAE6OF01A6T48.12.39.D06.1.454.CMB.1.raw
  modified_base (324)..(324): a, c, t, g, unknown or other
  misc_feature (324)..(324): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtcccgcgtaaggacagaaggagatgagggaggggaatggggtgagaaagatccagtgtagagattgtgatcgacccagactccagtctccttgtctcctccacccctggagagcacggccctccatcgtcctgctaggtctagtctgccgccctcctgctagtagtgacggatcgtcctttccttttgtntttggtttctgcagaggacgcgacggccacgtcctacccacctactcctagtatactataggtaacgttccgacccgtacccggtcttaccgtcggtgggacgtcggaccgtaagtattacgttcggttacgtaggtcggtcgttcggggtcgggtacgacgggtaccgacgacgtacttccgtacctaaccgaacgtaaacggaaaaaccggcgggtaccggggtagggaagtacggtacgtaacgtaggttacggttaacggtaactttacgttacgtagatagtgaataaacgg

SEQ ID NO: 221435 - DNA, 909 bp, Homo sapiens
  misc_feature: GYAE6OF01D107S.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttgggctgctaatgctcgtcgggtccctagtaaggacaggaaggagagtgggaaggggaggggtaaggtggggtagaaggaaagactacgtaggtgtaagagtagttggtagactaccgaaccgacgtacctccgtacgttccttcctttcgtccttcctacccgacccggtagggacgacgaccgaccggtccctaccgtacgttccgtccgtcggacgttacggttacttacggttccgtccggtccccgttcccgttccgtgtaccgtaagttacgggtacggtaacggtactttccgtttcccgtttttccgtttttaggtttacgtttttcggttacgtacgtacgggtacggaacgggacggtaccgtaccggtacccgttacgttaccctaaccccgtaaaccgtaccctttcgttacgtacctttaacgtacggttacgttaacccgttcccggaccccgttacccggtcgttaccgttcggtaacgggtacgtacccgtaagttaacgtttacgttacgggtttcggttacgggacggtttcggggaccggtttaccggggaccggggttaaccaaacgggtcccgtaaacggttaacccttacgtaccccgtaaaccgaaccggttaaaaccggtaaacgggaaacccggggtacgggggttacggggtaaaggaaaccggtttacggtaaccccggttaaggtttacggtttttaaaccgggtaaaccgtttaatttaacccggtacggtactaaccgtttaaacgggaccggtaataaacgggg

SEQ ID NO: 221436 - DNA, 620 bp, Homo sapiens
  misc_feature: GYAE6OF01A6GNQ.12.39.D06.1.454.CMB.1.raw
  modified_base (342)..(342): a, c, t, g, unknown or other
  misc_feature (342)..(342): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaagtggggtgagaaagatccgagtgtagagattgtgatcgacccagactccagtcctccttgtctctccaccccgtggagacgcgacgcctccatcgtcctgcaggtctagtctcgccgcctcctgcatagtcgacggatcggtcctttcccgttttgttagtttgggtttcngtcgtaacggaggacggcgacgggcctacgttcctacccaactaaccttcctagtacttcgtaagtacggtaacgtttccgaccccgtacccggtccttccgtcgtacgggtacgtcgacccgtaagtcttagttcgttacgaggttcggcgtggtccgggtcacggcaacgacgtactccttacaactaacgtaaacgaaacgtcgggtaccgggagaacggagtacgtacgtaggttcggtaagtactttaactcgtacgatacgtcgtaagaacg

SEQ ID NO: 221437 - DNA, 615 bp, Homo sapiens
  misc_feature: GYAE6OF01B2IQT.12.39.D06.1.454.CMB.1.raw
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (460)..(460): a, c, t, g, unknown or other
  misc_feature (460)..(460): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggaggggaggggaatggggtgagaaagatccagtgtagagtattgtgatcgacccagactccagtcctccttgtcctctccacccgtggagagcgacggccctccatcgtcctgcgtaggtctagtctgccgcctcngcatagngacggtntcgtccttccgttttgtagtttcggtttcngcgaaggtacgacggcgacggcctacggtcctaccaaccgtaccttcgtgtacttactagtacgtaacgttccgacccgtacccggtcttcgtcgtggacgtcgacagtatcgttgttcgngtcggtcgtggtcgggtacgaggcctaacgacgtacgttcctacgaactaacgtaacggaaaacgcggggtacggtaggtaaggtacgtacgtaacgtaggtttacggttaacgttaactttacgttaacgtacgtacgtagtacgaagtaacgg

SEQ ID NO: 221438 - DNA, 787 bp, Homo sapiens
  misc_feature: GYAE6OF01B8WJ2.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagtattgtgatcgaccagactccagtcctcttgtcctctccacccgtggagacgcgacggtccctaccattcgtcctgacgtaggtctagtctcgccgtccctcctcgctagtcggtacggacggtacttcggttaccttttcccgttttttaggttacgttttcgggtttttcctggaccgtaagggaacgggacgggtaccgaaccggggtacccctacggttacccctaccccgtaaaccgtaaccgttcccgttagtaactttaccgttaagttacggtaaacggtttcccgaccccgttacccccgggtctttacccgttcgggttacgggacgttaccgtaacccgtaaagtttagtttacgttcggtttacggtaggttaccgggtcggttaccgggtccgggtacgaccgggtactaaccgtaacggtacttacccaacgtaaacccaaacggttaaacggaaaaccggccggggttaaccggggtagggaacgtaacgggtacgttaaccgtaggtttaaccgggtttaacggttaaacccttttacggttaccgtagtaccgtaacggtacgaagtaaacgg

SEQ ID NO: 221439 - DNA, 651 bp, Homo sapiens
  misc_feature: GYAE6OF01ETTT2.12.39.D06.1.454.CMB.1.raw
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatgggggtgagaaagatcagtgtagagattgtgatcgacccagactccagtctccttgtctcctccacccctggagagcacggcctccatgtccngcaggtctagtctgcgtcctccngcagtagnggacggatcgtcctttccttttgtagtttcggtttctgacgtaggaggaggcgaggccctacgtcctaccaacctaaccgtcctagtactctagtagtaacgttcgcccgtacccggtcttcctcgtggtacgtcgacctagtaattagttcgttacgagttcgggtcgtcgggtccgggtcgacgggacaacgtacgtacgttacctaccaactaaccgtaaaacggaaaaaccggtccggggtacgggggttacgggaaaggtacggtaaccggtaacccgttaaggtttaccgggttaaacggttaaacttttaacgttaacggtacgtaccgtaagttacgaacggtaaagg

SEQ ID NO: 221440 - DNA, 720 bp, Homo sapiens
  misc_feature: GYAE6OF01BQIKB.12.39.D06.1.454.CMB.1.raw
  modified_base (203)..(203): a, c, t, g, unknown or other
  misc_feature (203)..(203): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtagagaaagatccagtgtagagattgngatgacccagactccagtctccttgtctccgtccaccccgtggagacgcgacggccctcctagttcgtacctgccgtaagggttccttacggttctcggcccgtcccttcccgtacggactagtaacggtcgacgggtatcggtacccttttcccgtttttagttacgttttcggttttctcggacgtaggtaggacgggtccacgggtccctacgttcccgtacctaaaccaacgttccctagtaacttcgttaagtacggtaacgtttcgaccccgtacccggtcttaccgttacgtggacgttacgaccgagtaacttcgttagtttaccgaaggtttcgggtacttcggggtcccgggtcaacgggtcaacctaggtaccttaccgacctaactaaccgaacgaaaaccgtcggggtacccgggtagggtaacggtcgtaaccgggtacgtacggttttaggtaaccgggttaaactttcggttaactcgggtaactacgtacgaagtaacgg

SEQ ID NO: 221441 - DNA, 654 bp, Homo sapiens
  misc_feature: GYAE6OF01A7A4R.12.39.D06.1.454.CMB.1.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctgtaaggacagaaggagatggagggaggggaagtggggtgagaaagatccagtgtagagattgtgatcgacccagactccagtctcttgtctctcaccctggagagcacggcctcatgtcctgacaggtctagtctgcctcctcgtgcctagtaggtcggaacggnttcgccttttccgttttgtagtttcggtttnggtacaggtagaggtcacgggctacgtctaccacactcctgattctatacggtacgttcgaccctaccggtctctcgtaggtcgtcggaccagtacgttagttacgtttacgacggttcggtaccttcgggaccgggttaccggtaaggtcccgaaactacgggtaacctttcccgtaaccgtaaacgtaaccggttaaaccggaaaaacgtccggggtaacccggggtaaaggggtacggtaaacggttaccggaaccgttaggttacgggttacggtaaactttacgttacggtactacggtagtcgaacgtaaagg

SEQ ID NO: 221442 - DNA, 626 bp, Homo sapiens
  misc_feature: GYAE6OF01EQAS2.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggaggggaggggaagtggggtgagaaagatccagtgtagagattgtgatcgaccagacctccagtctccttgtcctcctccaccccgtggagacgcgacggccctccattcgtcctgctggtctagtctcgcgtccctccgtgcagtagtgacggtatcgtcctttccctttttgtagtttggtttctgtcgaggacggagcgacggcctagttcctaccgaactaacctctgtatcctagtacgtaacgttcgacccgtacccggtcctcgttcgtggtacgtcgacctaagtactttagtcgtttacgaggttcgggtccgtcgggtaccgggtcgacgggtacacgacgtactctacctaacgaactaaacggaaaccggcgggtaccgggtaggtaacggtacgtacgtaacgtaggtttggttaacgtaaactttagttaccgtacgacgattcgagtaaacg

SEQ ID NO: 221443 - DNA, 774 bp, Homo sapiens
  misc_feature: GYAE6OF01BG4F8.12.39.D06.1.454.CMB.1.raw
  modified_base (342)..(342): a, c, t, g, unknown or other
  misc_feature (342)..(342): n is a, c, g, or t
tcagatacgacgtacacgaccggtgctcgatttagtgacatctcgcagtttctttggggactgatcaggactcctcagttcaccttctcactatgagctccctgctcagctcttggggctgctaatgctcgtgggtccctcgtaaggacagaaggagatgagggaggggtaatggggtgaagaaagatccgagtgtagagtagttgtgatcgacccagacctccgagttccttccttgtcctcctcccaccccgtggacgacgcaccggtccctcccagtcgtcccgtgacgtaggttctagtctcggccgtccctacctgcgtagttaggcggtaacggtntcggttcccttttcccgtttttaggttagttttcgggttttgcgtacgacgggaggacggacggaccggtacccgtagttcccctacccaaacctaacccgtttctacgttaactactttaagtacggttaaccgtccgtacccccggtaccccggtctttaccggttaacggtcggggtaccgtaccgtaccgtaaagggttacttaacggtttcggttaacggtacgggttcgggtccggtcggggttaccgggcgtaccggaccgtaacgtacggtacttaccactaaccgtaaacgtaaaccggtaaaaacggtccgggtacggggtacggtaagggtaacggttacccggtaacgttaggttacggttttaaaccggttaaccgttttaacgttacggtacgacgtttagtacggtaaccgtaaagg

SEQ ID NO: 221444 - DNA, 739 bp, Homo sapiens
  misc_feature: GYAE6OF01BVLUW.12.39.D06.1.454.CMB.1.raw
  modified_base (313)..(313): a, c, t, g, unknown or other
  misc_feature (313)..(313): n is a, c, g, or t
tcagatacgacgtacacgaccggtgctcgatttagtgacatctcgcagttcttttggggactgatcaggactcctcagttcaccttctcactatgaggctccctgctcagctcttggggctgctaatgctctgggtccctcgtaaggacagaaggagagtggagggagggaagtgggggtagagaaagatccgagtgtagagtattggtgagtcgacccgagactccagttcctccttgtcctcctccaccccgtggacgacgcgacggccctaccagttcgtcctgcgtaggtcttagtcctgccgccttcngactagtaggtcgacggtatccggttcctttccgtttttagtagtttcggtttcttcggagaaggtagggacggcggacggtccgtaccgttccctaacccgtacctaaccgttccttaacgtgttaccttaggttacccgtaagttcccgaccccggtacccgtctacgtcggtagacgtcgaccgtagtacttacgttgtacgtacggtcggtccggtcgggtaccgggtacgaggtacccgacgtaagtacccgttacgacccgtaaacgtaaccggtaaaaccgtaaaccgggaccgggggttaccggggtacggaaaggtttcggtaaaccgtacccggtttaaagggttacggttaaccgggtttaaatttaccggtttacggaaccggttaccttaacgggtaaacgtaggtaaacggg

SEQ ID NO: 221445 - DNA, 689 bp, Homo sapiens
  misc_feature: GYAE6OF01CLHKT.12.39.D06.1.454.CMB.1.raw
  modified_base (348)..(348): a, c, t, g, unknown or other
  misc_feature (348)..(348): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatcgacccagacctccagttcctccttgtcctctccaccccgtggagcgcgacggtccctccatcgtcctgctaggtctagtctgccgtcctctgctatggtagacggattcgtccttttccgttttgttacgtttcggtttcgngtacgtaaggacgacggcgacggtcctacggttcctaacccgaacctaaccgttccctgtaaactttcgtagttacgtaacggtttccgaccccgtacccggtctaccgttcgtacggtacggtcgacccgtaagttacgtttacgttacgttacgtacgggttcggtcgtttcgggtaccgggtacggacggacctaacggacgtaccgtacgtaaccaaccgtaaaacggtaacgaaaaaccgtaccgggggacgggtacgggtaagtaaccggtacgacgtttaaggttacggttaacggttaaactttacttacgtacgactagtcgtaaacgtaag

SEQ ID NO: 221446 - DNA, 721 bp, Homo sapiens
  misc_feature: GYAE6OF01EKGY0.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttgggctgctaatgctctgggtccctcgtaaggacagaaggagagtggaggggagggaagtggggtagaagaaagagtccgagtgtagagtagttggtgagtacgacccagacctccacgttccttccttgtcctcctcccgacccgtaggacgacgcgacggtccctaccacgttcgtcctgacgtaggtctacgtcgtcgccgtcctcgtgactagtaggtacggacgtacgttccgttccttttccgtttttgttagttttcggttcgtacgacgaaggtaggacggcgacggaccctacgtccacccaacctacctcgtacgtacttacgtaacgtagttaaccgtccgacccgtacccgtcttacgtcgtacgggtactaccgtaccgtaagttacttacgttcggttacgtagggtcggtcgttcggggtacccgacggtaacggccgtaacgacggttacttacccgaaccgtaaaccgttaaagggaaaacccgtaaacgggtcggggtaacccgggtaggaaccggtaaaggtccgtaaacgttagggttacgttaaacgttactttaacgtcgactaagttaactacgaacgtaacgg

SEQ ID NO: 221447 - DNA, 648 bp, Homo sapiens
  misc_feature: GYAE6OF01BA33Q.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcaccctggagagcaggcctccatgtccctgcaggtctagtctgcgcctcctgcataggtcgacggtatcgcctttcccttttgtatttggtttctgacagaggacggcgacggcctaagttcctacccacctaacctcctaggtacttacgttagtaggtaacgtttccgaccccgtaccccgggtccttaccgttcggtaggtacggtacgaccgtagtaagttacgttcggttagtaacgggttcggtacgttcgggtccgggtaccgaggtaccacggacgtactaccgttacaaaccgtactaacggaaaaaccgcggggtacccgggttagggaggtaacggtccgtaaccgtaagttcgggttaacggtaaaccttttagttaccgtagtaccgtaattcggaataaacgg

SEQ ID NO: 221448 - DNA, 813 bp, Homo sapiens
  misc_feature: GYAE6OF01CZU37.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttggggctgctaatgctcgtcgggtccctcggtaaggacaggaaggagagtggaaggggaggggtaagtgggggtagaaggaaagactccgaggtaggtaagagtattgtagactcgaccagactccgtagttccttcttgtcctctccgacccgtggagacggccgacggtcctcctagttccgtaccgtggccggttaacggttccgttacgtccgtcggtcccgtacccttccgtcggtaccttaagtacgggtacggtaacgggtacgtttccggtttcccgttttttacccgtttttaggtttacggtttttaccgggtttcgtacgggacggtaagggaacggtaacgggtaccgaaccgggttaccgaccggttaccctaaccgaaacccgtaccttaccggtagtactacgttaagtacggtacggttcccgacccgtacccggtcttacgtcgtacggtacgttcgacggtacgtacgttagttcgtacggtacgtcgggtcggtcgggtaccgggtcgaacggaacacggtaataccgttaccgtaacctaacgtaaaccggtaacgaaaaccgggcggggtaacgggtacgggaaggttaccggtacggtaaacgttacgggtttacggttaaaccgtttaaacgtttacgttaacccgtaggtacgtaacgtacggtaagtaaacggg

SEQ ID NO: 221449 - DNA, 684 bp, Homo sapiens
  misc_feature: GYAE6OF01BEB5S.12.39.D06.1.454.CMB.1.raw
  modified_base (362)..(362): a, c, t, g, unknown or other
  misc_feature (362)..(362): n is a, c, g, or t
  modified_base (672)..(672): a, c, t, g, unknown or other
  misc_feature (672)..(672): n is a, c, g, or t
tcagatacgacgtacacgaccggtgctcgatttagtgacatctcgcagttctttggggactgatcaggactcctcagttcaccttctcactatgaggctccctgctcagctcgttggggctgctaatgctcgtgggtccctacgtaaggacagaaggagagtagggaggggagggtaagtggggtagaagaaaacgagtcaggtgtaggagtattggtgactcgaacccagacctccgtacgttccttccgtttcgtccttacctacccgaccccgtagggacgaacggccgaaccggtcccttaacctcgttcggtccctcggacgttaacggttcctagttctcggcctccctcgtacgntaagtaggcgacggtctcgttccttttctttagttgttgttcaggcgaggtaggacggacgaccgtcgacttccaccgtaactaccttgtagtacttacgtagtaacggtacgttcccgacccggtccgtcttaccgtggtacggtacgagtacctaaagtcgtttagtcggttacgcgtcggtcgtaacgggtcgggtacctaaggcaacggttacacgttaccactacgaaacgtaaccgaaacgggtcggtacggtagggaactacggtacacgttaggttacgttaacggtaattcggtactgaancgttgaagtacg

SEQ ID NO: 221450 - DNA, 731 bp, Homo sapiens
  misc_feature: GYAE6OF01DNQVD.12.39.D06.1.454.CMB.1.raw
  modified_base (212)..(212): a, c, t, g, unknown or other
  misc_feature (212)..(212): n is a, c, g, or t
  modified_base (367)..(367): a, c, t, g, unknown or other
  misc_feature (367)..(367): n is a, c, g, or t
tcagatacgacgtacacgaccggtgctcgatttagtgacatctcgcagttctttggggactgatcaggactcctcagttcaccttctcactatgagctccctgctcagctcgttggggctgctaatgctcgtgggtccctcgtaaggacaagaaggagatggaaggggaggggaagtggggtagaagaaagactccgagtgtagagtattgngatcgaccagactccagttcctcttgtcctctccacccgtaggacgacgcgacggtccctaccgtatcgtccgtgacgtaggtctgtctcggcctcctctgactagtacgtaggacggtattcgttccgtttcctttttgttactttcggtttcnggtacgaggaggacggccgacgtacccgtacttacccacctaacccgaaccttcctagtaacgtttacttaagtacgggtaacgtttcccggacccgtacccggtcttcgttcgtacgggtacgtcgaaccgtaagttattacgttacgttacgtacgggtcggtccggttcgggttacggaccggtaacggaaccgaacgttaacggccctttaacctaacgtaaacccctaaagggtaaaccgaaaaccgggtccggggttaccgggaaggtacggtaaccggtacttaaaccggttagggtttacgttaacggtttaaactttaccgtacgggtactaggtaacgtcggaaagttaaccgg

SEQ ID NO: 221451 - DNA, 694 bp, Homo sapiens
  misc_feature: GYAE6OF01DE55T.12.39.D06.1.454.CMB.1.raw
  modified_base (341)..(341): a, c, t, g, unknown or other
  misc_feature (341)..(341): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatggagggagggagtggggtagagaaagatccagtgtagagtattgtgatcgacccagactccagtctccttcgtctctccaccccgtggagacgcgacgtccctccatcgtcctgcgtaggtctacgtctgccgcctcctgcataggtgacgatccgtcctttccttttgtttatttcggtttcncgtacgaggaggacggtcacggctacgtccaccgtaacacctcgtagattaccttagtacgtacggttcgaccccgtacccggtccttccgttcgacgggtacgttacgacgttaagtagtttaacgttcggtttacgacgggtcggttcggtttccggggaacccgggttccgaacgggtaaccctaacgtaaacgggttacccttacccgggtaaccttaaacccgaaccggttaaacgaaaaacccgggtcggggttaacccggggaggtaacggtacgggtaaccgaaccgttaggttaacgttaacggttaaactttaaccggttcttacgactttagagccgtaaag

SEQ ID NO: 221452 - DNA, 654 bp, Homo sapiens
  misc_feature: GYAE6OF01CYCEL.12.39.D06.1.454.CMB.1.raw
  modified_base (189)..(189): a, c, t, g, unknown or other
  misc_feature (189)..(189): n is a, c, g, or t
  modified_base (445)..(445): a, c, t, g, unknown or other
  misc_feature (445)..(445): n is a, c, g, or t
  modified_base (492)..(492): a, c, t, g, unknown or other
  misc_feature (492)..(492): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (552)..(552): a, c, t, g, unknown or other
  misc_feature (552)..(552): n is a, c, g, or t
  modified_base (617)..(617): a, c, t, g, unknown or other
  misc_feature (617)..(617): n is a, c, g, or t
  modified_base (630)..(630): a, c, t, g, unknown or other
  misc_feature (630)..(630): n is a, c, g, or t
  modified_base (638)..(638): a, c, t, g, unknown or other
  misc_feature (638)..(638): n is a, c, g, or t
tcagatacgacgtacacgaccggtgctcgatttagtgacatctcgcagttctttggggactgatcaggactcctcagttcaccttctcactatgacgcctccctgactcagctcgttggggctagctaatgctcgtcggtccctagaaggacaggaaggagagtagggaggggagggtagtggggtaanaagaaagctacgaggttagtaggagttagttggagactaccggaccacgtacctccgtagttccttccgttcgtccctaccgtacccgacccgtaggaacgcgccgtaccggtcccttacgactcgtccgtgacgtacggtctagttcaccgcgtccgttcagacgtagttacgacggacgtgtccgttaccgtttcgttttagttacgtcgtttcagcgtaagcggacgtggactcgactctacacgtactcgtnactacgtagtacgtacgcccgtacgccgtgtacctgacggctcgagnttacgagttacgtggagtgtcggtacgnggtacgaactcgacncggttaacctccggaanacggtaaactaacggacggttcggacgggtagaacggtcgtaacacgggttaattccgggttaanaacgtttaccgtnacgttaancgtacgtaataaccgg

SEQ ID NO: 221453 - DNA, 772 bp, Homo sapiens
  misc_feature: GYAE6OF01ETD3V.12.39.D06.1.454.CMB.1.raw
  modified_base (394)..(394): a, c, t, g, unknown or other
  misc_feature (394)..(394): n is a, c, g, or t
tcagatacgacgtacacgaccggtgctcgatttagtgacatctcgcagttctttggggactgatcaggactcctcagttcaccttctcactatgagctccctgctcagctcttggggctgctaatgctctgggtccctcgtaaggacagaaggagatgagggaggggaatggggtgaagaaagatccagtgtagagtagttgtagatcgaccacgtactccgagtccttccttgtcctctccaccccgtggacgagcgtacggtcctaccgattcggtacctcgctaggttactacgtccgtcggaccgtcctcccgtgaccgtaagttacggtcgaacggttcgtaccgttcccgttttacccgtttttagttacggttttcggttttaccgngtaacgtaaggaggaccggtaacgtacggcccgtaacgttcccgtaacccaacgtaacccgtcgttacgtaactaccgttagtaacggttaacgtcccggaccccgaccccggttcgtaccgttacggacgggttagacccgtacgagtttaaactgtacggttacgagggtccggttcgtagggtacccggtgaacgggcctaaacggtacgtagttaaccccaggttaaaacccgaggttaaaacccggaaaacggttccggggtaacggggtaccggaaaaacggttcgggtaacccttaaaccggttagtttacgggttaaaccgttaacctttacgtaaaccgtcgaaaccttagggaccttacggaaaccgg

SEQ ID NO: 221454 - DNA, 785 bp, Homo sapiens
  misc_feature: GYAE6OF01AOY2K.12.39.D06.1.454.CMB.1.raw
  modified_base (580)..(580): a, c, t, g, unknown or other
  misc_feature (580)..(580): n is a, c, g, or t
  modified_base (695)..(695): a, c, t, g, unknown or other
  misc_feature (695)..(695): n is a, c, g, or t
  modified_base (761)..(761): a, c, t, g, unknown or other
  misc_feature (761)..(761): n is a, c, g, or t
tcagatacgacgtacacgaccggtgctcgatttagtgacatctcgcagtttctttggggactgatcaggactcctcagttcaccttctcactatgaggcctccctgctcagcttcgttggggctgctaatgctcgttcgggtccctacgtaaggacaggaaggagagtggaggggaggggaagtggggagaagaaagactcgaggttgtaagagtagtttggtagacgtaccgaacccgaagtacctacctaccgtttccttccgtttcgttccctccctacccgtaccccggtagggaggaccgtaccggaaccggtccctacccgtagttccggtccgtaggtcgtacggttaccgtcgtcgttcccggccgttcccctccgtagacgttaacgtagggtacggaccggtttactcccgtttcccgtttttaccgttttaggtttcgttttcgggtttcctacggacggtaacggaggggtacgaccggtacgtcccgtacgtcctaacccactaccgtcgtacgtacttacgtagttaggtaccgttccgacccgtccgtacctcgcgttagggacncgactaggttatcgttcggtagccgggtgtacggtcgggtaaccgcgaacggtacaacccgtgtacccgtaaccgttaccaaacgttaaccggaaaacggtaaccgggaccgggngggttaaccggaacggacgggtttaccgtaaggttaacggtttacggttaggttaaactttaccgngtaccgaatcggtacaagggtacg

SEQ ID NO: 221455 - DNA, 871 bp, Homo sapiens
  misc_feature: GYAE6OF01CFR9C.12.39.D06.1.454.CMB.1.raw
tcagatacgacgtacacgaccggtgctcgatttagtgacatctcgcagttctttggggactgatcaggactcctcagttcaccttctcactatgagctccctgctcagcttcgttggggctgctaatgctcgtcgggttccctacggtaaaggacaaggaaggagtagtagggaagggggaggggtaaggtggggtagaagaaagatccgagtaggtaagagtagttggtagacgtacgaacccacgaccttccgtacgttccttccgtttcgtcctcctacccgacccgtagggaacgacgaccgaccggtccctaccgtacgttccggttaccgtggaccggttaacggttccgtttaacgttcggccgttccccgtccccgttccgacgtacgtaacggttaggtacggtaaacggtctttccggttccttttttaccgtttttggttttacggttttcggtttcgtaggacgttaaggacgggtacggtacccggaacggttccctaaccggttacccttaacccgaaacccgtttaaccgttacttaacggttaaccgtttaacgttaaacggtttaccggtaacccgggtttacccccgggaacccgttcccccggggtttacctcccgggtttgggttaacccggggtacgtaacgttaaccgtaaagtttacggtttaaccgtttcgggtaaacggttcgggttaccggtcgggtaccgggaccgggtaccacggacgtaccgtacgactacgactaacgaacggtaacgaaccggcggggtagaggtaacgacgtcgttaactgggtttaaccgtaacgttaacgtttacgtacccgtagtaccgtaagaggtaacgtaacg

SEQ ID NO: 221456 - DNA, 808 bp, Homo sapiens
  misc_feature: GYAE6OF01EPZUC.12.39.D06.1.454.CMB.1.raw
  modified_base (159)..(159): a, c, t, g, unknown or other
  misc_feature (159)..(159): n is a, c, g, or t
tcagatacgacgtacacgaccggtgctcgatttagtgacatctcgcagttctttggggactgatcaggactcctcagttcaccttctcactatgagctccctgctcagcttcgttgggctgctaagtcgctcgtcgggtccctacgtaagacagaaggngtagtgggaggggagggtaagtggggtagaagaaagctacgtaggtagtaacgagtagttggtacgataccgaccacgtaccttccgtacgttcctttccgttcgtcctccgtaccccacccggtaggacgaccgcgaaccggtccctacgtagtccgtcgtcgacgttacgttctacgtcgaccgtcccgtccctcgtcgtacgtagtacggtacggaacggttcttccgttcccgtttttcttttaggttacgttttcggttcgtaccggagaaacgggtcggaaccggtccgtaaacggtcccgtaccgtacccttaaacccgaacgttacccgtgttaaacttccgttaacgttaaggtaccgtttaccggtacccgtaccccgtcccggttcttacgttacgggttaggtcccgtaccgtaaaggttaacttcgttaacgtttcgggtaccgttgggtacgtccggttcggggaacccgtgaacggtaccgtaacgtaccgttacctccgtaaacgtaacgaaccgttaaacgggacgtacccgggggtgtaaaggaacgttcggttaaacggatttacgggtttaaacgtaaccgttttaacgtcgttaacgtaccggtaaaggtcgtaagtaagtaacccgg

SEQ ID NO: 221457 - DNA, 690 bp, Homo sapiens
  misc_feature: GYAE6OF01CYKFK.12.39.D06.1.454.CMB.1.raw
  modified_base (563)..(563): a, c, t, g, unknown or other
  misc_feature (563)..(563): n is a, c, g, or t
  modified_base (675)..(675): a, c, t, g, unknown or other
  misc_feature (675)..(675): n is a, c, g, or t
tcagatacgacgtacacgaccggtgctcgatttagtgacatctcgcagttctttggggactgatcaggactcctcagttcaccttctcactatgaggctccctgctcagctcgttgggctgctaatcgctctgggtccctcggtaaggacaggaaggagatggaaggggaggggaagtggggtagaacgaaagtatccgaggtgtaggagtattggtgagtcgaacccagtaacctcctacgttccttaccttcgtcctcctcccacccgtggacgcgccacggcctccagttccgtccgtcgacgtacggttctacgtccgtcggccctccctcgtagtcctaaggtcggtacggacggtcttcgttcctttccgtttttagtacgttttggtacgtcgcgaaggtacgacggacgtacgggtacctaccggttaccacctaacccgaaccttccgtgtaacttctaggtacgtaaccgtcgaccccgtaccgtctacttcggaggtctacggactaacgttgtacttcggtcggtacgtggtccggtacgggcgggtaacnccggtacaacgagtttaccgcaacgtactaaacgtaacggaaacgttcggggacgaggtaccgacggtaacgtaacgttagtttgggtacttaaacgttctaacggcgtaancgtaaggtcgtaaag

SEQ ID NO: 221458 - DNA, 683 bp, Homo sapiens
  misc_feature: GYAE6OF01E1ONR.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatggaggggaggggaatgggggtgaagaaagatccaggtgtagagtattgtgatcgaccctagacctccagttctccttgtcctcctccaccccgtggagacgcacggcctccattcgtccctgcgtaggttctagtcgttcgaccgtccctaccttggaccttagtacgggtcggacggtacgtcgttccttttacccgtttttgtagttttcgggttttcctcggacgacgggtaagacggtcgtaaccgggtccctacgttcctaacccgaaccttaacctcccgtagtaactcgttatacggtaacgttccgacccgacccgtcttcgtaccgtaggtacgtcgacgtaagtacttagttcgtacgtggtcgcgttcggcgggtacacgggtcacgacgtactacgtacaaccgaacgtaacgaaaacgcgggtcccgggtaaggtacgtaaggtacgtaaccggtagttacggttaacgggttaacttacgttaccgtagtaaccgacgttagtacgtaaagg

SEQ ID NO: 221459 - DNA, 742 bp, Homo sapiens
  misc_feature: GYAE6OF01BH8L5.12.39.D06.1.454.CMB.1.raw
  modified_base (321)..(321): a, c, t, g, unknown or other
  misc_feature (321)..(321): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
tcagatacgacgtacacgaccggtgctcgatttagtgacatctcgcagttctttggggactgatcaggactcctcagttcaccttctcactatgaggctccctgctcagctcgttggggctgctaatgctctgggtccctcgtaaggacaggaaggagagtggagggaggggaagtggggtgaagaaagatccgagtgtagagtattgtgatcgacccagacctacacgtccttaccttgttcctcctacccacccgtggagacgcgacgcctacagttcgtccctggcttaaggtcctacgtcgtcgccgtaccctcgtnacgtagtaggtcggacggtatccgtccttttaccgtttagttnttttggttacngacgtagacggaggtaccacggtccctacgtacctacccgtaaccgtaaccttccgtacgtaactttacctaaggttacggttaacggttccacccccggtacccggtttcgttcccttaacgggtggtaccgtttccgaacgtaaaggttcctttaagggggtcccttttaaggcggggtaccggtttcgcgggttaaccgggcgtaacggtcaacgggtacttaacccggtcaaacgttaaaccgaacgggttaaacgaaaggtcccggggagggttagaccggtaagtccgtaaccggtttaggttggtttaaaccgttaacgttttagtacccgaatcgggtttaacacgggttaagtacccg

SEQ ID NO: 221460 - DNA, 674 bp, Homo sapiens
  misc_feature: GYAE6OF01B73DK.12.39.D06.1.454.CMB.1.raw
  modified_base (375)..(375): a, c, t, g, unknown or other
  misc_feature (375)..(375): n is a, c, g, or t
tcagatacgacgtacacgaccggtgctcgatttagtgacatctcgcagttctttggggactgatcaggactcctcagttcaccttctcactatgaggctccctgctcagctcgttgggctgctaatgctcgtgggtccctcgtaaggacagaaggagagtgggaggggagggaagtgggggtagaaggaaagatccgagtagtaagagtattggtgactcgaccagactccagttcctcttgtctctccacccgtggagacgcgacgtccctccgtagtcgtcctggacgtaggttctagtctcgccgtccttccgagctacgtaggtacgacggtattcgttaccgtttccgttttgttacgtttcgtttccgngacgtaggtacggacgcgacggtcccgtaacgttcccaccaaaccgtaccttcgtatacgttactaggtagtaccgttccgccccgtacgtctcgttgacggtcgtcggacctaagtcttagttcgtaccggtaggtccgacggtcgggtcggaacgacgtaccgataacgtacgtaccgtaaccgaacgttaaaccggaaggtaaaaccggccgggtacggggttacgaagtaacgggtactacgttaggttacggttaacgtttaacttacgtcgacgtacgagttcggaaatacgg

SEQ ID NO: 221461 - DNA, 646 bp, Homo sapiens
  misc_feature: GYAE6OF01ESXTB.12.39.D06.1.454.CMB.1.raw
  modified_base (359)..(359): a, c, t, g, unknown or other
  misc_feature (359)..(359): n is a, c, g, or t
  modified_base (520)..(520): a, c, t, g, unknown or other
  misc_feature (520)..(520): n is a, c, g, or t
  modified_base (545)..(545): a, c, t, g, unknown or other
  misc_feature (545)..(545): n is a, c, g, or t
  modified_base (569)..(569): a, c, t, g, unknown or other
  misc_feature (569)..(569): n is a, c, g, or t
tcagatacgacgtacacgaccggtgctcgatttagtgacatctcgcgagttcgtttggggactgatcaggactcctcagttcaccttctcactatgagctccctgctcagctcttgggctgctaatgctcgtgggtccctcgtaagacagaaggagatggagggagggaatggggtgaagaaagatccagtgtagagacttgtgactcgaccagacctccagtctccttgtcctcctccacccgtggagacgcacggcctccagttcgtcctagcgaggtctagttctcgccgtaccctctgcagttgtacggaccggtatcgtcctttccgttttgtacttttggttacctgacacgngacgtcacgggcctacgtcctaccaacgtactccgtagtacttcctagtacggtaacttccggaccccgtcccggtccttctcgggtacggttacggccgtaccgtaaagtccgttcgttcgtttaaccggaggtttcggaccgttcggggacccggttanacgggtctacgaacgttcttaccgngaaaccctaggtaaacaaacgggnggtaccgggtgaaggtcgacctagtaacgttcgggttaaactccgtttaagttaccgcaacgtacgtgtagaaacgg

SEQ ID NO: 221462 - DNA, 639 bp, Homo sapiens
  misc_feature: GYAE6OF01CAWFJ.12.39.D06.1.454.CMB.1.raw
  modified_base (160)..(160): a, c, t, g, unknown or other
  misc_feature (160)..(160): n is a, c, g, or t
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (298)..(298): a, c, t, g, unknown or other
  misc_feature (298)..(298): n is a, c, g, or t
  modified_base (397)..(397): a, c, t, g, unknown or other
  misc_feature (397)..(397): n is a, c, g, or t
  modified_base (485)..(485): a, c, t, g, unknown or other
  misc_feature (485)..(485): n is a, c, g, or t
tcagatacgacgtacacgaccggtgctcgatttagtgacatctcgcagtttctttggggactgatcaggactcctcagttcaccttctcactatgaggctccctgctcagtctcgttggggctgctaatgctcgtcggtccctagaaggacagaagaganggagggagggagtggggtagaagaaagntcgagtgagagtattgagancgaacccgagacctcacgttctcttgtctctaccacccgtaggacgacgcacgcctacgtactcgtacctgactaggtctacgcgtcgcncctaccgtgactaagtagcgaacgtatcgttcccttgtttagttagtttcggttcagactaggaacgtgcgaacggtcacgttccacactaactccgtntacgttacaatacggtacttccggaccctacgtctcgtgtaggtactacgactaagtacttagtcgttacgtaggtcgtacggtcggngttacgacggacaacgtagaacttccgaaacaacggtaaacctaaaggaaaccggtccggggagggtaaagtacgtactacgggaaacgttagttaccggttaaagtttaacccgttagtacgttaaacggactaccgtaaaggaagttaaacg

SEQ ID NO: 221463 - DNA, 790 bp, Homo sapiens
  misc_feature: GYAE6OF01CV9OW.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttgggctgctaatgctcgtcggtccctacgtaaggacgaaggaaggagagtgggaaggggaggggaagtgggggtagaagaaaagactacgtaggttagtagagtagttagtggtatacgaacccagtacctccgtacggttccttccgttcgtcctacctcccgtaaccccgtagggacgacggccgaacggtccctacctacgttccgtccgtagacgtacggttactacgtccgtccggcccgtaccccttcgtcgacgtaaggttacggtacggtacggtactttccgtttccgttttacccgtttttaggtttcggtttcgtttcgcggtaacgaggagtacggacgacggtcccgtaacgtcccaacctacgtacctactgtaactacgtagtacgtacgttccaccccgttacgtctacgtcgtaggtccgtcgtaacgtagtagtttaccgttacggtaaggtccggttcggcggttaccggaccggttacggacggaactaacgtacggttacctaccgtaaccgaaactaaaccggtaaacggaaaccgggtaccggttacggggaaacgttacgggtaaacgtaaccggtaggttaacggtttaaacggttaccggtttaaaattttacggtaaccgtacgtaccgaaaggtgaaaccgtaaaagg

SEQ ID NO: 221464 - DNA, 822 bp, Homo sapiens
  misc_feature: GYAE6OF01BN7KL.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttgggctgctaatgctcgtgggtccctcgtaagacagaaggagagtggagggagggaagtggggtagaagaaagatcgagtagtagagtattgtgagtcgacccgagactccgacgttccttccgttcgtcctcctccaccccgtggacgacgccgacggtccctacctacgtcgttccgtcgacgtacggtctacgttcgtccgtccgtccccgttccgtgactacgttggtacggacggtcttccgttccttttccgttttgtttacgttttggtttcgtagaccggtaggaacggtacggacgtacggtaccctacggttacctacccctaaaccgttacccttaccgtacgtaacctttacgttaacgttacgtaacggtttaccccgacccccgttcccggtacctttcgtacggttacggtaacggtcggacccgttaaagttacgtttaacgtttcggtttaaccggtaccgggtttcgggtccggttacggggtcccgggtacggtacgggtaccgaacgttacgtaccttacccgtaaccgtaacgaaacggtaaaaccgaaaaccggggtacgggttaccggggtaacggtaaaccggttaacggtacccgtaaaccgggtttcggtttaaagggtttaaaccgtttaaacgttttaaccgttaaggttacggtaacctaacggtagtaaacggtaaacg

SEQ ID NO: 221465 - DNA, 711 bp, Homo sapiens
  misc_feature: GYAE6OF01D3PTT.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttggggctgctaatgctctgggtccctaggtaaggacaggaaggagagtggaggggaggggaagtgggggtagaaggaaagactccgaggttgtagagtagttgtgatacgaacccagacctcctagttccttccttcgtcctcctccacccgtgggacgcgcgacgtcctcctagtcgtcctgacgtaggtctagtcctcgcctcctctgactagtacggtacgagtctcgtccttttccgttttagttacgtttggtttccgtgacggtaacggaggacggtcgaccggtaccgtacgtcccgtacctaaacgtaccttccgtagtaacttctagtacggttaccgtcccgacccgtaccggtcttacgtcggtaggtcgtacgacgtagtactttaggttcgtacgtcggtcggtcggtacgggtacggcgaaggaccgacgtacgtactaccgtaacctaacggaaaccgtaaggaaacccgggtcgggtacggggtaggtaaacgtaccgggttaccaacgttagggttacggtttaaaccggttacttttaacgtaccgttaggtaacgttacggacggttaaacgaaccgg

SEQ ID NO: 221466 - DNA, 784 bp, Homo sapiens
  misc_feature: GYAE6OF01ADBP2.12.39.D06.1.454.CMB.1.raw
  modified_base (420)..(420): a, c, t, g, unknown or other
  misc_feature (420)..(420): n is a, c, g, or t
tcagatacgacgtacacgaccggtgctcgatttagtgacatctcgcagttctttggggactgatcaggactcctcagttcaccttctcactatgaggctccctgctcagcttcttgggctgctaatgctctcgggtccctagtaaggacaggaaggagagtagggaggggaggggtaagtggggtagaagaaacgtactaccgaggtagtaaggagtattggtagactaccgaacccgacgacctccgtacgttccttccgtttcgtccttcctacccaccccgtggaacgacgccgtaccggcccttaccgagttcggtccctggccgtaaggtcttacggtctcgtccgtaccctcgcgtactagtacggtacgacggtattccgttccgttttccgtttttagttcgtttcggtttnacggacgaaggtcggacgcgtacggccgtacgtcctaaccccgaactaccttcgtacgtattaccgtaagtacgttaaccggtccgtaccccgtaccgtccgttacgttacggtcgtacgtccggtaaccgaagtttaacttcggtttacggttaacggcgggttacgggtcgttaccgggggcccgtaacggtacgaacccgaagttccggtaacctttacgaaccccgaaacgttaacccggtaaaaccgaaacggggtccgggtaaaccgggtagggtaaaccggttcggaaccgttaacggttagtttcggtaaaaccttaagttttacgacgtatacccgagttacccgaaggttaaac

SEQ ID NO: 221467 - DNA, 709 bp, Homo sapiens
  misc_feature: GYAE6OF01CLF3H.12.39.D06.1.454.CMB.1.raw
  modified_base (300)..(300): a, c, t, g, unknown or other
  misc_feature (300)..(300): n is a, c, g, or t
  modified_base (446)..(446): a, c, t, g, unknown or other
  misc_feature (446)..(446): n is a, c, g, or t
  modified_base (539)..(539): a, c, t, g, unknown or other
  misc_feature (539)..(539): n is a, c, g, or t
  modified_base (571)..(571): a, c, t, g, unknown or other
  misc_feature (571)..(571): n is a, c, g, or t
tcagatacgacgtacacgaccggtgctcgatttagtgacatctcgcagttctttggggactgatcaggactcctcagttcaccttctcactatgagctccctgctcagcttcgttggggctgactaagtgtcttcgtcgggtccctaggtaaggacagaaggagagtggaaggggaggagtgggtagaagaaagtactcgaggttgagtagtagttgagtacgtacgaaccgacgactaccgtgtttccttccgtttcgccttacctcccgaccgtggacgacgtccgacgtccttacgngttcgtcgtagacgttcgtcgttacgctcggtcctccgtctgactaggtcgacggtacgcgttccttttccttttacgttttgtttacggtttcgtttcgcgaggaacggtcggacgtacgtcgacctacgttaccaactaactcncgttagtaacttcggtagttaacgaccgttccgaccccggtttcgctttcggacgttcggtcacgtaacgtggttaccttagtacggttacgngtcggttaccggtgggacctaagcggtaaacncgttaacgccgttaaccgacaaagggttaaccgaacggaaacgggccgggtaggttaagacgtaggttaaccgtaaaggttttcggaaaaccttttaaggtctttaacgacgggaacttcgtaagtacgaagttaacc

SEQ ID NO: 221468 - DNA, 667 bp, Homo sapiens
  misc_feature: GYAE6OF01EZ41V.12.39.D06.1.454.CMB.1.raw
  modified_base (283)..(283): a, c, t, g, unknown or other
  misc_feature (283)..(283): n is a, c, g, or t
  modified_base (386)..(386): a, c, t, g, unknown or other
  misc_feature (386)..(386): n is a, c, g, or t
tcagatacgacgtacacgaccggtgctcgatttagtgacatctcgcagttctttggggactgatcaggactcctcagttcaccttctcactatgaggctccctgctcagctcgttggggctgctaatgctcgtgggtccctacgtaaggacagaaggagagtggaggggaggggaagtgggggtagaagaaagtctccgaggtgtagagtattgtgatcgaccagtacctcacgttctccttgtcctcctccacccgtggagacgcgacgtcctcatcgtccngcgtaacggttctacggtcgtcgacccgtcccttccgtgacgtagtaggtacggacgttcgtccgttcctttttaccgtttttgttacggttttggtttaccncggacaagggtacgacggacgtacgccgtaacgtcctacccaaacgtcctctagtacttacgtagtacgtacgtccgacccgtcgtctcgtggagtcgctacgtatattcgtacgttacagggtcggtaccgtgggtaccgtcgcgtaacacgtactcttacaacgaaccctaaggaaacggaaccgtgggggtaaccggagttaacggtacggttacaacccggtttaggtacgttaaaccggttaatttaacggtcgacagttacgtagaaacggtagg

SEQ ID NO: 221469 - DNA, 483 bp, Homo sapiens
  misc_feature: GYAE6OF02HLRJG.12.39.D06.1.454.CMB.1.raw
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtatttggtttctgcagagaggcaggccagtctccacaactcctgatctatgaagttcgccacccggctctctggagtgccagatatgttcagtgctgcggtcaggcanagatctcacactagaaaacngccggtgagagtgacctagtgttagaacttattacgtgacatgataag

SEQ ID NO: 221470 - DNA, 485 bp, Homo sapiens
  misc_feature: GYAE6OF02H35I1.12.39.D06.1.454.CMB.1.raw
  modified_base (436)..(436): a, c, t, g, unknown or other
  misc_feature (436)..(436): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgcttcccttttgtattggtttctgcagagaggcaggccagtctccacaactctgatctatgaagttcgccacccggctctctggagtgccagatatgttcagtggctgcgggtcaggcacagatctcacactagaaaacngccgggtagagagtgaccagtgttaggaactttattactgcatgataag

SEQ ID NO: 221471 - DNA, 542 bp, Homo sapiens
  misc_feature: GYAE6OF02HNAIE.12.39.D06.1.454.CMB.1.raw
  modified_base (299)..(299): a, c, t, g, unknown or other
  misc_feature (299)..(299): n is a, c, g, or t
tcagatacgacgtacacgaccggtgctcgatttagtgacatctcgcaggttctttggggactgatcaggactcctcagttcaccttctccactatgaggctccctgctcagctcttggggctgctaatgctctgggtccctcgtaaggacagaaggagatgagggaggggaatggggtgagaaagatccaggtgtagagattgtgatgacccagactccagtctccttgtctctcacccctggagagcaggcctccatgtcctggcaggtctagtctgcgcctcctgcatagtgacggntcgcttcccttttgacttggtttctgctagagaggcaggccagtctccacaactcctgatctatgaagttcgccacccggtctctcgtggagttgacctagtatatgtttcagtggtctgcgggtcgaggcacgagagtcctaccacgaactaacgaaaaacgacgggtaccgggtaggagtaacggtcgaccgtagtcgttaggtaactttaacgttacttcgtacgtacgttagactaacg

SEQ ID NO: 221472 - DNA, 488 bp, Homo sapiens
  misc_feature: GYAE6OF02GPR6Q.12.39.D06.1.454.CMB.1.raw
  modified_base (438)..(438): a, c, t, g, unknown or other
  misc_feature (438)..(438): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgcttcccttttgtattggtttctgcagagaggcaggccagtctccacaactcctgatctatgaagttcgccacccggctctctggagtgccagatatgttcagtggctggcgggtcaggcacagatctcacactagaaaacngccgggtaggagaggtgaccatgttagaactttattactgacatgataag

SEQ ID NO: 221473 - DNA, 492 bp, Homo sapiens
  misc_feature: GYAE6OF02IGBR1.12.39.D06.1.454.CMB.1.raw
  modified_base (413)..(413): a, c, t, g, unknown or other
  misc_feature (413)..(413): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgcttcccttttgtatttggtttctgcagagaggcaggccagtctcacaactcctgatctatgaagttcgccacccggctctctggatgccagatatgttcagtgctgcggtcagcanagatctacacactagaaaacaggccgggtagacgagtcgacctagtgttacggaactttactactgactatcgactaag

SEQ ID NO: 221474 - DNA, 480 bp, Homo sapiens
  misc_feature: GYAE6OF02HPD5N.12.39.D06.1.454.CMB.1.raw
  modified_base (241)..(241): a, c, t, g, unknown or other
  misc_feature (241)..(241): n is a, c, g, or t
  modified_base (435)..(435): a, c, t, g, unknown or other
  misc_feature (435)..(435): n is a, c, g, or t
  modified_base (477)..(477): a, c, t, g, unknown or other
  misc_feature (477)..(477): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgtctctcacccctgganagcaggcctccatgtcctgcaggtctagtctgcgcctcctgcatagtgacggatgctcccttttgattggtttctgcagagaggcaggccagtctccacaactcctgatctatgaagttcgccacccggctctctggagtgccagatatgttcagtggctgcgggtcaggcacagatctcacactagaaaaacngccgggtgagagtgccatgttagaacttattactgcagtganaag

SEQ ID NO: 221475 - DNA, 503 bp, Homo sapiens
  misc_feature: GYAE6OF02IVTOG.12.39.D06.1.454.CMB.1.raw
  modified_base (444)..(444): a, c, t, g, unknown or other
  misc_feature (444)..(444): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctcatgtcctgcaggtctagtctgcgcctcctgcatagtgacggatgctccttttgtattggtttctgcagagaggcaggccagtctcacaactcctgatctatgaattgccacccggctctcgtggagtcgccagatatgttcagttcggcgtgcggtcacggcacgagtactcgtcaccacgtacgaaaacgngccgggtagagaggtcgacctagtgttaggtaacttagttactgtactagtcgataacg

SEQ ID NO: 221476 - DNA, 498 bp, Homo sapiens
  misc_feature: GYAE6OF02F8CWK.12.39.D06.1.454.CMB.1.raw
  modified_base (444)..(444): a, c, t, g, unknown or other
  misc_feature (444)..(444): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctccacccctggagagcaggccctccatgtcctgcaggtctagtctgccgcctcctgcatagtgacggatgccttcccttttgtatttggtttctgcaggagaggcaggccagtcctccacaactctgatctatgaattcgccacccgctctctggagtgccagatattgttcagtggcgtgcgggtcaggcacagtatctcacactagaaaacncggaccggtggagagtgacctagtgttagtaacgttattactagcagtgataag

SEQ ID NO: 221477 - DNA, 528 bp, Homo sapiens
  misc_feature: GYAE6OF02H405V.12.39.D06.1.454.CMB.1.raw
  modified_base (317)..(317): a, c, t, g, unknown or other
  misc_feature (317)..(317): n is a, c, g, or t
  modified_base (448)..(448): a, c, t, g, unknown or other
  misc_feature (448)..(448): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctcttgtctctcaccctggagagcaggcctccatgtcctgcaggtctagtctgcgcctcctgcatagtgacggatgcttcccttttgtattggtttcngcagagaggcaggccagtctccacaactcctgatctaatgaagttcgcccacccggtctctctggagtcgccagtatattgttctagtggctggcggtacaggcacgagactcacaccactacgaaaacgnggaccgggtaggacgtacggtcgaacctagttacggttacggtaactttacgttacgtagaccgtaagtcgactaaacgg

SEQ ID NO: 221478 - DNA, 496 bp, Homo sapiens
  misc_feature: GYAE6OF02FNXIA.12.39.D06.1.454.CMB.1.raw
tcagatacgacgtacacgaccggtgctcgatttagtgacatctcgcagttttttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgcccacccggctctctggagtgccagatatgttcagtggctggcgggtcagggcacgagatctcacaactacgaaaacagccgggtggagagtgaaccatggttaggaactttagttactgcatgacaagtacg

SEQ ID NO: 221479 - DNA, 656 bp, Homo sapiens
  misc_feature: GYAE6OF02J2U5G.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatgacccagactccagtctccttgtctctcaccctggagagcaggcctccatcgtcctgcaggtctagtctgccgtcctcctgctatagtgacggtatcgtccttcccgtttttggtagttttcgggttttcctcggaccgaaggtacggtacgggccgtaacggggcccctaaggttcccttacccaacctaaacccgtttcccgtagtactttaccttaagttaggtaaacgtttccggaccccgtaccccgggtctttcgtaccgtgggtacgttcgacccgtaagtacttacgttgttacgtaggtggtccgtgggtaccgggtcaacgggtcaacgtagtactactacgaacgtaacctaaaggaaaccgcgggtaccgggtagaacgcgtaccggactaaggttacggttacgtaacctttagttcgtagacctagacggataacgg

SEQ ID NO: 221480 - DNA, 607 bp, Homo sapiens
  misc_feature: GYAE6OF02IZQZI.12.39.D06.1.454.CMB.1.raw
  modified_base (323)..(323): a, c, t, g, unknown or other
  misc_feature (323)..(323): n is a, c, g, or t
  modified_base (493)..(493): a, c, t, g, unknown or other
  misc_feature (493)..(493): n is a, c, g, or t
tcagatacgacgtacacgaccggtgctcgatttagtgacatctcgcaggttcgtttggggactgatcaggactcctcagttcaccttctcactatgaggctccctgctcagctcttgggctgctaatgctctgggtccctcgtaaggacagtaaggagatgagggaggggaatggggtgagaaagatccagtgtagagattgtgatgacccagactccagtctcttgtctctcacccctggagagcaggcctccatgtcctgcaggtcctagtctgcgcctcctgcatagtgacggatgccttccttttgactttcggtttcngctagacgaggcaggccagtctaccactaacctcctagacttcctaatacgtaagttcgacccgacccggtctctcgtggagtcgaccgagactagttcgttacgtagttgcgttaggcgggttcgacggtacacgtagtactctacgacgtaacgtaagtaaaaaccgngggtacccgggttagggaacggtacggtacggtaacccgtaagtttacggtttaacggttaaaccgttttaacgtttaccggttaggtaccgtacggttacggaccgtaaacgg

SEQ ID NO: 221481 - DNA, 513 bp, Homo sapiens
  misc_feature: GYAE6OF02FWIZI.12.39.D06.1.454.CMB.1.raw
  modified_base (412)..(412): a, c, t, g, unknown or other
  misc_feature (412)..(412): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatgagggaggggaatggggtgagaaagatccagtgtagagattgtgatgacccagactccagtctccttgtctctccacccctggagagcaggcctccatgtcctgcaggtctagtctgcgcctcctgcatagtgacggatgctcccttttgtatttggtttctgcagagaggcaggccagtctccacaactctgatctatgaagttcgcccacccggctctctgggagtcgccagtatatgttcagtgctgcggtnaggcacagactctacgacactaacgaaaacgcggccgggtagaggacgtcgaacctagtggttacgtaacgtttattacgttagactagttgacgtaacgg

SEQ ID NO: 221482 - DNA, 674 bp, Homo sapiens
  misc_feature: GYAE6OF02IL4HP.12.39.D06.1.454.CMB.1.raw
  modified_base (278)..(278): a, c, t, g, unknown or other
  misc_feature (278)..(278): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatcgtcctgcagtctagtctcgccncctcctgactagtaggtaggacggtatcgtccttttcccgttttgttacgttttggtttctgtacgaggaggcggacgacggcctacggttcctaccgaacctaaccttccgtagtacttactagtaggtaacgttccgacccgtacccggtccttcgtcgtaggtacgtcgaccgaagtacgttacgttcggttacgtagggttcggtccgtcggggtaccgggtacgtacggtaccaacgtagtaaccttccgtaaccgaaccgtaaacggtaaaacggaaaaccggccggggtacggggtagggaacggtacggtaacgtaaccggttaggtttaacggttaacgtttaaacgtttacgttaaccggtagtaccgtaacgtcggaacgtaagg

SEQ ID NO: 221483 - DNA, 704 bp, Homo sapiens
  misc_feature: GYAE6OF02IL91O.12.39.D06.1.454.CMB.1.raw
  modified_base (307)..(307): a, c, t, g, unknown or other
  misc_feature (307)..(307): n is a, c, g, or t
  modified_base (344)..(344): a, c, t, g, unknown or other
  misc_feature (344)..(344): n is a, c, g, or t
  modified_base (600)..(600): a, c, t, g, unknown or other
  misc_feature (600)..(600): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggagggaatggggtgagaaagatccagtgtagagattgtgatgacccagactcagtctccttgtctctccaccctggagagcaggcctccatcgtctgcaggtctagtctggccgtcccttctagcctaattaggtcgtaacggntcggtcctttcccgtttttggtacttttggttttccngtaccaaggtagacggtcaacgggcctagttccctaccgaacctaaccgttcccgtagtaacttaccgtagttagggtaacgtttcccgaccccgtaacccgggttcctaccgttccggtacggtacggttcggacctaaggtacttaagttccggttacgtagggttcggtccgtgggtaccgggtcggaacggtacctacgtaacggtacttcccgttaaccgaaccgtaaccgttaaacggaaaaaacccggngggtacccggggtagtaacggtccggtaacgtaaccggtagtttacgggttaacggttaaacctttaggttaccgttagaccggtaacgttcggaattaaacgg

SEQ ID NO: 221484 - DNA, 647 bp, Homo sapiens
  misc_feature: GYAE6OF02HHW23.12.39.D06.1.454.CMB.1.raw
  modified_base (296)..(296): a, c, t, g, unknown or other
  misc_feature (296)..(296): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgtctctccacccctggagagcacggcctccatcgtcctgcaggtctagtctgcgcctctgcatagtgacggntgcttccttttgtatttggttctgcagagagcaggcagtctaccacactctgatctatgtaagttcgcccgtacccggtctcctcgtacggtacggtcgaccctagtaactttacgttacggttacgtaggttcgggtccgttggggtaccggggttaccgaacggggacctaaccggtaagtaccgtttacctaacccgtaaccgttaaaccgttaaaccggaaaaaaaccggtaccgggggtaacccggggtagggtaacgggttacgggtaacggtaacccgtaaggttacgggtttaacgggttaaacttttaacgtttaccgtagtacctaagttcgaaccgtaag

SEQ ID NO: 221485 - DNA, 619 bp, Homo sapiens
  misc_feature: GYAE6OF02GUB1G.12.39.D06.1.454.CMB.1.raw
  modified_base (333)..(333): a, c, t, g, unknown or other
  misc_feature (333)..(333): n is a, c, g, or t
tcagatacgacgtacacgaccggtgctcgatttagtgacatctcgcaggttctttggggactgatcaggactcctcagttcaccttctcactatgaggctccctgctcagctcttggggctggctaatgctctgggtccctcgtaaggacagaaggagatgagggagggatggggtgagaaagatccagtgtagagattgtgatgaccagactcagtctcttgtctctcaccctggagagcaggcctcatcgtacctgcaggtctagtctgcgcctcctgctagtagtacgacggatcgtccttcccttttgtactttggttttctggcaggngtaggcgaggccagtcctaccactactcctagacttctatagtaacgtttcgacccgacccggtctccgttcgtagggtacgtcgaccgagtaattagttcggtttcgaaggttggtacgttggccgggttacgagggaccacgtacgtacgttccgtaccgtacgtaaccgttaaacggaaaaaccgcggggtaccgggtagggaggtacggtacggtaaccgtaacggttacgggtttaacggtaactttaacgttacgttacgtacgtagttacgtataacgg

SEQ ID NO: 221486 - DNA, 544 bp, Homo sapiens
  misc_feature: GYAE6OF02IR7TU.12.39.D06.1.454.CMB.1.raw
tcagatacgacgtacacgaccggtgctcgatttagtgacatctcgcagttctttgggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctctgcatgtgacggatgcttccttttgtattggtttctgctagagagcaggccagtctcacaactctgatctatagaagttcgcccacccgctctcgtggagtcgcagatatgttcaggttggctggcggtcaggcacgagatccgtactaaccaactaaacgaaaaacgacgggtaccgggtagggaggtacggtacggtaacccgtagttacggttaacggtaactttaacggtttaactgtacgtaacgttcggataaacgg

SEQ ID NO: 221487 - DNA, 596 bp, Homo sapiens
  misc_feature: GYAE6OF02GFYV1.12.39.D06.1.454.CMB.1.raw
tcagatacgacgtacacgaccggtgctcgatttagtgacatctcgcagttctttggggactgatcaggactcctcagttcaccttctcattatgaggctccctgctcagctcttggggctgctaatgctctgggtccctcgtaaggacagaaggagatgagggagggaatggggtgagaaagatccagtgtagagattgtgatgacccagactccagtctccttgtctctcacccctggagagcaggcctccatgtcctgcaggtctagtctgcgcctcctgcatagtgacggatgcttcccttttgtatttggtttctgcagagaggcaggccagtctccaacaactcccgtagtactactagtagtaacgttcgacccgtacccggtctacgttcggtacggtagtccgaccgaagtacttagttcgttacgagggttcgtccggtcgggtaccggtacgaacgggtacctaacgtagtaccttcgtaccaacgtaacgtaaacgaaaacgcgggtaccgggtagacggtacgtacgaaccgtaggttaggtaacgttaacgtttacttacgtacgacgtagtacgaacgtaag

SEQ ID NO: 221488 - DNA, 619 bp, Homo sapiens
  misc_feature: GYAE6OF02FS17T.12.39.D06.1.454.CMB.1.raw
  modified_base (293)..(293): a, c, t, g, unknown or other
  misc_feature (293)..(293): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgtctctcacccctggagagcaggcctccatgtcctgcaggtctagtctgcgcctctgcatgtgacggtntcgtccttccgttttgtagtttcggtttctgactaggaggcggacgacggacctacgttcctcccaactaacctccgtagtacttctagtcggtaacgttccgacccgtacccggtcttctcgtaggtacgtcgaccgagtacttagttcgttacgaggttcggtcgttcgggtccgggtacgacggaccgacgacgtactccgacctaaccgtaaccgtaaacgaaaaccgtacgggtccggggtaggaacggtacggtacggtaacctaagggttcggttaacggtaactttacgttacgttagacgtacgtacgacgtaacgg

SEQ ID NO: 221489 - DNA, 663 bp, Homo sapiens
  misc_feature: GYAE6OF02IDVI2.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagtattgtgatcgacccagactccagtctccttgtctctccaccctggagagcacggcctccatcgtcctgctaggtctagtctgccgtccctctgcataggtcgacggtatcgtcctttcccgtttttgttagtttcggttttctgcgaaggacggacggccgacggccctacgtcctaccaactaacctcctagtacttactagtagtaacgttccgacccgtacccggtcttaccgtcgtcggtagtccggacctagtaattacgttcggttacgtacgggttcgggtaccgttcggggtaccgggtacgacgggtaccaaacgtacgtaccttaccgtaccgaacctaaccgtaaacggaaaacgtaccggggtaccgggtagggaacggtacggtacggtaaccgttaggttacggtttaacgtaactttacgttacgtcgtacgtaacgtcgtaactaacgg

SEQ ID NO: 221490 - DNA, 535 bp, Homo sapiens
  misc_feature: GYAE6OF02G8AF6.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctccacccctggagagcaggcctccatgtcctgcaggtctagtctgccgcctcctgcatagtgacggatgccttcccttttgtatttggtttctgcagagaggcaggccagtcctccacaacttccagatctatggaagttcgacccgacccggtctcctctgggcgttcgacctagatagttgttacaggtcggctggcggtcaggcacagctcgtcacgtacaagaaaacgcggaccgggtgaaggacgtcgacgtagttacggttagtaaacgtttacgttacgtcgtactatacgagtaacg

SEQ ID NO: 221491 - DNA, 556 bp, Homo sapiens
  misc_feature: GYAE6OF02G0NUX.12.39.D06.1.454.CMB.1.raw
  modified_base (241)..(241): a, c, t, g, unknown or other
  misc_feature (241)..(241): n is a, c, g, or t
  modified_base (444)..(444): a, c, t, g, unknown or other
  misc_feature (444)..(444): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgtctctcacccctgganagcaggcctcatgtcctgcaggtctagtctgcgcctcctgcagtagtgacggatgccttcccgttttgtatttggtttctgtcagagaggcaggccagtctccacaactcctgatctatgaagttcgccgacccgctctcgtggacgtgccagtaactagttgttcgaggttcggctcgggccgggtcgacgggtaccaacgngaacgttcctacacaaccgtaagaaaaaccgcgggaccgggtaggacggtacggtcgaaccgttagtaggttacggtaactttacgttacgttgtacgtagttagactaaag

SEQ ID NO: 221492 - DNA, 555 bp, Homo sapiens
  misc_feature: GYAE6OF02HLO3Y.12.39.D06.1.454.CMB.1.raw
  modified_base (241)..(241): a, c, t, g, unknown or other
  misc_feature (241)..(241): n is a, c, g, or t
  modified_base (354)..(354): a, c, t, g, unknown or other
  misc_feature (354)..(354): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgtctctcacccctgganagcagcctccatcgtcctgcaggtctagtctgccgcctcctgcatagtgacggatcgccttccttttgtatttggtttctgcagagaggcaggcctagtcctaccacactccngatctatgtagttcgcccgacccggtctcgtcgtggagtcgaccagtattagtcgttacgagggttcgtcgtcgggcgggtcgacggccaacgagtactcctaccaacctaacgtaacgaaaacgcgggaccgggtaggaagtaggtacgacctaggttcgtaacggttaactttacgttacgtgactagtacgactaagg

SEQ ID NO: 221493 - DNA, 557 bp, Homo sapiens
  misc_feature: GYAE6OF02ID0ID.12.39.D06.1.454.CMB.1.raw
  modified_base (420)..(420): a, c, t, g, unknown or other
  misc_feature (420)..(420): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgaccagactccagtctccttgtctctcacccctggagagcaggcctccatgtcctgcaggtctagtctgccgcctcctgcatagtgacggatcgtcttcccttttgtattcggtttctgcagtagaggtcgaggctacgtactccaactacctcgtacgatcgtatgaagttcgccgacccgctctcgtgcgtgccagagtatcgttcagttcggngtagtcgggtacaggcacgacgtacgtccttcaactactaacgaaaaccgtgaccgggtacggaacgaggtcggacccgtaagttacggttacggttaacgtttaacgttacgttacgtactagtacggataaacgg

SEQ ID NO: 221494 - DNA, 663 bp, Homo sapiens
  misc_feature: GYAE6OF02F6ZGA.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctccaccctggagagcaggcctccatgtcctgcaggtctagtctgccgcctcctgcatagtgacggtatcgtcctttcccgttttgttacgttttcggtttctgtaccgaaggtaacgacgggacccaaggggtcccacggtttaccctaccctaacctaacccttcctagtaactaccgttaagtacggtaacgttccggaccccgtaacccggtcccttaccgttcggtagggtacgtccgtacccaaggttactaagttcgtttaaccgagggttcggtcgtacgggtccggtacgacggtacaacggtagtactcctactaaccgtaacgtaaacgaaaacgcggaccggggtagaacgtacggtaacgaaccgttaggttacggttaacgttaacgtttacgttacgtacgactacgtacgagtaacgg

SEQ ID NO: 221495 - DNA, 527 bp, Homo sapiens
  misc_feature: GYAE6OF02FLFLM.12.39.D06.1.454.CMB.1.raw
  modified_base (319)..(319): a, c, t, g, unknown or other
  misc_feature (319)..(319): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgcttccctttgttattggtttcngcagagaggcaggccagtcctaccactaacctcctgattctatgaagttcgccacccggtctctcgtggacgtgccagtatattgttcaggttggcgtcggcgggtcaggccacagattcncaccaatagaaaacgnggaccgggtggaagtacgtacggaccgtagttggttacgtaactttacgttactgtacgtatggactaacg

SEQ ID NO: 221496 - DNA, 548 bp, Homo sapiens
  misc_feature: GYAE6OF02FYX5E.12.39.D06.1.454.CMB.1.raw
  modified_base (320)..(320): a, c, t, g, unknown or other
  misc_feature (320)..(320): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatcgacccagactccagtctccttgtctctcacccctggagagcaggcctccatgtcctgcaggtctagtctgcgcctcctgcatagtgacgatgctccctttgtatttgttctgcagngaggcaggccagtcctccacaactcctagatcctatcgaagttcgcccacccggctcctcgtggacgtgcccgagtactagttgttcgagttcggtcctggccgggtacaggccacgacgtacttcctacacgaacgtacgaaaaacgcgggtaccgggtaggaggtaggtacgaccgtagttacggttagtaactttacgttacgtagactacgtacgacgtaacgg

SEQ ID NO: 221497 - DNA, 611 bp, Homo sapiens
  misc_feature: GYAE6OF02G8NJR.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcacggcctccatgtcctgcaggtctagtctcgcgcctcctgcatagtgacgatgtccttccttttgtatttggtttctgcagagaggcgagccagtctaccactaactcctagactctatgtaacgttcgacccgacccggtcttccgtcgtcgggtacgtcgaccgagtacttacgttcggttacgtacggttcgggccgttcgggtccgggtacgacgggtaccgaacgtacgtacttccgtaccaaccgtaaacgtaaacggaaaaaccgacggggtacccggggtaggacgggtaacggttaccgaaccgtagtttacggttacgttaacgtttacgttacgtcgtactacgtacgactaagg

SEQ ID NO: 221498 - DNA, 609 bp, Homo sapiens
  misc_feature: GYAE6OF02HIG3Z.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctccaccctggagagcaggcctccatgtcctgctaggtctagtctgccgcctcctgcatagtgacggatcgccttccttttgtatttggtttctgcagagaggcaggccagtcctaccaactaactcctagtacttctaatcggtaacgttcgaccctaccccggtcttcgtcgtgggagtcgaccagtattattcgttacgtaggtcggtcgtcgggtcgggtacgacggtaccgaacgtacgtactcctaccgtaaacctaaccgtaaacggaaaaaccgtacgggacccggggtagggaacgggtacgtacggtaacctaaggttacggtttaacggttaaacctttagttaccgtagtactaagtacgaacgtaag

SEQ ID NO: 221499 - DNA, 592 bp, Homo sapiens
  misc_feature: GYAE6OF02G7UGO.12.39.D06.1.454.CMB.1.raw
  modified_base (321)..(321): a, c, t, g, unknown or other
  misc_feature (321)..(321): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgccttcccttttgtatttggtttcngcagagaggcaggccagtctccactactcctgatctatgaagttcgcccgacccggcttcgtcgtggacgtcgaccgagtattagtcgtttcgaggttcggtcgtagggtccgggtcgacggccaacgacgtacttccgtaccaaccgtaaccgtaaacgaaaaaccgagggacccggggtaggaacggtacggtacgtaaccgtaaggttcggttaacggttaaactttaacgtttaaccgtacgtaccgtaagttacgaaccgtaaagg

SEQ ID NO: 221500 - DNA, 752 bp, Homo sapiens
  misc_feature: GYAE6OF02HXZAR.12.39.D06.1.454.CMB.1.raw
  modified_base (289)..(289): a, c, t, g, unknown or other
  misc_feature (289)..(289): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggagggaatggggtgagaaagatcgagtgtagagattgtgatacgacccagacctccagttcctccttgtcctcctccaccccgtggagagcaggccctccatcgtcctgcgagttctagtctgccncccttccgtgctagtaggtggacggattcgtcctttcccgtttttgttaacgttttgggttttcctggtacgtaaggtaggacggtccgacgggtccctaagtcccctacccgaacctaaccttcccgtagtacttaccttagtacgggttaacggttccgaccccgtaccccggtactttaccgtccggtaggtacgtcgccgtaaagttagttacttaggttaccgtacggttggtaccgttcgggccgggtacgaacggtaccgaagtaccggttaccttaccgtaacctaaccgaaaccggttaaaaacgaaaaaccgggttacccggggaccggggttaggaacgggttacgggtaacccgtaacccgttaagggttttaccggtttaaaacgggtttaaaccgttttaccgtttaacggtaccggtaacgttaacgttacgggaaccgttaaaaggg

SEQ ID NO: 221501 - DNA, 660 bp, Homo sapiens
  misc_feature: GYAE6OF02JDGMY.12.39.D06.1.454.CMB.1.raw
  modified_base (243)..(243): a, c, t, g, unknown or other
  misc_feature (243)..(243): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatcagtgtagagattgtgatgacccagactccagtctccttgtctctcaccctgtagancaggcctccatcgtcctgctaggtctagtctgccgcctcctgcataggtgacggtatcggtcctttcccgttttagttagttttcggtttctggcctaggaggcggaccgaggtcccagttcctaccaacgtaacttccgtgtaactcctagttacgtaacggttccgacccgtaccccggtcgttcctacggtcggtaacgtccgacctagtagttacgttacggttcgtacggttcggtcggttcgggtccgggtacgaacgggtacaacgtacgtacttccgaaccgtaacctaaacgtaaacggtaaaaaccggtcgggtacgggtacgggtaggtacggtcggtaaccgttaggttacggttaacggttaacgtttacgttaccgtacgtacgtacgtacggtaccgtaagg

SEQ ID NO: 221502 - DNA, 539 bp, Homo sapiens
  misc_feature: GYAE6OF02F8T4Z.12.39.D06.1.454.CMB.1.raw
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctcatgtctgcaggtctagtctgcgcctcctgcatagtgacggatgcttccttttgtatttggtttcngcagagaggcaggccagtcctccacaactcctgatctatgaagttcgccaccgctctcgtggngtcgcagatatcgttcgagtcggctggccgggtcacgggtcacgtagactcctacgaaccaacgtaaacgaaaaacgtcggtaccggggtaggaacgtacggtacgacctagttaggttacggtaacttttacgttacgttgtactagtagacgtaacg

SEQ ID NO: 221503 - DNA, 715 bp, Homo sapiens
  misc_feature: GYAE6OF02IMMGZ.12.39.D06.1.454.CMB.1.raw
  modified_base (155)..(155): a, c, t, g, unknown or other
  misc_feature (155)..(155): n is a, c, g, or t
  modified_base (173)..(173): a, c, t, g, unknown or other
  misc_feature (173)..(173): n is a, c, g, or t
  modified_base (181)..(181): a, c, t, g, unknown or other
  misc_feature (181)..(181): n is a, c, g, or t
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (470)..(470): a, c, t, g, unknown or other
  misc_feature (470)..(470): n is a, c, g, or t
  modified_base (555)..(555): a, c, t, g, unknown or other
  misc_feature (555)..(555): n is a, c, g, or t
  modified_base (703)..(703): a, c, t, g, unknown or other
  misc_feature (703)..(703): n is a, c, g, or t
tcagatacgacgtacacgaccggtgctcgatttagtgacatctcgcgtaggttctttggggactgatcaggactcctcagttcaccttctcactatgaggctccctgctcagctcttgggctgctatgctgtcggtccctagtaggacagaaggngatggaggaggatgggtnacgaagtnccgagtgagagtattggagagtcgaccagtactcgngtccgtcctggtcctctccgacccgtgaagcgcacggtcctcagtccgtcagcgtaacgtcgtagctcggccnccgttccgntacgtaaacgtcggttcgaacggtnttacggtcctttttcccggtttaagtcggtttcgttttaacccaggttagaaccggttaagcggttaccgaacggggaacttcggtttcccacggtaaaccctaaagtttcccgtaggtacttaccgttaaagtcgggtttaaacnccgtaaccgtaccgtcgtactcggtacgtgttacgaccgtaggtactaacgtcgttaaggtcgttacggtcgtacggtgtaccgngtaaccgacggtacgtacggtactttaccgaacgtttacgaaacggtaaaaccgtcggggtaacccgggtttacggaagttacgggtacctaaggttacggttcggttaaacggttacttagttacccggaagttcggtacggtttanaccggttaacgg

SEQ ID NO: 221504 - DNA, 651 bp, Homo sapiens
  misc_feature: GYAE6OF02J00OC.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggaggggaggggaagtggggtagggaaagatcagtgtagagattgtgatgaccagactccagtctccttgtctctccaccctggagacgcacggccgtccacgtcgtcctcgctaggtctacgtctgccgcctcctgcagtcgtgacggagtcgtaccgtttccttttgttagtttggtttctcggtcgaggaggaggcgacggacctacgtcctaccaacctactccgtacgtacttctactaggtaacgttccgacccgtacccggtcttccgtggttacggacgtcgtacgaacgtaatagttcggtacggttaggtcggttacgttcgggtaacggtcggacggttacactacgtacgttacctacgtaaccgaaacgttaaacggaaaacgtccggggacgggtaagacggtacgtaccggtaacgtaggttaggttaacggttaacgttttacgttaacgttgaccgtagtacggtagtaagtacgg

SEQ ID NO: 221505 - DNA, 643 bp, Homo sapiens
  misc_feature: GYAE6OF02HNSP5.12.39.D06.1.454.CMB.1.raw
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggagggaatggggtgagaaagatccgagtgtagagattgtgatcgacccagactccagtctccttgtctctccaccctggagngcgacgcctccatcgtcctgctaggtctagtctgccgcctcctgctagtaggtggacgtatcgtcctttccttttgtatttcgttctgngaggagaggtcacggccagtccacccacaccttctagtattctagtagtaacgttccgacccgtacccggtctccgttcgtaggtacggtccgtacctagtaagttacgttcgttacgtaggtcggtcgtcgggtccgggtaccgacgggtaccaacggtacgtacttacctaaccgtaaccgtaaacgtaaacggaaaaaacgcggggtacccgggtagggtaacgggtacggtaacgtaccgtaacggttaggttaaccgttaacgtttaacgttaccgtacgtacgtacgttacgtaacgtaacgg

SEQ ID NO: 221506 - DNA, 625 bp, Homo sapiens
  misc_feature: GYAE6OF02G19OK.12.39.D06.1.454.CMB.1.raw
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatgacccagactccagtctcttgtctctcaccctggagancaggcctcatcgtccngcaggtctagtctcgccgtccctcctgcagttacgtcggacggtatcgtcccgtttcctttttagttagttttcggtttctcggtacgtaggtaacggcggtaccgacgggtcctaacgtcctaccgaactacgtctagacttcgtagtgtaacgtcgaccctacccggtctcgtcgtggacgtcgcctagtatagtgttagcggtgtcgtcgggtccgtacggagtaccctagacgtactccgtacaccgtaacgtaaacgaaaaccgcgggtaccgggtaggtaaggtacgtacgggtaacctttggtaacggttaacgttaactttacgttacgttacgtacgttaacgtaccgtagtaacgg

SEQ ID NO: 221507 - DNA, 633 bp, Homo sapiens
  misc_feature: GYAE6OF02H7YBY.12.39.D06.1.454.CMB.1.raw
  modified_base (292)..(292): a, c, t, g, unknown or other
  misc_feature (292)..(292): n is a, c, g, or t
  modified_base (619)..(619): a, c, t, g, unknown or other
  misc_feature (619)..(619): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctggtccctcgtaaggacagaaggagatggagggaggggaatggggtgaagaaagatccagtgtagagattgtgatcgacccagactccagtcctccttgtctctccacccctggagagcaggcctccatcgtcctgcaggttctagtctcgccgtcccttcncgcaagtgtcgaacggattcgtccttttccctttttgttagttttcggttttctgtacgaggaggtacggcgacgggtcctaacgtcctacccaacctaaccttccgtagacttcctaagtaggtacgtttccgaccccgaccccggtcttccgttcgttggtacggtcgaccgtaaggtacttgttgttactagggtcggtcgtcgggtcgggtccgaggacacgtaagactactacgaaccgtacgtaaacgaaaacgtcgggacgggtggaacggtacggtaccgaaccgtaggttacgtaggttaaactttagttaccgtagngtacgtcgtagaag

SEQ ID NO: 221508 - DNA, 640 bp, Homo sapiens
  misc_feature: GYAE6OF02F6FFD.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagattgtgatgacccagactccagtcctccttgtctctccacccctggagagcgacggccctccatcgtcctgcaggtctagtctgccgcctcctgccatagtggacggtatcgtctttcccttttgttattttggtttctggtctaggagacggcaggccagtcctccactaactcctgtactctagtgtaacgttcgacccgtacccggtcttccgtgtgggacgtcgtcccgaagtactagttcgttacgaggttcggtaccgttggtccggggtacgacggtacccagacgtacttaccgtacctaaccgtaaacgttaaacggaaaaacgtacggggtaccggggttaggaacggtaccggttaacggaacccttaagggtttcggtttaacgggttaaaccttttacgttaaccgtggtacttaacgtacgagtaacgg

SEQ ID NO: 221509 - DNA, 652 bp, Homo sapiens
  misc_feature: GYAE6OF02FLKHP.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggaggggaggggaagtggggtagaagaaagatccagtgtagagattgtgatgacccagacctccagtcctccttgtcctctccaccccgtggacgagcacggtccctccatcgtcctgctaggttctacggttctcggccgcccttccgtgctataggtgacggtatcgtcctttcccttttagttagttttcggtttctcgtacgaaggtacgaggccacggccgtacgttcctacccaacgtaacccttcctagtacttcgttaagtacggtaacgttcccgacccgtaccccggtcttaccgtcgtacgggtacgtcgaccgtaagtacttacgttgtttacgaggttcggcgttcgggcggtacgacggtcaacgtagtacttccacaaccgtaacgtaaacgaaacgtcggggaccgggtaggaacgaggttaccaacgttacggttacgttaacggtaactttagtacgtgactacggtactactaag

SEQ ID NO: 221510 - DNA, 677 bp, Homo sapiens
  misc_feature: GYAE6OF02IC3E1.12.39.D06.1.454.CMB.1.raw
  modified_base (208)..(208): a, c, t, g, unknown or other
  misc_feature (208)..(208): n is a, c, g, or t
tcagatacgacgtacacgaccggtgctcgatttagtgacatctcgcagttctttgggactgatcaggactcctcagttcaccttctcactatgaggctccctgctcagctcttggggctgctaatgctctcgggtcccgacgtaaggacagaaggagatggaggggaggggaagtgggggtgaagaaagatccagtgtagagtattgngatgacccagactcagtctcttgtctctccacccgtggagacgcacggtcctaccatcgtcctgctaggtctagtctgccgtccctctcgacagttacgtggacggtattcgtccttttcccgtttttagttacgtttcggtttactggtacgaaggtagacggtcgacgacctgtcctaccaaacctacgtccgtagtacttacgtaagtacggtaacgtttccgcccgtacccggtcccttaccgttcggtacgggtacgtcgaccgtacgtaagttacgttcgtttacgtagtttcggtacggttcggggtaccggtaacgcggtaacaacgtagtacgtacctacgaacttaaacgaacggaaaaaccgtcgggaccgggtaggacggttaacggccggttaaccgtaggttacggtttaacgttaacgtttaacgttagtacgtagttaacgtacgaactaagg

SEQ ID NO: 221511 - DNA, 721 bp, Homo sapiens
  misc_feature: GYAE6OF02FM4FQ.12.39.D06.1.454.CMB.1.raw
  modified_base (354)..(354): a, c, t, g, unknown or other
  misc_feature (354)..(354): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagagtggaggggagggaagtggggtagaagaaagactacgagtaggtagagtagttgtagagtcgaacccaacgacctacctacgttccttccgtttcgtccttcctcccgaccccgtggagacgcgacggccctccacttcgtccgtgcgtacggtacttacgtctcgccgtccctccgtgctaagtcgtcggacggtntcgttccttttccgttttgttacgttttcggtttcgagtcgaaggaggacggcgacggtacctacgtccctaaccctaacgtaaccttccgtacgttacttacttaagtacgtaacgtttccgacccgtacccgtctttcggtcggtacgggtacgcggtaccaagttacttaggttacgttccggaggttggtcccggtggggtaccgggtacgaacgtccgtaaacgtacgtaccttccgaacctaaacggttaaaccaaaggaaaaccgggtcggggtaccgggtaggacgggaacgttccgtaaaccgttggttaacggttaacttaacgtttacgttacgtccaggtagttaacgaggtaac

SEQ ID NO: 221512 - DNA, 687 bp, Homo sapiens
  misc_feature: GYAE6OF02JGVA5.12.39.D06.1.454.CMB.1.raw
  modified_base (264)..(264): a, c, t, g, unknown or other
  misc_feature (264)..(264): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgtctctcacccctgtagagtcaggcctccatcgtcctgcnggtctacgtctgcgcctctgcatagtgacgatcgcttcccttttgtatttcggttctgctagaggacggtcaggcctagtcctaccgaactaacgttccctagtacttccgtaatacggtaacgttccggaccccgtaacccgggtccttaccgttaccgttacgggtaacgttcggaccctaagggtactttaaggttcggtttacgtagggttacggtccggttcgggtaccgggtacgtacgggtaccgtaacgtacggtaactccgttacctaaccgtaaacggtaaaccggtaaaaaaccgcggggtaacccgggtaggggtaacggtaacgggtaccggtaacccgttaaggttacgggtttaacggttaaacgttttaacgttaccgtacgtacgtaacgtacgtaacgtaaacgg

SEQ ID NO: 221513 - DNA, 740 bp, Homo sapiens
  misc_feature: GYAE6OF02JW6GE.12.39.D06.1.454.CMB.1.raw
  modified_base (163)..(163): a, c, t, g, unknown or other
  misc_feature (163)..(163): n is a, c, g, or t
  modified_base (640)..(640): a, c, t, g, unknown or other
  misc_feature (640)..(640): n is a, c, g, or t
  modified_base (731)..(731): a, c, t, g, unknown or other
  misc_feature (731)..(731): n is a, c, g, or t
tcagatacgacgtacacgaccggtgctcgatttagtgacatctcgcagttctttggggactgatcaggactcctcagttcaccttctcactatgaggctccctgcctcagctcgtgggctgactagtctctcgttcggtcccgtacgtaaggacgagaagganagtggaggggagggaggtggggtagaagaagactcgaggtagtagatagttgtagatacgaccgagtactaccgtcgttccttccttcgtcctcctacctaaccccggtggacgacgaccggacggtcccctacgtcttccggtccgtcgaccggttaggttccgtacgttccgtccgggtcccgtacccgttccgtacggtacctagttacgggtaggaccggttacgtttccggtacctttttccccggtttttagtttcggtttttcggttcgttacggaccgttaagggacggaggtaccgtaccgggtaactacggtttcccacccgtaaaccgttactccgttagtacttactagtaaggtttccgtaccgtacccgtcccgtcttacgtccgtaggtccgtcggactacggtaagttcgttagtacgttcggagtccggtagggtccgacgtgacaccgtgtaactccgngtaaccttaagaaccggaaaccgtggtacgggagtacgtgtacccgtagtaagtcggttagttaaccttagtacgtacggatttacggganaccggtaac

SEQ ID NO: 221514 - DNA, 617 bp, Homo sapiens
  misc_feature: GYAE6OF02G53U8.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaagtggggtgagaaagatccagtgtagagtattgtgatgacccagactccagtctccttgtctctccaccccgtggacgagcacggcctccatgtcctgcaggtctagtctgcgcctccgtgcataggtcggacggatcggtcctttcccgttttagttacgttttggtttctgcgaggagacggtcgacggtccgtacgttcctacccaacgtaaccttcctagtactacgtagtacggtacgttccgacccgtacccgtcctactcgtggtcgtcgaccgtagtattgttagttacaggttcgcgtcgggtcggtacgacggcaacgacgtctcctacactaacgaaacgaaaacgcgggtaccgggtaggaacggtacggtacgaccggttaagttcggttaacgttaactttaggttaacgtcgtaacgtaggtcgtagtaacg

SEQ ID NO: 221515 - DNA, 672 bp, Homo sapiens
  misc_feature: GYAE6OF02H05H6.12.39.D06.1.454.CMB.1.raw
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagtattgtgatcgacccagactccagtcctcttgtctctccaccctgtagagcaggcctccatcgtctgcnggtctagtctgcctcctccngctagtaggtggacggtattcgtcctttcccgtttttgttacgttttcggtttctgcgaaggacggtacggacgtacggccctagtcctaacccaacctaaccttccgtagtacttacgttataacgggtaacgtttcccggcccgtacccgggtccttccgttacggtacgggtacgtacgaccgtaagtacgttagttcggtttacgagggttcggtacgttcggggccgggtacgcggtacacgtagtaccgttcctaacgaccgtaacgtaaacggtaaaaccggcggggtaccgggtagggtaacgtacggtacgaaccggttaggttaacggttaacgttaactttaccgttacgtccgaacgttagtacggaataacgg

SEQ ID NO: 221516 - DNA, 801 bp, Homo sapiens
  misc_feature: GYAE6OF02I7I98.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttggggctgctaatgctctcgggtccctcgtaaggacaggaaggagatggaggggaggggaagtggggtagaagaaagctccgaggtgtagagtattgtgatcgaccagactcagtctccgttgtctcctccgacccgtggacgacgcgacggccctacagttccgtcctgaccgtaggtcctaaggtctcggaccgtcccctcgtacgtacgtacttagggtacggaaccggttctccggtttacccccgttttttacccggtttttttaggggttttaaacgttttttccgggggtttttcctaacggggttaacccgaaaggggtaaccggttaaaccgggggcctaaaccgggggttaccccttaaaccggttacccgtaacccctaaaccggttaaaccctttccgtaacggttacttaacccgtttaggtaaggtaacccggttccggaccccggttacccggtccgttccgttaccggtggtacgtcgtaccgttagtaacgttacggttacgttacgtggtaccgggttcggtacgtccgggtactacgggtaccgtacgtacgtactcgtaccgtacgaacgttaaacgaaacggtacgggacggtaggaggtacgtcgtaacgtaggttacggttaacgttacgttacgttacgtacgtactagtaccgacgttaacg

SEQ ID NO: 221517 - DNA, 599 bp, Homo sapiens
  misc_feature: GYAE6OF02GWREJ.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgatgacccagactccagtctccttgcctctcacccctggagagcaggcctccatgtcctgcaggtctagtctcgccgtcctcctgctatagtcgacggatcgtccttccttttgtactttggtttctgctagaggtacggcgaggcctaggtcctaccactaactcctagtacttctagtgtaacgttccgacccgaccggtctcgttcgtaggtacgtcgaccgtagtactagttcgtacgtaggtcgtcgtcggtcgggtacaggacctacgtacgtactccgtacaaccgtagtaaacgaaaaccgtcgggtacgggtaggacgtacggtacgtaaccgtaggttacggttaacggttaactttacgttacgtacgtaccgtagtcggaataacgg

SEQ ID NO: 221518 - DNA, 837 bp, Homo sapiens
  misc_feature: GYAE6OF02JFKJA.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggaggggaatggggtgagaaagatccagtgtagagtagttgtgatacgacccgagacctccgagttcctccttcgtccttcctcccgtacccccgtggaacggacgaccgtacggtccctaccgtattccgtccgttcgccgttacggttacttacggtccgttacggcccgtccccgttccgtacgctaacgttggacggtaacggtacctcggttcccgttttcccgtttttaggttacgttttcggtttaccgtcggttcggaaaggtcgggtacggaccgtaccggttaccgtccgttaccctacccgaaaccgttaccgttaccgtaggttaccttaccgtaacgttacgggtaacggttcccgaccccgttcccggtccgttacgttacggtcgggtacgtccgtacgtaagtcgttaacgtttcgggttacgtacggggttcggtaaccgtcggggttaccggaccggttaacggacgtaacgtacgtaacctttcgtaaccgaaacgttaaaccggaaaacggttaacccgggacggggttaccggggtacgtaaacgggtaccggttaacggtaacccggttaaggttttaaccgggttaacggtttaaaaccgtttacggtttaaccggaccgtttacgtaaacggttaccggtaactaaacggg

SEQ ID NO: 221519 - DNA, 638 bp, Homo sapiens
  misc_feature: GYAE6OF02GL6YT.12.39.D06.1.454.CMB.1.raw
  modified_base (182)..(182): a, c, t, g, unknown or other
  misc_feature (182)..(182): n is a, c, g, or t
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
tcagatacgacgtacacgaccggtgctcgatttagtgacatctcgcagttctttggggactgatcaggactcctcagttcaccttctcactatgaggctccctgctcagctcgttgggctgctaatgctctcgggtccctcgtaaggacaggaaggagagtggaggggaggggaagtggggnggaagaaagactccgaggtgtagagtattggngaatcgaccgagacctccagtctccttgtcctctcccgacccgtggagacncgtacggcctacntcgtccngcgagtctgtctcgccgccgtcctggaactgacggtacgacggntcgttccttaaccgtttttntgtttcggttctagcgtagtagacggtacncggctgtaccttacgaactacgtcagtcctactaagtcgaacgttcgacctaccggnttccgngttgaggtcaccgagtctaagttcggtgacgttggtccgtaagggtcggtcgaacgtccgatacggttacaccgtctaaacggtacctaaagaaaacccggttgccgggggtagtacggtacggtaacccggtacttaacggttggggttaactaaccgtttaagtcgtaccgacggtactacggtaaccgtaagg

SEQ ID NO: 221520 - DNA, 721 bp, Homo sapiens
  misc_feature: GYAE6OF02HM925.12.39.D06.1.454.CMB.1.raw
  modified_base (154)..(154): a, c, t, g, unknown or other
  misc_feature (154)..(154): n is a, c, g, or t
  modified_base (173)..(173): a, c, t, g, unknown or other
  misc_feature (173)..(173): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (609)..(609): a, c, t, g, unknown or other
  misc_feature (609)..(609): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggngatggagggagggatgggngagaaagatccgagtgtagagtattgtgatcgacccagactccagtcttccttgtcctccncctacccgtggacgngcgacggtccctaccgtatcgtccgtagccgtaggttccgttagtcgtacggtccctcccttaccgtgacgttaagtaacgggtttcgaacgggttacttcggtccctttttacccgttttagttaggttttccgtttacgcgacggtaaggtaacggtcggccgtacggtacccgtcgttacctacccgtaactaacccgttcctaaggtaccttacggtattaaccggtaacgttcccggacccgtaaccccgtcgttccgttacggtacggtacgtacgtacccgtagtaacgttcgtcgttacgtacgtgggtccgtagggaccggtcgtacggccgtaacgtacgtacttaaccncgtaaaccgtaacgtaaacgtaaaacggtcgggtaaccggtagacggtacgtaaccgtacgttacggttaacgttacgtaagtttactgtacgtaacgtgtacggtacaagg

SEQ ID NO: 221521 - DNA, 778 bp, Homo sapiens
  misc_feature: GYAE6OF02GDUZI.12.39.D06.1.454.CMB.1.raw
  modified_base (155)..(155): a, c, t, g, unknown or other
  misc_feature (155)..(155): n is a, c, g, or t
  modified_base (578)..(578): a, c, t, g, unknown or other
  misc_feature (578)..(578): n is a, c, g, or t
  modified_base (754)..(754): a, c, t, g, unknown or other
  misc_feature (754)..(754): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggngatggagggagggaatggggtgagaaagatccagtgtagagtattgtgaatgacccaagtacctccacgttcttcccttgtccttaccgtcctacccccgtaggacggacgccgacggtccctacacgtcgtacctgccgtaggttcctaggtcctcgaccggtcccttccgtcgtacctacgttaaggtcggtaacggtacttcggttaaccccgtttcccttttagggttacgttttacgggttttccgacggttaccgtaacgggtacggtaccggtacccgtacgggaccctacgtttaccccgtaacctaacccggtaacccttccgtacgttaaccttacgttaaacgttcggtaaccggttcgacccccgtaacccgtgttacccttggtacggtaaccggttcacggtaacgttnacgtttcggtaccgaggttcggtcggttcggcgggtacctacgggcaaacgtcggtactaccgtccggacgtaaaccgtaaacggaaaaccggccggggtttaacgggtataaccgggtaggttaacccctaacgtttacgggttggttaaaccgttacgtttaacgtaaccgttnaccggtttaactcggaaagtaccg

SEQ ID NO: 221522 - DNA, 674 bp, Homo sapiens
  misc_feature: GYAE6OF02H0C74.12.39.D06.1.454.CMB.1.raw
  modified_base (319)..(319): a, c, t, g, unknown or other
  misc_feature (319)..(319): n is a, c, g, or t
  modified_base (579)..(579): a, c, t, g, unknown or other
  misc_feature (579)..(579): n is a, c, g, or t
tcagatacgacgtacacgaccggtgctcgatttagtgacatctcgcagttctttggggactgatcaggactcctcagttcaccttctcactatgaggcctccctgctcagctcttggggctgctaatgctctgggtccctcgtaaggacagaaggagatggaggggaggggaagtggggtgaagaaagatcgagtgtagagtattggtgatacgacccagactcctagtccttccttgtcctcctcccaccccgtgggacgagcacggcctaccatcgtccctgcaggttctagtctcgccgtccctcctgcagttggnggacggattcgtcctttcccttttgttagtttcggtttctcgacgaggacgacggctacggcctacgttccctacccaacgtaacctccgtagtacttacgttatacgggtaacgtttccgaccctaccccgggtcttccgtcgtgggtacgtaccggactaaggtacttaacgtttcgttacgaggttcgggtacgtcgggtacgggtccgaaggcctaacgcgttaatccgtaccaacgtaaccgtaaagaaaccggngggtaccgggtaggacgtacggtacgtaaccgttagttaccggtttaacggttacctttacttacgaccggttactaacgtaggtaaccgtaagg

SEQ ID NO: 221523 - DNA, 684 bp, Homo sapiens
  misc_feature: GYAE6OF02H8SAR.12.39.D06.1.454.CMB.1.raw
tcagatacgacgtacacgaccggtgctcgatttagtgacatctcgcagttctttggggaccgatcaggactcctcagttcacttctcactatgaggctccctgctcagctcttggggctgctaatgctctgggtccctcggtaaggacagaaggagatggagggaggggaagtggggtagagaaagatccagtgtagagtattgtgatcgaccagactcagtcctcttgtctctccaccctggagagcacggcctaccagtgtcctgcgtagtactagttctcgaccgccttcgtagcctaaagtacggttacggacggaattcgtaccctttcccgtttttagttagttttcggtttactcggtacgaagggtaacggacggaccgtaacggtccgtaacgttccgtaccaaacctaccgtccgttgtacttacgtaagtacgtacgtttccgacccgtacccggtctccgttacggtggtacgtacgtaccaggtaacttatttcggttaccgagggtttcggccggttcgggtaccggacgaacgggtcaacgtaacgtctaccctacgaaccttaaacggtaaacgtaaaacggcggttacgggtaaggacgtacgtaaccgaacgtagtttaggtaacgttaacgtttagttacgagtactagttacggaatagtaacg

SEQ ID NO: 221524 - DNA, 542 bp, Homo sapiens
  misc_feature: GYAE6OF02HH8XP.12.39.D06.1.454.CMB.1.raw
  modified_base (321)..(321): a, c, t, g, unknown or other
  misc_feature (321)..(321): n is a, c, g, or t
  modified_base (450)..(450): a, c, t, g, unknown or other
  misc_feature (450)..(450): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggagggaatggggtgagaaagatccagtgtagagattgtgattacccagactcagtctccttgtctctcaccctgagagcaggcctcatgtcctgcaggtctagtctgccgcctctgcatgtgacggatgccttccttttgtatttggtttctgctaggngagcaggccagtctcacactctgatctatgaattcgccaccgctctcgtggacgtgccagtatacgtgttcaggttgacgtggcggtcgacggtacacgagtctacctcgaacacgtaaacgaaaacgnggaccgggtagacggtacgtacgaaccgttaggttacggttaacggtaaacgtttacgttaccgtaggtacgtacgttacgacgtaagtacg

SEQ ID NO: 221525 - DNA, 623 bp, Homo sapiens
  misc_feature: GYAE6OF02JBCXI.12.39.D06.1.454.CMB.1.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (500)..(500): a, c, t, g, unknown or other
  misc_feature (500)..(500): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatgagggagggaagtggggtagagaaagatcagtagtagagattgtgatacgaccgatactccagtctccttgtctctcacccctgagagacncggcctacgatgtacccngaccaggtctacgtctcgcgccctctgcagttaacgtggacgtancgtcttccgttttatacgtttgttctgacgaganagacgacgaccagtcctacaacctacttacctacgaacttctagtaacgtaacgttccgacctaaccccggtctacgttccgagggttacgacgtaccgtaatacttagttacgttacgtagttcggcgtcggtcggactacggacgacgtacgntacgaacctaacgaacgtaaacggaaaacgccgggtaccgggtagaacggtaccggtaagaaaccgttacggtaggttaaccgtttaattaaccggtttacacggtatacgtagtaagtaacg

SEQ ID NO: 221526 - DNA, 654 bp, Homo sapiens
  misc_feature: GYAE6OF02F5ZFA.12.39.D06.1.454.CMB.1.raw
  modified_base (184)..(184): a, c, t, g, unknown or other
  misc_feature (184)..(184): n is a, c, g, or t
  modified_base (552)..(552): a, c, t, g, unknown or other
  misc_feature (552)..(552): n is a, c, g, or t
  modified_base (640)..(640): a, c, t, g, unknown or other
  misc_feature (640)..(640): n is a, c, g, or t
tcagatacgacgtacacgaccggtgctcgatttagtgacatctcgcagttctttggggactgatcaggactcctcagttcaccttctcactatgaggctccctgctcagctcttgggctgctaatgctctgggtccctcgtaaggacagaaggagatggagggaggggaatggggtgagaaagntccagtgagagattgtgatcgacccagactccagtcctccttgtcctctccacccgtggagagccgacggccctacctactcgtcctcgccgtaggtcctacgtctgcccgtcccttcctgacctaagtaggtaggacggatcgtcctttccctttttgttacgttttcgggtttcttggggcaaggacgtacgggcacggacctacggttacctacccaaaccgtacctccgtagtacttacgtacgtacgtaacgttccgaccccgtacccggtcctcgttacgtcggtacgttcggacctaagtacttaacgtttcggttacgtaggttcggtcctagggtccggtaacgacgacgaacgacgtntacctacgaaccgaacgtaaacgaaaacgacgggaccgggtaggtagacggtacaaccgtagttagggttaacgttaattcgtacgtnatagacgacgtaag

SEQ ID NO: 221527 - DNA, 848 bp, Homo sapiens
  misc_feature: GYAE6OF02HOCU0.12.39.D06.1.454.CMB.1.raw
tcagatacgacgtacacgaccggtgctcgatttagtgacatctcgcagttctttggggactgatcaggactcctcagttcaccttctcactatgaggctccctgctcagctccgttggggctgctaatgctctgggtccctcgtaaggcagaaggagatggaggggagggaagtggggtgaagaaagatccgagtagtagagtattgtgagtacgacctagacctaccgagttcttccttacggtctaccgtaccaaccccgtggagacgactacggccctaccgattccgtaccgtgaccgtaaggttccgttacgtacgtcggcccgtcccttaccgtcgtactaacgttaacgggtcggaaaccggtattcccggttaacccgtttttcccgtttttaggttaaccggttttggttttaccgtacggtaccgaagggaaccgtacggaccggacggtaccccttaaacggtccctaaaccccgtaaaccgttaaccttaccgtacgttaagtacgttagtaacgttacgtacccggtaaccccgacccggttacgtttccgtacggtacggtacgtcgtaaccgtaagttaacgtttagtaggtttacgttaaggtccgggttacgttacgggtaccgggtaacgtaaccgggtaacccgtaagtaacccggtaacgtacgttaaccgtaaaccgtaaaccggtaaaaccggtaaaaaacgtccggggtaaccggggtaagggtaacggtaacggttaaaccggaaccggtttaggttaaccgtttaaacgggttaacgtttaacgtttaacggtacgtaacgtaaccgggtataacggtaaacg

SEQ ID NO: 221528 - DNA, 857 bp, Homo sapiens
  misc_feature: GYAE6OF02I2V58.12.39.D06.1.454.CMB.1.raw
  modified_base (661)..(661): a, c, t, g, unknown or other
  misc_feature (661)..(661): n is a, c, g, or t
tcagatacgacgtacacgaccggtgctcgatttagtgacatctcgcagttctttggggactgatcaggactcctcagttcaccttctcactatgagctccctgctcagctcgttggggctgctaagtgctcgtcgggtccctacggtaaggacaaggaaggagagtaggaggggagggtaaggtggggtagaaggaaagactacgtaggtaggtagagtagttggtagagtacgaaccgacgtaacctccgacgttccttccgtttcgttccttcccgtaccccgtaccccgttaggtaacggaacgtaccgaccggtacccttacccgtagttccgttaccgtcggtacgttagggttaccgttacgttccgtcggccccgttcccgttccgttcgtaccggtaaggttaacgggtacgggtaacggtacgtttccgttaccgttttaccgtttttaggtttaacggtttttcgtttacgcggttacggacggtaaggacggtaaccgccggtaccgtaccttaaccgtacccgaaccttaaccgtcgtacttaacgttacttaacggtaactttacccgggtccgtacccggtacccgtaccttacgttcggtacgggtacgtacggtaccgtaagttacgttacggttacggttacgngggtccgtacgggtacggttaccggacgtaccggacgtaacgtacgtcgtaccttaacggtaaccctaacggaaaaccgaaaccggggtcgtaacgggggacgttacgggaaccggttaacgttccggttaacgttgtttaaacccgtttaacgttacgttacgggttacctaggttaacgacggtaacgtaacgg

SEQ ID NO: 221529 - DNA, 872 bp, Homo sapiens
  misc_feature: GYAE6OF02I4U30.12.39.D06.1.454.CMB.1.raw
  modified_base (326)..(326): a, c, t, g, unknown or other
  misc_feature (326)..(326): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctcgggtccctcgtaaggacagaaggagtatggaggggagggagtggggtagagaaagactccgagtgtagatagttgtgactcgaccagacctccagtcctcttcgtctcctaccgacccgtggagacgcgaccgtccctcctagttccgtcctcggtaccgacgggttaccttacggttccgttacgggtccccnccctttccggtcggacctaaggttaggtaccggggtaaccgggagtttaccggttaccccttttttccccggtttttaggttttaacggttttttcggttttccgtaggtaccgtaagggtaaccgggacggtacccgggaccgggtaccctaacccgggtttcctaaccccgtaacccgtaaaccttcccgttaggttaaccttacggtttacgtaaaccgggtttacgttccccgtaccccggtaaaccccggtttcttcccgggttaacgggttacggacccggttcggaccgttagttaacgttacgttccggtttaggtaccggttcgggccgtttcggggaccggttcgaaccggataccggtactaaccgttacctacccgtaaccgttaaaccggtaaacggtaaaccgtaaccgggggtacggggttaccgggtacgtaaacgggtaccgtttaaccggtacggttttaacgggttaaccggttaaacgtttttacggttacccggtgttaccccgtaggtacgtaacggttaacgg

SEQ ID NO: 221530 - DNA, 647 bp, Homo sapiens
  misc_feature: GYAE6OF02FHH3Z.12.39.D06.1.454.CMB.1.raw
  modified_base (303)..(303): a, c, t, g, unknown or other
  misc_feature (303)..(303): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatggagggagggaatggggtgagaaagatccagtgtagagattgtgatgacccagacctccagtctccgttgtctctccacccctggagtagcacggcctccatcgtcctgcaggtctagtctgccgcctccgtgcagtagtgacgntcgtccttcctttgtatttcggttctgctaggagtacggagacgggtaccagttcccacctaacgtaaccttccgtagtactacttagacggttaacgtcgacccgtaccggcttccgtaggtcggtacgtacgacctaaggtaactcgttaggttaccgtaaggttcggtacgttcgggtaccgggttacgaaggaccgtagtaacgtacttaaccgtacccaaacgtaaccgttaaaacggaaaaccggtccgggaccggggttagaacggtacggtaacgaacgttagttacggttaacgttaaacgtttacgtaccgtgaccgtattccggaactaacgg

SEQ ID NO: 221531 - DNA, 672 bp, Homo sapiens
  misc_feature: GYAE6OF02FP01C.12.39.D06.1.454.CMB.1.raw
  modified_base (340)..(340): a, c, t, g, unknown or other
  misc_feature (340)..(340): n is a, c, g, or t
tcagatacgacgtacacgaccggtgctcgatttagtgacatctcgcagttctttggggactgatcaggactcctcagttcaccttctcactatgaggctccctgctcagctcgttggggctgctaatgctcgtgggtccctcggtaaggacagaggagatggaggggaggggagtggggtagaaggaaagatcagtaggtagagtattgtgatacgaccagacctcctagttcctccgttcgtctccgtccacccgtggacgcgccgacggcctacagtcgtccgtagcgaggttcgtagtcgtcggcccgtcctccgtgactagttaggtcggacggtnttcgttcccttttccgttttggttacgttttcggtttcgtgacgtaggacggtacggcgacggtccgtacgtaccgtacccaaccttacctccgtagtacttacgtaacgtaggtacgtccggacccgtccgtcttcgtcgtaggcgttcacgtagtgttacgttgtcgtaggtcgtcgtgggtacggtgacggtagacgtacgtactccgaacaacgtaacggaaaccggaagggtaccggacggggtagtacggaggttaacgaccgtttagggttaaccgttaacggttaaactttcggtacgtacgtacgtaagacggtaacgtaacg

SEQ ID NO: 221532 - DNA, 609 bp, Homo sapiens
  misc_feature: GYAE6OF02FRQL5.12.39.D06.1.454.CMB.1.raw
  modified_base (156)..(156): a, c, t, g, unknown or other
  misc_feature (156)..(156): n is a, c, g, or t
  modified_base (266)..(266): a, c, t, g, unknown or other
  misc_feature (266)..(266): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
  modified_base (490)..(490): a, c, t, g, unknown or other
  misc_feature (490)..(490): n is a, c, g, or t
tcagatacgacgtacacgaccggtgctcgatttagtgacatctcgcagttctttggggactgatcaggactcctcagttcaccttctcactatgaggctccctgctcagctcttggggctgctaatgctctgggtccctggtaaggacagaagganagtcggaggggaggggaagtgggggtagaaggaaagactccgagtgtagagtattgtagatcgacccagacctcctagtcctccttgtcctcctccgacccgtggaacgngccacggccttacatcgtcctgctaggtctagttcgtgcccgtcctcgtgacgttatagggtgacgnttcgtcctttcgttttagtctttggtcnggngaggaggcgtcgacggtctacgtccacacgtacctcgtntactagtacgtagtacgttccacccgtacgtctcgtagcgtacgtcacgtagtactgttcgttagacgttcgaccggtgtccggtanacggcaacgtgtacctcacgtacctaaaggtaacgaaccggtacgggccgggtagaacgtacgacgttacgtacgttacgtaagttaccttcgttacgtccgattacgtacgtatacgg

SEQ ID NO: 221533 - DNA, 844 bp, Homo sapiens
  misc_feature: GYAE6OF02IDXVZ.12.39.D06.1.454.CMB.1.raw
tcagatacgacgtacacgaccggtgctcgatttagtgacatctcgcagttctttggggactgatcaggactcctcagttcaccttctcactatgaggctccctgctcagctcgttggggctgctaatgctcgtcgggtccctcgtaaggacaaggaaggagagtagggaggggaggggaggttggggtagaagaaggtactccgtaggttaggagagtagttggtagtactacgacccgtaagacctccgtacgttccgttccttgttacctcctacccgtacccgtgggaacgacgtcgcggtccctaccgtacgttcgtcgtcggactacggttcgtagtccgtcgccgtcctacgcgtactagtcggtacgacgtactttcgtaccgttttccgttttagtcgttttcggtttacgccgtacggtaacggtaaggccggtactacgggtaccctaggtccctaacctaaccgtaccgttcctaacgttacttagtacggttaacgtacccggttccgaccccgtcccgttacgtttccgtaccgggtggtaacgtccgaaccgttaagtacggtttcgtacggtttcggtacggtcgggttccgacggggtcccggtaggttaaccgggaccacgggtttaccaaccgtttacccgtaaaccgtaaaccgtttaacggaaaaacgggtaccccgggtaaggggtttcggggaaaccgggttagtaacgggttaaaccggtaaccggttttaaacggggttaccgggtttttaaaaacccgttaccggtttacggtaaacggtttccgttaaacccggtagttagggtaaccctaaaacggg

SEQ ID NO: 221534 - DNA, 734 bp, Homo sapiens
  misc_feature: GYAE6OF02HCDZU.12.39.D06.1.454.CMB.1.raw
  modified_base (628)..(628): a, c, t, g, unknown or other
  misc_feature (628)..(628): n is a, c, g, or t
  modified_base (691)..(691): a, c, t, g, unknown or other
  misc_feature (691)..(691): n is a, c, g, or t
  modified_base (731)..(731): a, c, t, g, unknown or other
  misc_feature (731)..(731): n is a, c, g, or t
tcagatacgacgtacacgaccggtgctcgatttagtgacatctcgcagttctttggggactgatcaggactcctcagttcaccttctccactatcgaggctccctgctcagctcttgggctgctaatgctcgtcgggtcctacgtaaggacaaggaaggagagtggaggggagggaagtggggtagaagaaagctcgagtcgtagagtagttgtgactccgacccagacctcctacgttctccgttgtaccttcctccgaccccgtggaacgacgtcgaccggtccctaccgtattccgtccgtacgtacgtacggttcctacggtctcggtcccgtccctaccgtagtacgagttacggcggtacgtacgttccgttacccttttccgtttagtttaccggtttacgtttcgacgtacggtacgtacgggtacgtacccggtaccgacctaccgtttacccgtaaccctaaccgtaaccgttccgtaacgtacgttaccgtaggttaaaccgtcggtcccgaccccgtaccgtcgttacgttcggtaaggtaccgtacgtaccgaagtttaaccgtgttaccgttacgtagggttaccggcggttaccggggacgtacgaacccggngttaaccgagttccctacgaaccgtacgaaacggtaacgacggtacgggcggttagcgtacgnaccgttaggtaccgttagtactgtccgagtgtacaggtanacg

SEQ ID NO: 221535 - DNA, 680 bp, Homo sapiens
  misc_feature: GYAE6OF02HN88C.12.39.D06.1.454.CMB.1.raw
  modified_base (285)..(285): a, c, t, g, unknown or other
  misc_feature (285)..(285): n is a, c, g, or t
tcagatacgacgtacacgaccggtgctcgatttagtgacatctcgcagttctttggggactgatcaggactcctcagttcaccttctcactatgaggctccctgctcagccttcttggggctgctaatgctctgggtccctcgtaaggacagaaggagatggagggaggggatggggtgaagaaagatccagtgtagagattgtgatcgacccagactccagtctcttgtctctccaccctggagacgcaggtccctccagtcgtcctgacgtacggtctagtcncgccgccttccagactacgtaggtacggacggtacgtcgtcccgtttccgtttttagttacggtttcggttttactacggtacgtaacgggaggtaacgggccgtaacggcccgtaaggttcctaaccccaaactaccgttcctagtaacttacggttaactaggtaaacgtttccgacccggtaacccggtcttacgttcgtacgggtcgtacgacgtaagtacgttagtcgtttacgaaggttcgggtacgtcgggtaccgggtaccggaagccgaagtacgtaacttccgtaaccacgtaaacgtaaaacggaaaacgcggggtacgggtagaggtacgtagaccgtaagttagttaacgtaacttagtacgtagtataacgtagactaagg

SEQ ID NO: 221536 - DNA, 781 bp, Homo sapiens
  misc_feature: GYAE6OF02HPMWJ.12.39.D06.1.454.CMB.1.raw
  modified_base (209)..(209): a, c, t, g, unknown or other
  misc_feature (209)..(209): n is a, c, g, or t
  modified_base (423)..(423): a, c, t, g, unknown or other
  misc_feature (423)..(423): n is a, c, g, or t
tcagatacgacgtacacgaccggtgctcgatttagtgacatctcgcagttctttggggactgatcaggactcctcagttcaccttctcactatgaggctccctgctcagctcgttgggctgctaatgctctcgggtccctaggtaaggacagaaggagagtggagggagggtagtggggtgaagaaagatacgagtagtagagtattgngagtacgaccagacctccgtacgttccttccttcgtccttcctacccgtaccccgtaggacgacgaccgacggtccccttaccgtagttccggttccgtgacgtacggttacgttacgttccgtcggcccgtaccccttcccgtacgacgtagttacggtacggaaccggtacgttcgttccctttccgtttttagttggttttcggttttcgnggtacgtaggtacggtacggtcgtaaccggtaccgtacggtacctaacccgaacctaaaccgtcgtaacgtacgttaacgttacggtaggttaaccgttacccgaccccgtaccgtcgttaccgttcggacggtacgtcgtaacgtattacgttagttcgttacggtacgggttacggtcggtacggtccgggtaacgcggaaccttaagtagtaccctaacgtaacgaacgtaaacggtaaaacggacgtacccggggtagggagtaacggtaccggtaataccggttagttaaccgggttactttaaaccgtttacggttaacggtacctaaggtaacggttacgaagttaaccgg

SEQ ID NO: 221537 - DNA, 873 bp, Homo sapiens
  misc_feature: GYAE6OF02J0PWE.12.39.D06.1.454.CMB.1.raw
  modified_base (358)..(358): a, c, t, g, unknown or other
  misc_feature (358)..(358): n is a, c, g, or t
  modified_base (855)..(855): a, c, t, g, unknown or other
  misc_feature (855)..(855): n is a, c, g, or t
tcagatacgacgtacacgaccggtgctcgatttagtgacatctcgcagttctttgggggactgatcaggactcctcagttcaccttctcactatgaggctccctgctcagctcgttggggctgctaatgtctccttgggtcccctaggtaaggacgaaggaaggagagtaggggaaggggaggggaaggttgggggagaaggaaagtactaccgtaggtacggtagtattagttagtggtactacgaacccagtaacttcctaggttaccttcctttggtaccttcctacccgtcccggttagggagacgcggtaacgccttccaaggttcgtcgtacgacgttacggtcttaggtcncgtccggaccttccgaatcgtaggttaagcgacgggtatcgtttacctttcgtttttaggtattttcggttccgttacggacggtaacgtaggacgggcgtaaaccggtaccttccgttaccgtaaacccggtaccttaaagggtacccgtactttaaagttttaaccgggtaaaccgggttacggtttaaaccgggtacccggttaacccggtacccggtttcccggtttaaccgggtttaccggtaccgggtaacggtacgtttaaacccggtaagtttacggtttacttacggttaccgggtttacggcgggtttacgggcccgggtccggtaacggtaccggaacggtaaccgttcggtaccgttacccggttaccgaaaaccgtaaaggtaaacccggaacgggtacggggtaaccgggtaggacggttaaggtccggtaacgttacgttaacgggttaaccgttaacttttaaccgggtcctaaccgtttnaaccgggttagataacgg

SEQ ID NO: 221538 - DNA, 171 bp, Homo sapiens
  misc_feature: GYAE6OF01CM21F.34.87.H10.1.454.CMB.1.raw
  modified_base (171)..(171): a, c, t, g, unknown or other
  misc_feature (171)..(171): n is a, c, g, or t
tcagtacacgtgatcacgaccggtgctcgatttagcagtactgcgttgggtttggggaagaggaagactgacggtccccaggagttcaggtgctgggcacagcggccctgggctgcctggtcaaggactacttccatcacgtgtactgagcgggctggcaaggcgcatagn

SEQ ID NO: 221539 - DNA, 252 bp, Homo sapiens
  misc_feature: GYAE6OF01EJ2LU.34.87.H10.1.454.CMB.1.raw
  modified_base (252)..(252): a, c, t, g, unknown or other
  misc_feature (252)..(252): n is a, c, g, or t
tcagtacacgtgatcacgaccggtgctcgatttagcagtactgcgtgggtctgggacagacttcactcttaccatcaacagactggagcctggagattttgcagtgtattactgtcaacagttggtctcacacacgtggacgttcggccaagggaccaaggtggaaatcaaacgaactgtggctgcaccatctgtcttcatcttcccgccatctgaatcacgtgtactgagcgggctggcaaggcgcatagn

SEQ ID NO: 221540 - DNA, 254 bp, Homo sapiens
  misc_feature: GYAE6OF01BFAOI.34.87.H10.1.454.CMB.1.raw
  modified_base (251)..(254): a, c, t, g, unknown or other
  misc_feature (251)..(254): n is a, c, g, or t
tcagtacacgtgatcacgaccggtgctcgatttagcagtactgcgtgggtctgggacagacttcactcttaccatcaacagactggagcctggagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcatagnnnn

SEQ ID NO: 221541 - DNA, 176 bp, Homo sapiens
  misc_feature: GYAE6OF01CPP6N.34.87.H10.1.454.CMB.1.raw
  modified_base (170)..(176): a, c, t, g, unknown or other
  misc_feature (170)..(176): n is a, c, g, or t
tcagtacacgtgatcacgaccggtgctcgatttagcagtactgcgttgggtttggggaagaggaagactgacggtccccaggagttcaggtgctgggcacagcggccctgggctgcctggtcaaggctacttccatcacgtgtactgagcgggctggcaaggcgcatagnnnnnnn

SEQ ID NO: 221542 - DNA, 173 bp, Homo sapiens
  misc_feature: GYAE6OF01E0QN6.34.87.H10.1.454.CMB.1.raw
  modified_base (173)..(173): a, c, t, g, unknown or other
  misc_feature (173)..(173): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtcaaggactacttccatcacgtgtactgagcgggctggcaaggcgcatagn

SEQ ID NO: 221543 - DNA, 173 bp, Homo sapiens; identical to SEQ ID NO: 221542
  misc_feature: GYAE6OF01DWJFM.34.87.H10.1.454.CMB.1.raw
  modified_base (173)..(173): a, c, t, g, unknown or other
  misc_feature (173)..(173): n is a, c, g, or t

SEQ ID NO: 221544 - DNA, 174 bp, Homo sapiens
  misc_feature: GYAE6OF01BF4IQ.34.87.H10.1.454.CMB.1.raw
  modified_base (173)..(174): a, c, t, g, unknown or other
  misc_feature (173)..(174): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtcaaggactacttccatcacgtgtactgagcgggctggcaaggcgcatagnn

SEQ ID NO: 221545 - DNA, 174 bp, Homo sapiens
  misc_feature: GYAE6OF01ADYFW.34.87.H10.1.454.CMB.1.raw
  modified_base (172)..(174): a, c, t, g, unknown or other
  misc_feature (172)..(174): n is a, c, g, or t
tcagtacacgtgatcacgaccggtgctcgatttagcagtactgcgttgggtttgggggaagaggaagactgacggtccccaggagttcaggtgctgggcacagcggccctgggctgcctggtcaaggactacttccatcacgtgtactgagcgggctggcaaggcgcatagnnn

SEQ ID NO: 221546 - DNA, 201 bp, Homo sapiens
  misc_feature: GYAE6OF01D0IVZ.34.87.H10.1.454.CMB.1.raw
  modified_base (173)..(201): a, c, t, g, unknown or other
  misc_feature (173)..(201): n is a, c, g, or t
tcagtacacgtgatcacgaccggtgctcgatttagcagtactgcggttgggttgggggaagaggaagactgacggtcccccaggagttcaggtgctgggcacagcggccctgggctgcctggtcaaggactacttccatcacgtgtactgagcgggctggcaaggcgcatagnnnnnnnnnnnnnnnnnnnnnnnnnnnnn

SEQ ID NO: 221547 - DNA, 178 bp, Homo sapiens
  misc_feature: GYAE6OF01A1P4X.34.87.H10.1.454.CMB.1.raw
  modified_base (171)..(178): a, c, t, g, unknown or other
  misc_feature (171)..(178): n is a, c, g, or t
tcagtacacgtgatcacgaccggtgctcgatttagcagtactgcgttgggtttgggggaagaggaagactgacggtccccaggagttcaggtgctgggcacagcggccctgggctgcctggtcaaggactacttccatcacgtgtactgagcggctggcaaggcgcatagnnnnnnnn

SEQ ID NO: 221548 - DNA, 174 bp, Homo sapiens; identical to SEQ ID NO: 221544
  misc_feature: GYAE6OF01BMT5D.34.87.H10.1.454.CMB.1.raw
  modified_base (173)..(174): a, c, t, g, unknown or other
  misc_feature (173)..(174): n is a, c, g, or t

SEQ ID NO: 221549 - DNA, 175 bp, Homo sapiens
  misc_feature: GYAE6OF01EGJBO.34.87.H10.1.454.CMB.1.raw
  modified_base (173)..(175): a, c, t, g, unknown or other
  misc_feature (173)..(175): n is a, c, g, or t
tcagtacacgtgatcacgaccggtgctcgatttagcagtactgcgttgggtttgggggaagaggaagactgacggtcccccaggagttcaggtgctgggcacagaggccctgggctgcctggtcaaggactacttccatcacgtgtactgagcgggctggcaaggcgcatagnnn

SEQ ID NO: 221550 - DNA, 252 bp, Homo sapiens
  misc_feature: GYAE6OF01C626G.34.87.H10.1.454.CMB.1.raw
  modified_base (249)..(252): a, c, t, g, unknown or other
  misc_feature (249)..(252): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgaactgtggctgcaccatctgtcttcatcttcccgccatctgaatcacgtgtactgagcgggctggcaaggcgcatagnnnn

SEQ ID NO: 221551 - DNA, 504 bp, Homo sapiens
  misc_feature: GYAE6OF01BYJVO.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctgggtcgtcggtgaacgtctcctgcgagacctctggagacgatttcactgtctttactgtcaattggtgcgacaggcccctggacaaggacttgagtggatgggcaggatcaccctccctctgggacacctctctacgcacagaagttccaggacagagtctcgattaccgcggacgaggtcacgtctacagtctacataactattatccactatcatctgacacacgccatctatactgtgcgagaggtggagaatcgacatacgtacccgtgaaccagagtgacg

SEQ ID NO: 221552 - DNA, 249 bp, Homo sapiens
  misc_feature: GYAE6OF01CLFSJ.34.87.H10.1.454.CMB.1.raw
  modified_base (245)..(249): a, c, t, g, unknown or other
  misc_feature (245)..(249): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgactgtggctgcaccatctgtcttcatctccgcatctgaatcacgtgtactgagcggctggcaaggcgcatagcnnnnn

SEQ ID NO: 221553 - DNA, 253 bp, Homo sapiens
  misc_feature: GYAE6OF01B2GCK.34.87.H10.1.454.CMB.1.raw
  modified_base (249)..(253): a, c, t, g, unknown or other
  misc_feature (249)..(253): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgaactgtggctgcaccatctgtcttcatcttcccgccatctgaatcacgtgtactgagcgggctggcaaggcgcatagnnnnn

SEQ ID NO: 221554 - DNA, 173 bp, Homo sapiens; identical to SEQ ID NO: 221542
  misc_feature: GYAE6OF01A8LF4.34.87.H10.1.454.CMB.1.raw
  modified_base (173)..(173): a, c, t, g, unknown or other
  misc_feature (173)..(173): n is a, c, g, or t

SEQ ID NO: 221555 - DNA, 322 bp, Homo sapiens
  misc_feature: GYAE6OF01AX47F.34.87.H10.1.454.CMB.1.raw
  modified_base (271)..(322): a, c, t, g, unknown or other
  misc_feature (271)..(322): n is a, c, g, or t
tcagtacacgtgatcacgaccggtgctcgatttagcagtactgcgtgggtcgtgggacagacttcactcttaccatcaacagactggagcctggagattctgcagttctattacttgtcaactaattttggcaactcgatttccgtttttccggcccttgggaccagagtggaaatcaaaacgaactgtcggctgcaccatctgtcttcatccttacccgcatctgaatcacgtgtactgagcgggctagggctaaaggcgtcattaaggnnnnnnnnnnnnnnnnnnnnnnnnnnnnnnnnnnnnnnnnnnnnnnnnnnnn

SEQ ID NO: 221556 - DNA, 252 bp, Homo sapiens
  misc_feature: GYAE6OF01C1U23.34.87.H10.1.454.CMB.1.raw
  modified_base (248)..(252): a, c, t, g, unknown or other
  misc_feature (248)..(252): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgaactgtggctgcaccatctgtcttcatcttcccgcatctgaatcacgtgtactgagcgggctggcaaggcgcatagnnnnn

SEQ ID NO: 221557 - DNA, 174 bp, Homo sapiens; identical to SEQ ID NO: 221545
  misc_feature: GYAE6OF01A14TP.34.87.H10.1.454.CMB.1.raw
  modified_base (172)..(174): a, c, t, g, unknown or other
  misc_feature (172)..(174): n is a, c, g, or t

SEQ ID NO: 221558 - DNA, 174 bp, Homo sapiens; identical to SEQ ID NO: 221544
  misc_feature: GYAE6OF01DDQ2K.34.87.H10.1.454.CMB.1.raw
  modified_base (173)..(174): a, c, t, g, unknown or other
  misc_feature (173)..(174): n is a, c, g, or t

SEQ ID NO: 221559 - DNA, 173 bp, Homo sapiens; identical to SEQ ID NO: 221542
  misc_feature: GYAE6OF01AOQ5K.34.87.H10.1.454.CMB.1.raw
  modified_base (173)..(173): a, c, t, g, unknown or other
  misc_feature (173)..(173): n is a, c, g, or t

SEQ ID NO: 221560 - DNA, 252 bp, Homo sapiens; identical to SEQ ID NO: 221550
  misc_feature: GYAE6OF01A9KNG.34.87.H10.1.454.CMB.1.raw
  modified_base (249)..(252): a, c, t, g, unknown or other
  misc_feature (249)..(252): n is a, c, g, or t

SEQ ID NO: 221561 - DNA, 543 bp, Homo sapiens
  misc_feature: GYAE6OF01D6GTV.34.87.H10.1.454.CMB.1.raw
  modified_base (482)..(482): a, c, t, g, unknown or other
  misc_feature (482)..(482): n is a, c, g, or t
  modified_base (535)..(535): a, c, t, g, unknown or other
  misc_feature (535)..(535): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctgggtcgtcggtgaacgtctcctgcgagacctcgtggagacgatttcactgtctttactgtcaattgggtgcgacaggcccctggacaaggcttgagtggatgggcaggactccacccctcctcgtcggaccacctctcctacgcaacgagtaacgttccgaaggacagacgtctcgtaacttacccggcggacgaggtcacgtctacagtcctactattaactattactccactatcatctacgacgactacgccatctattcngtgcgtaggacggtaggaagtaagtcgaactagtaccgtccgtagacgaaggngtggaacg

SEQ ID NO: 221562 - DNA, 543 bp, Homo sapiens
  misc_feature: GYAE6OF01BAQMR.34.87.H10.1.454.CMB.1.raw
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctgggctgaggtgaagaagcctgggtcgtcggtgaacgtctcctgcgagacctgtggagacgatttcactgtctttactgtcaattgggtgcgacaggcccctggacaaggacttgagtggatgggcaggactccacccctccctcgtcggacctaccgtctacctacgcaacgacgtaacgttccaggaacagacgtctacgaacttaccggacggacgacggtacacgtactacagtctaacaataactattactccacctatcatctagacgacacgcctatctattactgtacgcgagtacggtagaagaacgtcgaacagtacgccgtacanacgngtgaacg

SEQ ID NO: 221563 - DNA, 251 bp, Homo sapiens
  misc_feature: GYAE6OF01A2C63.34.87.H10.1.454.CMB.1.raw
  modified_base (248)..(251): a, c, t, g, unknown or other
  misc_feature (248)..(251): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgaactgtggctgcaccatctgtcttcatcttcccgcatctgaatcacgtgtactgagcgggctggcaaggcgcatagnnnn

SEQ ID NO: 221564 - DNA, 641 bp, Homo sapiens
  misc_feature: GYAE6OF01AVG90.34.87.H10.1.454.CMB.1.raw
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctggaggtgaagagccgtgggtcgtcggtgaacgtctcctgcgagacctcgtggagacgtattttcactgttctttactgtcaattgggtgcgacncggcccctggacaaggtcgtgagtggatgggcaggactccgcccctccgtcgtcggaccncctctccgtacgcacacgtacgttaccgaggacgagtacgtcctacggtaccttacggcggacgtacggtctacgtcgtaacgacgtacctaactattaactacttactccctaacttatacctagttccctaggaacccgtaaccgacccggtacctacgttaccttaacgtttacgtgtcggacggtaaggggtaagggtacgggtaaacgtaaacgtcggtaaaccctagttaaccgggtccccggtacgaaaccgtagggtaacggttcggtaaaccggg

SEQ ID NO: 221565 - DNA, 666 bp, Homo sapiens
  misc_feature: GYAE6OF01DEJL6.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctgggtcgtcggtgaacgtctcctgcgagacctcgtggagacgatttcactgtctttactgtcaattgggtgcgacacggccctggacaaggcttgacgtggatgggcaggatccacccctcctctcgggacctaccgtctcgtacgacaacgagtaacgttcccaagggacaggtacgtcgttacgtaactttaacccgggcggtaaccggacggttaccaaccggttcctaacgtacgttacccttaacaagtttaaaccttaagtttaactacccctaaacccttattacctaacgttcctacggaaccgtaacccgtacggtccctaagtttaccttactttaaccgttcggttacggaccggtaagggtaacgggtacgggtaaagtaaacgttcggaaacctagtaccggtcccggttaagacgtaaacggaggttgaaccggg

SEQ ID NO: 221566 - DNA, 173 bp, Homo sapiens; identical to SEQ ID NO: 221542
  misc_feature: GYAE6OF01D831I.34.87.H10.1.454.CMB.1.raw
  modified_base (173)..(173): a, c, t, g, unknown or other
  misc_feature (173)..(173): n is a, c, g, or t

SEQ ID NO: 221567 - DNA, 501 bp, Homo sapiens
  misc_feature: GYAE6OF01EAYGG.34.87.H10.1.454.CMB.1.raw
  modified_base (495)..(495): a, c, t, g, unknown or other
  misc_feature (495)..(495): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctgggtcgtcggtgaacgtctcctgcgagacctctggagacgatttcactgtctttactgtcaattgggtgcgacaggcccctggacaagggacttgagtggatgggcaggatcaccctcctctggacacctctctacgcacagaagttccaggacagagtctcgattaccgcggacgagtcacgtctacagtctacataactattatccactatcatctgacgacacggcatctattactgtgcgagaggtgagaaatcgacatacgcccgtgacagngtgacg

SEQ ID NO: 221568 - DNA, 260 bp, Homo sapiens
  misc_feature: GYAE6OF01C3T2D.34.87.H10.1.454.CMB.1.raw
  modified_base (194)..(194): a, c, t, g, unknown or other
  misc_feature (194)..(194): n is a, c, g, or t
  modified_base (248)..(248): a, c, t, g, unknown or other
  misc_feature (248)..(248): n is a, c, g, or t
  modified_base (252)..(260): a, c, t, g, unknown or other
  misc_feature (252)..(260): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggcctgggaccagagtggaaatcaaacgactgtggctgcaccatctgtcttnactccttcccgcctatctagaactcacgtgtactgaggcggctggacgaggcgnatgnnnnnnnnn

SEQ ID NO: 221569 - DNA, 755 bp, Homo sapiens
  misc_feature: GYAE6OF01A5B33.34.87.H10.1.454.CMB.1.raw
  modified_base (143)..(143): a, c, t, g, unknown or other
  misc_feature (143)..(143): n is a, c, g, or t
  modified_base (748)..(748): a, c, t, g, unknown or other
  misc_feature (748)..(748): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctntttgtggtggcagcagctacaggtgtccagtcccaatgcaacgtggtgcagtcgtggggctaggaggtgaagtaagcgtggggtcgtcggtagaaccgtctccgtgcgacgacctcgtggacgacgtatttccacgttgttacctttacgtagttactaaggtttggggtcgaccggtaacgaccgggtcccccgtagggaacgtaaacgggtctttaggaaggtgggtaacgcggggtaccgaaacggtcctacccccgtaaccccgttcccgtcggtaaccgggacccttaccgttactacccgttaacgggccctaaaccgaaggtaacccgtttaccgaagggtaacccgtaaggtaccgttaccgtaaccggtaacggtttaaccccgggacgggtaaacgggttaccggtaccctaacggggtttaccaaccggtaacctttacgaaccttaaacgttaaacttaacgtttaccctacccgtacttaataccgtactcgtacgaaccgtacctaccggaccttactaactacgttacgtggtagccggaagtaggagaacggaattcggaacagttacggacccgttagaagtacgagnggtaccg

SEQ ID NO: 221570 - DNA, 683 bp, Homo sapiens
  misc_feature: GYAE6OF01A90GM.34.87.H10.1.454.CMB.1.raw
  modified_base (297)..(297): a, c, t, g, unknown or other
  misc_feature (297)..(297): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctggggtcgtcggtgaacgtctcctgcgagacctcgtggagacgtatttcactgttctttactgtctaattgggtgcgacncggcccctggacaaggtacttgagtggagtgggcgaggtactaccgaccccctcctcgtcgggacctacccgtctcctacgcacagaacgttccaggacaggacgtctacgacgttaccggcggaacggtacggtaccacgttaccgtacacggtcctaactaattaaaccgttatttaaccgtacccctaacccttacttacacttcgtacgaacccggaccgtacccgacctacgttacttacgtttaaccgttcggttacggtaccggaagggtaggggtttacgggaaacggttaaaacgttcccggaaaaccgtaaaggttaccccggtaccccggggttaagaaacccgggttaagggaacgggttcgggtaaacccggg

SEQ ID NO: 221571 - DNA, 963 bp, Homo sapiens
  misc_feature: GYAE6OF01AFHGD.34.87.H10.1.454.CMB.1.raw
  modified_base (108)..(108): a, c, t, g, unknown or other
  misc_feature (108)..(108): n is a, c, g, or t
  modified_base (242)..(242): a, c, t, g, unknown or other
  misc_feature (242)..(242): n is a, c, g, or t
  modified_base (806)..(806): a, c, t, g, unknown or other
  misc_feature (806)..(806): n is a, c, g, or t
tcagtacacgtgatcacgaccggtgctcgatttagcagtactgcgttgggtttgggggagcatcacacaacaaccacattcctcctactaaagaacgcccctggggancacgagcgctactccaccgagtggactcggacccgtgggacggtttcccttgttttggtagggtcggaccaggcagtaccgtacgtggtcgttacccaacggttccccaaacgtggaccctaaggttggggacncgtaaggttccgggtggggccttaggggaaggtacggaaaacggaccgggtccgggtttcggggtaccggttccgggtaaaccgttaccccggggttccttcccccgggtaaggaacccgggtaaccgttccccgttaggggtacgggaaccgtaacgggttaaccttttccgtaaccgttcgtttaaccgttttcggtacgttaccggttaaggttcgggtcggtaaccgtacccgggtaaccgggtcccccgtaaggtaccgggtaaacggttccggtaacggtagggttacggagggttcgggaacgtacgggtacccttaccccgtaaccccgttcccggtcggtacccgggaacctcccgttaacccgtccgttacgaccgtaacgtacgtaaccggtacccgtaggtaaacgttccggtaccgttaccgtacgggtacccgttaacccggacggtaccggacgttactacccggttaaccgtacaccggttaactaacgttacgaactttcgtaaccaccttaccgtgttacctacgtacgaaccggtaccggaaccncccggtttacaacgttttaccttaacgttacggtgtaccggacccgggttaaaggtaccgggtaacgggtaacccttaaggtacccgggtaaacccttaacgggaccccggttaacgggaacccgtaagggacgttaaacggtccggggtaaacccg

SEQ ID NO: 221572 - DNA, 725 bp, Homo sapiens
  misc_feature: GYAE6OF01DA2K6.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggtaggttcctctttggtggtggcagcagctacgaggtgtccacgtcccaactcgacaacgtggtgctagtcgtgggctggagtagaagagccgtgggtcgtcggtacgacgtctccgtggacgacgtaccgtcgaggacgtacgtacttcacgttcgttctttacgtggttacgtaaggtttcgggagtcggaccgaccggtcccggtaggaacgaacggtacgttaggaggtggaggtcgggacgtaacggtacctaccccgtccccgttccgtacggtaccggtacctacccgtcctaccgtaccgaccgaacgtacgtaacggttaccgacggtaacgtacggtacgttccgacgtacgtaccggacggtacggtacgtccgtaacgtaccgtactacgtactaactacttaacgttaccttacctacccgttaacttacgtacctaacttacccggtacgaccgtacccgtacgtaccgtaacttacgttacgtacgtcggtacgtaccggtaaggtacggttaaggaacgtaacgtcgtaaccgtaaggtacccggtaccgacgtaacggtaggtagtcggtaacgg

SEQ ID NO: 221573 - DNA, 172 bp, Homo sapiens
  misc_feature: GYAE6OF02G0L5W.34.87.H10.1.454.CMB.1.raw
  modified_base (171)..(172): a, c, t, g, unknown or other
  misc_feature (171)..(172): n is a, c, g, or t
tcagtacacgtgatcacgaccggtgctcgatttagcagtactgcgttgggtttggggaagaggaagactgacggtccccaggagttcaggtgctgggcacagcggccctgggctgcctggtcaaggactacttccatcacgtgtactgagcgggctggcaaggcgcatagnn

SEQ ID NO: 221574 - DNA, 178 bp, Homo sapiens
  misc_feature: GYAE6OF02HE9NT.34.87.H10.1.454.CMB.1.raw
  modified_base (173)..(178): a, c, t, g, unknown or other
  misc_feature (173)..(178): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtcaaggactacttccatcacgtgtactgagcgggctggcaaggcgcatagnnnnnn

SEQ ID NO: 221575 - DNA, 173 bp, Homo sapiens; identical to SEQ ID NO: 221542
  misc_feature: GYAE6OF02IH9KS.34.87.H10.1.454.CMB.1.raw
  modified_base (173)..(173): a, c, t, g, unknown or other
  misc_feature (173)..(173): n is a, c, g, or t

SEQ ID NO: 221576 - DNA, 174 bp, Homo sapiens; identical to SEQ ID NO: 221544
  misc_feature: GYAE6OF02GIKMR.34.87.H10.1.454.CMB.1.raw
  modified_base (173)..(174): a, c, t, g, unknown or other
  misc_feature (173)..(174): n is a, c, g, or t

SEQ ID NO: 221577 - DNA, 172 bp, Homo sapiens
  misc_feature: GYAE6OF02IGXLS.34.87.H10.1.454.CMB.1.raw
  modified_base (172)..(172): a, c, t, g, unknown or other
  misc_feature (172)..(172): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctgtcaaggactacttccatcacgtgtactgagcgggctggcaaggcgcatagn

SEQ ID NO: 221578 - DNA, 171 bp, Homo sapiens; identical to SEQ ID NO: 221538
  misc_feature: GYAE6OF02GRW77.34.87.H10.1.454.CMB.1.raw
  modified_base (171)..(171): a, c, t, g, unknown or other
  misc_feature (171)..(171): n is a, c, g, or t

SEQ ID NO: 221579 - DNA, 199 bp, Homo sapiens
  misc_feature: GYAE6OF02HRQXK.34.87.H10.1.454.CMB.1.raw
  modified_base (173)..(199): a, c, t, g, unknown or other
  misc_feature (173)..(199): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtcaaggctacttccatcacgtgtactgagcgggctggcaaggcgcataggnnnnnnnnnnnnnnnnnnnnnnnnnnn

SEQ ID NO: 221580 - DNA, 175 bp, Homo sapiens
  misc_feature: GYAE6OF02F5KFY.34.87.H10.1.454.CMB.1.raw
  modified_base (173)..(175): a, c, t, g, unknown or other
  misc_feature (173)..(175): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtcaaggactacttccatcacgtgtactgagcgggctggcaaggcgcatagnnn

SEQ ID NO: 221581 - DNA, 177 bp, Homo sapiens
  misc_feature: GYAE6OF02IU81M.34.87.H10.1.454.CMB.1.raw
  modified_base (168)..(177): a, c, t, g, unknown or other
  misc_feature (168)..(177): n is a, c, g, or t
tcagtacacgtgatcacgaccggtgctcgatttagcagtactgcgttgggtttgggaagaggaagactgacggtccccaggagttcaggtgctgggcacagcggccctggctgcctggtcaaggctacttccatcacgtgtactgagcgggctggcaaggcgcatagnnnnnnnnnn

SEQ ID NO: 221582 - DNA, 175 bp, Homo sapiens
  misc_feature: GYAE6OF02GHVHX.34.87.H10.1.454.CMB.1.raw
  modified_base (174)..(175): a, c, t, g, unknown or other
  misc_feature (174)..(175): n is a, c, g, or t
tcagtacacgtgatcacgaccggtgctcgatttagcagtactgcgttgggtttggggggaagaggaagactgacggtcccccaggagttcaggtgctgggcacagcggccctgggctgcctggtcaaggactacttccatcacgtgtactgagcgggctggcaaggcgcatagnn

SEQ ID NO: 221583 - DNA, 173 bp, Homo sapiens; identical to SEQ ID NO: 221542
  misc_feature: GYAE6OF02FXZ18.34.87.H10.1.454.CMB.1.raw
  modified_base (173)..(173): a, c, t, g, unknown or other
  misc_feature (173)..(173): n is a, c, g, or t

SEQ ID NO: 221584 - DNA, 175 bp, Homo sapiens; identical to SEQ ID NO: 221580
  misc_feature: GYAE6OF02IEYJL.34.87.H10.1.454.CMB.1.raw
  modified_base (173)..(175): a, c, t, g, unknown or other
  misc_feature (173)..(175): n is a, c, g, or t

SEQ ID NO: 221585 - DNA, 178 bp, Homo sapiens
  misc_feature: GYAE6OF02IUMPN.34.87.H10.1.454.CMB.1.raw
  modified_base (173)..(178): a, c, t, g, unknown or other
  misc_feature (173)..(178): n is a, c, g, or t
tcagtacacgtgatcacgaccggtgctcgatttagcagtactgcgttgggtttggggggaagaggaagactgacggtcccccaggagttcaggtgctgggcacagcggccctgggctgcctggtcaaggctacttccatcacgtgtactgagcgggctggcaaggcgcatagnnnnnn

SEQ ID NO: 221586 - DNA, 250 bp, Homo sapiens
  misc_feature: GYAE6OF02GE48W.34.87.H10.1.454.CMB.1.raw
  modified_base (249)..(250): a, c, t, g, unknown or other
  misc_feature (249)..(250): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgaactgtggctgcaccatctgtcttcatcttcccgccatctgaatcacgtgtactgagcgggctggcaaggcgcatagnn

SEQ ID NO: 221587 - DNA, 174 bp, Homo sapiens; identical to SEQ ID NO: 221544
  misc_feature: GYAE6OF02GHDWH.34.87.H10.1.454.CMB.1.raw
  modified_base (173)..(174): a, c, t, g, unknown or other
  misc_feature (173)..(174): n is a, c, g, or t

SEQ ID NO: 221588 - DNA, 173 bp, Homo sapiens; identical to SEQ ID NO: 221542
  misc_feature: GYAE6OF02I2C2S.34.87.H10.1.454.CMB.1.raw
  modified_base (173)..(173): a, c, t, g, unknown or other
  misc_feature (173)..(173): n is a, c, g, or t

SEQ ID NO: 221589 - DNA, 581 bp, Homo sapiens
  misc_feature: GYAE6OF02GF6CH.34.87.H10.1.454.CMB.1.raw
  modified_base (165)..(165): a, c, t, g, unknown or other
  misc_feature (165)..(165): n is a, c, g, or t
  modified_base (169)..(170): a, c, t, g, unknown or other
  misc_feature (169)..(170): n is a, c, g, or t
  modified_base (172)..(172): a, c, t, g, unknown or other
  misc_feature (172)..(172): n is a, c, g, or t
  modified_base (175)..(177): a, c, t, g, unknown or other
  misc_feature (175)..(177): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
tcagtacacgtgatcacgaccggtgctcgatttagcagtactgcgttgggttgggggaagaggagactgacggtccccaggagttcaggtgctggcacagcggcctggctgcctggtcaaggctctccatcacgtgactgagcgggctggcaaggcgcagtacgnagcnncngcnnngagntancancngctgatcgnttcaagcgatgcngtcaancgtantgatacgtnactcgngcgacngcgacgttacagcgcgtacngcgngcgactgngngtaacngtacgtanacgtgaacgtcgagtcgngtaaacgcgngtacgtacgacgtacgtaaaacgtcgggtaccagtacgaccgtacgtaacgtacgtacgggtactacgtaacgtttacgaaacgtacgttaaacgtcgggttaacggacgttacccgggtacgtacgtacgtacgtacgtacgtacgtacgtacgtacgtacgtacgttacgtacgtacgtacgtacgtacgtacgtacgtacgtacgtacgtacgtacgtacgtacgtacgtacgtacgtaccgtacgtaccgtacgtacg

SEQ ID NO: 221590 - DNA, 174 bp, Homo sapiens
  misc_feature: GYAE6OF02F59YF.34.87.H10.1.454.CMB.1.raw
  modified_base (173)..(174): a, c, t, g, unknown or other
  misc_feature (173)..(174): n is a, c, g, or t
tcagtacacgtgatcacgaccggtgctcgatttagcagtactgcgttgggtttgggggaagaggaagactgacggtcccccaggagttcaggtgctgggcacagaggccctgggctgcctggtcaaggactacttccatcacgtgtactgagcgggctggcaaggcgcatagnn

SEQ ID NO: 221591 - DNA, 173 bp, Homo sapiens; identical to SEQ ID NO: 221542
  misc_feature: GYAE6OF02I1G69.34.87.H10.1.454.CMB.1.raw
  modified_base (173)..(173): a, c, t, g, unknown or other
  misc_feature (173)..(173): n is a, c, g, or t

SEQ ID NO: 221592 - DNA, 203 bp, Homo sapiens
  misc_feature: GYAE6OF02GVJV0.34.87.H10.1.454.CMB.1.raw
  modified_base (175)..(203): a, c, t, g, unknown or other
  misc_feature (175)..(203): n is a, c, g, or t
tcagtacacgtgatcacgaccggtgctcgatttagcagtactgcgttgggtttgggggggaaggaggaagactgacggtcccccaggagttcaggtgctgggcacagcggcctgggctgcctggtcaaggactacttccatcacgtgtactgagcgggctggcaaggcgcatagnnnnnnnnnnnnnnnnnnnnnnnnnnnnn

SEQ ID NO: 221593 - DNA, 178 bp, Homo sapiens
  misc_feature: GYAE6OF02HJEJH.34.87.H10.1.454.CMB.1.raw
  modified_base (174)..(178): a, c, t, g, unknown or other
  misc_feature (174)..(178): n is a, c, g, or t
tcagtacacgtgatcacgaccggtgctcgatttagcagtactgcgttgggtttgggggaagaggaagactgacggtccccccaggagttcaggtgctgggcacagcggccctgggctgcctggtcaaggactacttccatcacgtgtactgagcgggctggcaaggcgcatagnnnnn

SEQ ID NO: 221594 - DNA, 503 bp, Homo sapiens
  misc_feature: GYAE6OF02GH4D5.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctgggtcgtcggtgaacgtctcctgcgagacctctggagacgatttcactgtctttactgtcaattgggtgcgacaggcccctggacaaggacttgagtggatgggcaggatcaccctcctctggacacctctctacgcacagaagttccaggacagagtctcgattaccgcggacgaggtcacgtctacagtctacataactattactccacctatcatctgacgacacggccatctattactgtgcgagaggtgagaatcgacatacgccgtgacagagtgacgg

SEQ ID NO: 221595 - DNA, 671 bp, Homo sapiens
  misc_feature: GYAE6OF02FFHAT.34.87.H10.1.454.CMB.1.raw
  modified_base (202)..(202): a, c, t, g, unknown or other
  misc_feature (202)..(202): n is a, c, g, or t
  modified_base (325)..(325): a, c, t, g, unknown or other
  misc_feature (325)..(325): n is a, c, g, or t
tcagtacacgtgatcacgaccggtgctcgatttagcagtactgcgttgggttgggggagcatcacacaacaaccacattcctcctactaaagaacgcccctgggagcacagcgcatcaccatggactggacctggacggttcctcttggtggtggcagcagctacgaggtcgtaccacgtcccaacgtcgactaacgtggtncgtacgtcggtggggctagggaggtacggaacgtacggtccggtggggtcgttcggtacgtaaccgtctcgtgccgtacgtacctcggtaggacgtacgtacttcacgttcgtacttttacgngtacgtaaggttcgggacgaccgaccgaccggtcccgtaggaacgtaacggtctggacggtggacgtcggacacggtcctacccgtaccctccgtcgaccggtacctcctcgtaccgtacgaccgtacgtacgtacgtacgaacgcgacgtacgtactacggtaccgtcggacggtcgacgtcctacgtactacgtactacaacttataactatacctaccactctacagttaccgacgaccgacgtaccgtactacgtacttacgtacgtcgagtacggaggacgggtaacgaagtaccgtacgtacacggtaccggtccgtaagacggtaggacggtagaccgg

SEQ ID NO: 221596 - DNA, 672 bp, Homo sapiens
  misc_feature: GYAE6OF02HCV5R.34.87.H10.1.454.CMB.1.raw
tcagtacacgtgatcacgaccggtgctcgatttagcagtactgcgttggggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagagccgtgggtcgtcggtgaacgtctctgcgagacctcgtggacgacgtatttcacttgttctttactgtactaagttgggtgcgacacggcccctaggaccaaggtcttgacgtggagtcgggacaggtactcctaccccgtccgtacgtcggaacctaccttctaccgtacgccaacgaaggtacgttaccaaggtaccaggtactccgtacgaacttaccgggcggaaccgaggtacctaccgtctaacgacgttactaaccgtaagttaaaccttactttacacccgttaacttactcctaatccgttaaccgaccgaaccgaccggtacccttaattaccgttaacttaaccgtgtaacgacggtaacggtagggtaacggtaaccgaaagttaccggaactaacggttacccggtacccggaagttaaaccgacgggttacggtagtaaccggg

SEQ ID NO: 221597 - DNA, 581 bp, Homo sapiens
  misc_feature: GYAE6OF02FRT2Z.34.87.H10.1.454.CMB.1.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagtacacgtgatcacgaccggtgctcgatttagcagtactgcgttgggtttgggggagcatcacacaactaaccacattcctcctctaaagaagcccctgggagcacagcgtcatcaccatagggaacgtggacctcggagggttccctcttttgtggtcggcctagcagctacaggtgtccagtcccgaactgcaacgtggtgcagtctggggctggaggtgaagagcctgggtcgtcggtgaacgtctcctgcgagacctctggagacgatttcacttgtctttacngtcaattgggtncgacaggcccctggacaggcttggagtggatggggcagggctccgacccctcctcgtcgggaccaccgtctctacgcacagtaacgttccgaggaccagcgtctcgacttaccgcggacgaggtctacgtctacacgtctacattaactattactccactatcatctacgaccgtacaccggtacctacgttctacttacgtgtacgccgaggagggtcggaaagtaacgtccggaactacggtacggcccgttagaccgtacggtaggtggtaacgg

SEQ ID NO: 221598 - DNA, 716 bp, Homo sapiens
  misc_feature: GYAE6OF02H5837.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctgggctgaggtgaagaagcctgggtcgtcggtgaacgtctcctgcgagacctcgtggagacgtatttcacgtgttctttactgtctaagttgggtgcgtacgacggccccgtaggacaaggcttaggagtgggagtgggcgaggtactccgtacccctcccgtcgtcggtaccaccttcgtcctacggcaacgaacgtaacggttaccaacgggtaacgacgtaacgtcccgttacggtaacgtttacccgggccgggtaaccgtaacggggttacccaccggttacctaacgtacgttaccgttaaacctacttaaacgttaacttaacgtcccctaaccttatacctaacttaccgtaacggtaccgtaaccgaacccgggtacccttaagttaccttaagtttaaccgtcgggtacgtacggtaacgggtaggggttaaggtaaacggtaaaccgttacggaacctaagttaacccggcccggttaaggaaaccggtaacggtaggtacggaaccgg

SEQ ID NO: 221599 - DNA, 132 bp, Homo sapiens
  misc_feature: GYAE6OF02JCMAZ.34.87.H10.1.454.CMB.1.raw
  modified_base (128)..(132): a, c, t, g, unknown or other
  misc_feature (128)..(132): n is a, c, g, or t
tcagtacacgtgatcacgaccggtgctcgatttagcagtactgcgttgggtttgggcacagcggcctgggctgcctggtcaggactacttccatcacgtgtactgagcgggctggcaaggcgcatagnnnnn

SEQ ID NO: 221600 - DNA, 578 bp, Homo sapiens
  misc_feature: GYAE6OF02HBS5R.34.87.H10.1.454.CMB.1.raw
  modified_base (191)..(191): a, c, t, g, unknown or other
  misc_feature (191)..(191): n is a, c, g, or t
  modified_base (291)..(291): a, c, t, g, unknown or other
  misc_feature (291)..(291): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtncagtctggggctgaggtgaagagcctgggtcgtcggtgaacgtctcctgcgagacctcgtggagtacgtatttcacttgtctttactgtcaagttgggtncgacacggcccctggacaaggtctggagtggagtgggacaggactccaccccgtcctcgtacggacctaccgtctacctacgcacgagtaacgttccaaggacacgtacgtctacgtattaccggcggtaacgacggtcacgtctacgagtactacgataactattacacctactatctatcgtagacgtacgacgtcctacgtcttaacttctgtcgacgtaggtacgggtagaacgtaaagtccgaactacggtaccgaccgtagaactagggtagtcgtaacgg

SEQ ID NO: 221601 - DNA, 269 bp, Homo sapiens
  misc_feature: GYAE6OF02IK0QE.34.87.H10.1.454.CMB.1.raw
  modified_base (255)..(255): a, c, t, g, unknown or other
  misc_feature (255)..(255): n is a, c, g, or t
  modified_base (260)..(269): a, c, t, g, unknown or other
  misc_feature (260)..(269): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcattccttttcggccctgggaccagagtggaaatcaaacgactgtggctgcaccatctgtcttcatccttcccgccatctgaatcacgtgtactgacggcgggctggacaaggcgacagtaagngtacnnnnnnnnnn

SEQ ID NO: 221602 - DNA, 183 bp, Homo sapiens
  misc_feature: GYAE6OF02JWS8L.34.87.H10.1.454.CMB.1.raw
  modified_base (174)..(183): a, c, t, g, unknown or other
  misc_feature (174)..(183): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtacaaggactacttccatcacgtgtactgagcgggctggcaaggcgcatagnnnnnnnnnn

SEQ ID NO: 221603 - DNA, 596 bp, Homo sapiens
  misc_feature: GYAE6OF02GIH1T.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagaagcctgggtcgtcggtgaacgtctcctggcgagacctctggagacgatttcactgtctttactgtacaattgggtgcgacaggccccctggacaaggacttgagtggagtgggcaggatcccgacccctcccgtcgtcgggacctacctctactaccgtacaacaagtaacggttaccgaaggtaacaggtacgtcgtacgtacgttacccggcgggacgaggtcctacgtctacagtcctaacattaactattactcctattcctagtctactctacgtacgacgaccggacctacttacttaattaccgtagttcgacggtaggtacgggtaggaagtaacgtacgaactagtacccgtccggtacgactaggaggtacgg

SEQ ID NO: 221604 - DNA, 179 bp, Homo sapiens
  misc_feature: GYAE6OF02I3MA8.34.87.H10.1.454.CMB.1.raw
  modified_base (174)..(179): a, c, t, g, unknown or other
  misc_feature (174)..(179): n is a, c, g, or t
tcagtacacgtgatcacgaccggtgctcgatttagcagtactgcgttgggtttgggggaagaggaagactgacggtcccccaggagttcaggtgctgggcacagcggccctgggctgcctggtcaaggactacttccatcacgtgtactgagcgggctggcaaggcgcaatagnnnnnn

SEQ ID NO: 221605 - DNA, 621 bp, Homo sapiens
  misc_feature: GYAE6OF02H3PIK.34.87.H10.1.454.CMB.1.raw
  modified_base (263)..(263): a, c, t, g, unknown or other
  misc_feature (263)..(263): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgccaactggtgcagtcgtggggctgaggtgaagagccgtgggtcgtcggtgacgtctccgtgcgagacctcgtggagacgtntttaccacgtgttctttactgtactagttgggtgacgacgacggccctggacgtaggacttggacggtggagtgggacgaggactccgacccctcctcgtacggacacctctactcacacgagacgttcagacagacgtctacgtacgtaccgcggtacgtaggtcctagtcctagacgtacctaactaactaaacgttacttacctaccttaacctactactacttacctacggtacccaaccgtaccgtaccgtaacttccgttaagttactacgggttgtaccgggaggtaacggggtggtaaacgtaacgtaacgaactaagttaccgaccgtagacgtaagaggtacgtacgg

SEQ ID NO: 221606 - DNA, 842 bp, Homo sapiens
  misc_feature: GYAE6OF02IXF2L.34.87.H10.1.454.CMB.1.raw
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtgcagtcgtggggctgaggtgaagaagccgtgggtcgtcggtgaacgtctccgtgcgtacgacctcgtggagacgtaatttccactgttcctttactgttctaagttgggtcgcgacgacggccccgttggaacgtaacggtacttcggaggttgggtagtcggggacacgggtactcccgtaaccccgtccctggtaccggaccctaccgtccctaccgtacggaccgtaacgaaacgtaaccgttccgaacggtaaccgtaaggtacgttaccgttaccggtaaaccgtttaaccccggggacgggtaaccggtaacgggttacccgtaaacccggtttaccgtaacccgtaccgggttaacctttaacgtaaaaccgttttaaaccttaacgtttttaaaccctaccccgttaaaacccgtttaaacttacccgtaacgtttaccgttaaacgtaacccggaaacccgtaaccgggtaccccttaaagttacccgttttaaaccgttaccgttacgggttaccgggaaccgggtaacggtaacggggttaaacggtaaccggttaaaaacgtcccggtaaaccgttaaaaccggtcccggggttaacccggtttaccgaaaccgggtaacggtacggttaggtaaccggg

SEQ ID NO: 221607 - DNA, 271 bp, Homo sapiens
  misc_feature: GYAE6OF02I8RY2.34.87.H10.1.454.CMB.1.raw
  modified_base (242)..(242): a, c, t, g, unknown or other
  misc_feature (242)..(242): n is a, c, g, or t
  modified_base (248)..(271): a, c, t, g, unknown or other
  misc_feature (248)..(271): n is a, c, g, or t
tcagtacacgtgatcacgaccggtgctcgatttagcagtactgcgtgggtctgggacagacttcactcttaccatcaacagactggagcctggagattctgcagtctattattgtcaacaatttggtcactcatttccttttcggccctgggaccagagtggaaatcaaacgatgtgctgcacatctgtcttcatccttcccgcctatctagaactcacgtgtctgagcggctggcaaggcncagtgnnnnnnnnnnnnnnnnnnnnnnnn

SEQ ID NO: 221608 - DNA, 759 bp, Homo sapiens
  misc_feature: GYAE6OF02ILQMW.34.87.H10.1.454.CMB.1.raw
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (510)..(510): a, c, t, g, unknown or other
  misc_feature (510)..(510): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
tcagtacacgtgatcacgaccggtgctcgatttagcagtactgcgttgggtttgggggagcgatcacacaacaaccacattccctcctctaaagaagccccgtgggagcacagcgcatccaccagtggactcggacctggaggtttccttctttggtggtggccgaggcacgctaanggtntccagttccccaatcggacaactggtgcgtacgttccggtgggacgtggacggtaggaacgtacgtccggtcgggtacggtcggtaacgtaccggtccttaccggtcgaccggacgtcccgttacggtacggggaacgtaaccggttactttaccggtacggtttcgtttaacgttttaacggttacgttacggttaacgggtttggggtaccgaccggaaccggtaacccgggtaccccgtaaggaaccggtaacgtagttaccggtaggaggtaggggaccctaagggaccttcccgtacccccgtaccccgtagttaccgggaacnccgttaaccgtccgttacgaccacgaacgtaacggttaccgagtaccaggtaccgtctacggtaacgttaccgcggtaacgtggactcgtaccgtaacagtacctcgtaataagtctactccgaactntacntactgaccgctacgcctaagttacatttacgtgtcgacgtacgagggtaagtaacggtaacgtaccgtaagaccgttagggacccttagggaacgttacgaaggttcgtaaggtcgg

SEQ ID NO: 221609 - DNA, 746 bp, Homo sapiens
  misc_feature: GYAE6OF02IVGYS.34.87.H10.1.454.CMB.1.raw
  modified_base (191)..(191): a, c, t, g, unknown or other
  misc_feature (191)..(191): n is a, c, g, or t
tcagtacacgtgatcacgaccggtgctcgatttagcagtactgcgttgggtttgggggagcatcacacaacaaccacattcctcctctaaagaagcccctgggagcacagcgcatcaccatggactggacctggaggttcctctttgtggtggcagcagctacaggtgtccagtcccaactgcaactggtncagtcgtggggctggaggtgaagaacgccgtagggtcgtcggtgaaccgtctccgtgcgagacctcgtaggagtacgtatttcacgttgttctttacgtgtacgtaagttgggcgacgtaccgaccggtccccgtaggaacgaacggtacgttagaggtggagtacgggcgacgtacctaccccgtaccccttccgtaccggttacggaaccctacccgttcctaccgtaccgaccgtaacgtaacggtaaccgttaccgaggtaccgtaacgtacgttaccgtaccggtacggttaccccgggacgggtacggtacggttacctaccggttactacgtaccgttactaacctaactttaacgttacttaacccgtacctaacctttactacgtacttacggtaccgtaacccggacgtacccggtaccttacgttaacttacgtttaacgtgtaccggtcggtaacgggtacgggtaacggtaacgtaaaccgttccgaaccgttaacggtacccggtacccggttaggaaccgtagggtacgtacggtaacgg

SEQ ID NO: 221610 - DNA, 665 bp, Homo sapiens
  misc_feature: GYAE6OF02GU32C.34.87.H10.1.454.CMB.1.raw
  modified_base (192)..(192): a, c, t, g, unknown or other
  misc_feature (192)..(192): n is a, c, g, or t
tcagtacacgtgatcacgaccggtgctcgatttagcagtactgcgttgggtttgggggagcactcacacaacaaccacgattcctcctctaaagaagcccctgggagcacagcgcatcaccatggactggacctggaggttcctctttgtggtggcagcagctacaggtgtccagtcccaatgcaactggtncgagtcgtggggctggacggtagaagaacggccgtggggtccgtcgggtagaacggtctcctgcgacgtacctcgtggagacgtatttcacttgttactttactgtctaagttgggtcgcgacgccggtccccgtggaacaggtacttggaggtggagtgggacgtaggtactccctaccccgtccctcgtacgggacctaccgtcctacgtaccgtacaccgtaacgtaacgttacccgacggtaacaggtacgtccgtacgtaccttacccgggccgggtaaccgtaggtacccgtacggtacctaacggtacgttacccgtaactaacttaaaccttacgtttaacctaccctacttactctactacgtacgaccgtaccaccggtcctacttacctacttaacgcgtagcgtaggtaggtcggaaatagtccgtaatacgtcggaccgtagacgtacgtaggtctacgg

SEQ ID NO: 221611 - DNA, 246 bp, Homo sapiens
  misc_feature: GYAE6OF02JSXD4.34.87.H10.1.454.CMB.1.raw
  modified_base (147)..(147): a, c, t, g, unknown or other
  misc_feature (147)..(147): n is a, c, g, or t
  modified_base (184)..(246): a, c, t, g, unknown or other
  misc_feature (184)..(246): n is a, c, g, or t
tcagtacacgtgatcacgaccggtgctcgatttagcagtactgcgttggggtttgggggggaagaggaagactgacggtccccccaggagttcaggtgctgggccacgagcggccctgggctgcctggtacaaggactacttccatnacgtgtactgagcgggctggcaaggcacagtagcatnnnnnnnnnnnnnnnnnnnnnnnnnnnnnnnnnnnnnnnnnnnnnnnnnnnnnnnnnnnnnnn

SEQ ID NO: 221612 - DNA, 595 bp, Homo sapiens
  misc_feature: GYAE6OF01CPT0F.13.33.C11.1.454.CMB.1.raw
  modified_base (351)..(351): a, c, t, g, unknown or other
  misc_feature (351)..(351): n is a, c, g, or t
  modified_base (491)..(491): a, c, t, g, unknown or other
  misc_feature (491)..(491): n is a, c, g, or t
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggacctgtcccagctgcagctgcaggagtcgggcccaggagtggtgaagccttcggagaccctgtccctcagttgtatgtgtctggtcggctccctaagtaggactacttactacgtggggctggatccggcacgccccgagggaacgggcgtggagtggagttggggatatctcttataggtggagtacgaactacaactccgtccctnaaacggtagtcgagtcatcaatactcgtagaccaggtaccgaggtaacacttctaccctagtaaagtcgtagttctgtcgaccgttcgcgacgacacggtctgttacttattattggtgacgaggacggtactaaagttnttacgggttcgagggttgtaccgtacgttacggtcggggacaccggggtaaccctcggtccacccggtccttcctcgacgtcccaccgaaccgaccgggtcccc

SEQ ID NO: 221613 - DNA, 568 bp, Homo sapiens
  misc_feature: GYAE6OF01A31CS.13.33.C11.1.454.CMB.1.raw
  modified_base (293)..(293): a, c, t, g, unknown or other
  misc_feature (293)..(293): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgccccgagggacgggtcgnggaggtggtagttggggattatctcttagtaggtgggagtacgaactacactccgtaccacgaagagtcgagtacatcatactacgtagacgaggtaccgaggaactattcctaccgtagtaacgtgtagttctgtacgtaccgtcgacagacgacgtctgtactattntgngcgagacgntaaagtntggtacgaggtgttacgtacgtacgtcgggacgtacgggtacctaggtcccacgtcctcgtcacgccctaccgacgacggtaccccg

SEQ ID NO: 221614 - DNA, 545 bp, Homo sapiens
  misc_feature: GYAE6OF01EJNDW.13.33.C11.1.454.CMB.1.raw
  modified_base (460)..(460): a, c, t, g, unknown or other
  misc_feature (460)..(460): n is a, c, g, or t
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgccccgagggaaggggctggagtggagttggggatatctcttataggtgggagtacgaactacaatccgtcctacaagagtcgagtcatcatactcgtagacaggtccaaggaacgaattctccctagaaagtgagttctgtcgaccgtcgacagacacggctgtctatttatgtgcgagacgganaaatagtgttacagggtagttcgactacgtgggccgagggtaccctggtccaccgtctcctcgacgccctccaccgacggtaccc

SEQ ID NO: 221615 - DNA, 648 bp, Homo sapiens
  misc_feature: GYAE6OF01CQ4XZ.13.33.C11.1.454.CMB.1.raw
  modified_base (213)..(213): a, c, t, g, unknown or other
  misc_feature (213)..(213): n is a, c, g, or t
tcagtcacgtactacacgaccggtgctcgatttagagtgagctcgttgggtttggggatgctttctgagagtcatggatctcatgtgcaaagaaaatgaagcacctgtggttcttcctcctgctggtggcggctcccagagtggggcctgtcccagatgcagctgcaggagtcgggccaggagtggtgaacgccttcggagaccctgtccctnagttgtaatgtgtcgtggtggctaccgtaagtacgactaacttactacgtgggctggactccggacaccgcccggagggagggcgtaggagtggagtgggatagtctacgttagtaggtaggacgtaacgaactactaacgtcccgtacctagaacgtacgtacgaagtcaacttacaacttacgtaccgtaaggtaccgtaacgggtaccgaaacgggtaaacgtaacttcctacccgtaaggtaaacggttgtaacgttcgtagtacgtaaccggtcgacgaagaccgacggtcgttacgtacttagttagttgtagacgagacggtactaaagtagtggtacgaggtgtacgacgtacggtcgggaaccgacggtacccgtggtcccgaccgtcctacccgtacacgtcccgtaccaccggacggtaccccg

SEQ ID NO: 221616 - DNA, 573 bp, Homo sapiens
  misc_feature: GYAE6OF01EKVJ3.13.33.C11.1.454.CMB.1.raw
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttgggtccaggccgggggggtccctgagactctcatgtgcggcctctgggctcaccgtcaacaccaactacatgagctgggtccnccaggctccagggagaggccgggagtgggtctcagttatttatgtcgacggtgccacattctacgnagactccgtgaggggccgttcaccgatcctccagtagactaacttccaagaacacggtagtacgttacttacaaatacgaacgtacctgagagtcggaggacacggccgtctactactgtgacgaagatgacagaggacgggacccccggtagtcggggccgtgggtggagggttcttcgttgactgtcgtgggcgtaaccgggg

SEQ ID NO: 221617 - DNA, 903 bp, Homo sapiens
  misc_feature: GYAE6OF01CWRU3.13.33.C11.1.454.CMB.1.raw
tcagtcacgtactacacgaccggtgctcgatttagagtgagctcgttgggtttggggatgctttctgagagtcatggatctcatgtgacaagaaaatgaagcacctgtgttcttcctctgctggtggcggctcccagagtcgggcctcgtccagctgcagctgcgaggacggtccgggcccgagggaggtggtacgaacgtccgttcggacgtacccgtcgtccctcgtagtttagtaagtgtgtcgtgggtcgtacctaccgtaaggtacggtacttacgttacgtacgtcgggcgtcggacgtccggaccgaccggaccccggaaggggaacgggtcgtaggggacggttaggggtaaggtttagggtaagttacgtttacgttacgtttaaggttaagggttacgggtaacggttaaaccgtaaccgtaacgtaaccgttaccccgtaaccctacgtaaacggtaacggttacgtaacgttacgaacttacgtaacgtacgttaccggtaagacgtacggtaaccggaaggtaaacgtaacttccgtacgtaagtaagtcgtacgttactcggtacggtaccgtacgacgtaacggtacgtacggtccgttagttaccgtttaagtttacgttcgggttacggaaccggtaacgggttaaccgtaacgttaaaacggttacgggtttaaccgggtttaacgggaaacgggggttttaaccggttaaacccggtttacccgggtaaaccgggtttaccgggggggaaacccggttaacccgggggttaaacccggttttcccggtaaacccccggtttacccgtttaccccgtacccggttacccgaaaccccggttaccccttaaaccccgggaaccgggtaaaccccgggttacccccg

SEQ ID NO: 221618 - DNA, 661 bp, Homo sapiens
  misc_feature: GYAE6OF01A1YTG.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagagtggggcctgtcccagctgcagctgcaggagtcgggcccaggagtggtagaagtccgttcggacgaccctcgtccctctagttgtatgtgtcgtggtcgcctacctaagtagactacttactacgtgggctggtacgtccggcacgccccgagggacgggcgtgggaggtggtaggttggggattagtctacgttagtaggtagggtagtaacgaactacgtactacccgtaccctacgaacgtacgtcgactacatactatacgtccgtacgacgtaggtaccgaaggaactaattccgtaccgtagtaaggtcgtagttcgtgtacgtccgtacgacgagaccgacgtactgttacttaatcgttgcgtacggaacgtacggtataaacgttgttacggttacggagggtaacgttcgtaacgtacgggtccgggtaaccgaccgggtaccgttcgggtaccgtacccgttccgtacctacccgacgcccccgttaccaaacccggccgggtaacccccg

SEQ ID NO: 221619 - DNA, 932 bp, Homo sapiens
  misc_feature: GYAE6OF01BSRU6.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagcttgggttttccttgttgcttattttaaaaggtgcccagtgtgaggtgcagcgtggtggagtcgtggaggaggctttgatccaggccgtcggggggtccctgacgtacctccttcctgtcgcacgtccgtcgtcgggttccaccgtcacgtcaccacctacatgagcgtcgggccgcgaggcctccggaggggacggggctaggtagtcgtcgttctttactttttaatttagttaggttaggttaggtaacgttacgtaacttaccgtacccgtacaacggtaccgttaccgggtacgggggtacgggggacccgttaatttcccgaaaccctacgtttaccgtaacccgtaaggggaaacctaaaccttaaacgtttaaccccgaaaagtaaacccgtaccgggtttaccttttacgggttttttaaccccttaaaagttaaaacgtaccggaaaaccgttccggtacccggtttaaggaacgggtaacgtaccccgggtaaaggttacccggaaacccggggtacccgggggtttaccccgttttaaggttaacccgttttaccggttacggggtaacggtacccggggtaaaaggggtaacccgggttacccgggggtacccggggggtaaccccccccttaaaaagggggtttaaccccgggttttaaacccgtaacccggggttaccggtttttaaacggggtccccggggggttaaaaccccggggttttcccggggaaacccggggggggtaacccgtaaaaaccccccgggggggg

SEQ ID NO: 221620 - DNA, 647 bp, Homo sapiens
  misc_feature: GYAE6OF01EGJL6.13.33.C11.1.454.CMB.1.raw
  modified_base (419)..(419): a, c, t, g, unknown or other
  misc_feature (419)..(419): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccgaggccgggggggtccctggagactctcatgtgcggcctcgtggctcaccgtcaacaccaactacatgagcgtcgggtccgccgaggcctccgaggggaaggacgggccgggaggtgggtctacgtagttttactttagtggttcgacggtgccactacttctacgcagactcgtggacgggtccgtcaccatcncagagacaacttacaacgaactacggttatacttcttaacaaattacgaaccgtacctaggaacgacgtacggaacggacgaccggtccgtacttaacgttacgtggtacgacgaaagagtcgacgaacggtacggaccgggtaccccggttaaggtccggggtacgtgggttcgggtcgggttctttcggtttcgaccgttggccggttcggggcccgtaaccgggg

SEQ ID NO: 221621 - DNA, 695 bp, Homo sapiens
  misc_feature: GYAE6OF01C86R0.13.33.C11.1.454.CMB.1.raw
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagcttgggttttccttattactaattttaaaaggtgtccagtgtgaggtgcagttggtggagtctgggaggaggcgttggtccgaggcccgggggggtccctggacgactctcatgtgcggcctcgngggctcaccgtacaacaccaactacatgagctggccncaggctcgagggagacggccggagtcggtctcgtagtttattagtgtacgacggtcgacctactactttcacgcacgtacgtccggtagggacggggtcccgttacacctatcctaccgaagacgaacgtaattacccgaaagaacgtacggtagttacttcttaactaaatacgaaccgtacgtaggaagtacggtacggaacggaccgtaccggaccgttacttaacgtttacgtaggtacgaacggaaagtagtcgacgaaggaacgggacccggggtaccccgtaaagggttccgggggaccttgggggttacgggttacggttttccgttttacggttcgggtaacttgggcccggttcgggggacccgtaaacccggggg

SEQ ID NO: 221622 - DNA, 605 bp, Homo sapiens
  misc_feature: GYAE6OF01CYTMX.13.33.C11.1.454.CMB.1.raw
tcagtcacgtactacacgaccggtgctcgatttagagtgagctcgttgggtttgggggggagaggagcccagcactgggattccgaggtatttccattcggtgatcggcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtggttcaccgtcagtcacacctacatgacgctcgggtccgccgaggcctaccgaggggaaggggctgggagtgcgtcttcttttattatagtagtggtatacatactcgcagactcggtgacggggcctagtcaccatcctacagacgactaacttaccgaaagaacctacgtcttacgttttacttactaaactagaaacctagtaccttagacgacacgaacgtgaaccgacgggtccgtagttacttacgtcgttagacgtaagagtaggtccgggacccgacgtaacggttactacgtactagtcgggacgtcgtcggggaccgaagggtaaccccg

SEQ ID NO: 221623 - DNA, 555 bp, Homo sapiens
  misc_feature: GYAE6OF01DJRNN.13.33.C11.1.454.CMB.1.raw
  modified_base (213)..(213): a, c, t, g, unknown or other
  misc_feature (213)..(213): n is a, c, g, or t
  modified_base (404)..(404): a, c, t, g, unknown or other
  misc_feature (404)..(404): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagtcacgtactacacgaccggtgctcgatttagagtgagctcgttgggtttggggatgctttctgagagtcatggatctcatgtgcaagaaaatgaagcacctgtggtttcttcctcctgctggtggcggctcccagatggggcctgtcccagctgcagctgcaggagtcgggcccaggagtggtgaagcctttcggagaccctgtccctnagttgtaatgtgtctggtggctcctaagtaggactacttactactgggctggatccggcacgccccgagggaacgggctggaggtggagttggggatatctcttagtagtggagtacgaactacaactccgtccctacaagagttacgagtcatctatatacgtagactacgtaccaggtaaacgacttcncccgtagtaaagtgtagttctgtacgaccgtcganacgacacggntgtctatntgtgacgagacgtactaaatagtggttcagggtatccgatacgtgggactacgggacctggtccaccgtctcctacacgccctccgactacgggtccc

SEQ ID NO: 221624 - DNA, 859 bp, Homo sapiens
  misc_feature: GYAE6OF01B0649.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacaacagaggactcaccatggagttttggctgagctgggttttccttattactattttaaaaggtgtccagtgtgaggtgcagttggtggagtcgtggaggaggtcttggtccgagggcccggggggtccctgagactctcatgtgcggcctcgtgggctcacccgtacaacaccaactacatgagcgtcgggtcccgccgaggcctacccggaagggggaacggacgggccgggtaggttcggggtcctacgtaaggttttaattttagtcggttccggtacgggttcgacccgtaactacgtttaccgtacgacgaaggtacccgtaccgggtcgggacgggggtcccggtttaccgacccctattcccgtacccgaaggaacgtaacctaaacgttacccgaaaacgaaccgtaacgggttacgttaacttacttaacgtaaaactacggaaacccgtaaccgttacggaacggtaacggtaccgggaacggtaaccggtaccgggtacccggtttaccgttaacgtttaccgttcggttacggaacggtaaacggtagtacggacgtaaacgggaaccgggaacccggggtaaccccccgggtttaagggtccgggggttacccgggttacgggggttcgggggtaaccggggtttttcccggttttccggtttttaccgggtaaccggtttccggggttacccgggttcccggggggtaaccccggttaaacccgggggg

SEQ ID NO: 221625 - DNA, 753 bp, Homo sapiens
  misc_feature: GYAE6OF01BOWZ0.13.33.C11.1.454.CMB.1.raw
tcagtcacgtactacacgaccggtgctcgatttagagtgagctcgttgggtttggggggggagaggagcccagcactgggattccgaggtatttccattcggtgatcagcactgaacacagaggactcaccatggtagttttggctgagcttgggtttttccttattactattttaaaaggtgtccagtgtgaggtgcaggttggtggagtcgtgggaggaggcttggtccgagggccgggggggtccctgagactctcatgtcgcggcctcgtgggctcaccgtcaaccaccaaactacatggacgtcgtcggggtccgccgaggcctccgaagggggaaggagggcccggggaggttggggtcctacgtagttttattattcggtcggtacggtcggcctactactttccacgcgacgtaaccttccggtggggacgggggtcccggttaccaaccgtacttcccgtaccgaaggaaccgaactaacttacccgaaacgtaaacgacgggttagtaacttcgttaacaaacgtacggaaccgtaaccgtggaaggtacggtacggtacgggacccgtaccgggtccgtactttaacgttaccgtgggtaacgacggaaaagagtcggaacgacggaacggggacccgggtaacccccgggtaacgggtccgggggtaccggtggggttacgggttcgggtttactttcggttcggtactcgggtacggttcgggggaccgtaacccggggg

SEQ ID NO: 221626 - DNA, 843 bp, Homo sapiens
  misc_feature: GYAE6OF01EY36G.13.33.C11.1.454.CMB.1.raw
  modified_base (209)..(209): a, c, t, g, unknown or other
  misc_feature (209)..(209): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggtagttttgctgagcgttggttttctgtagctattaaagcgccagtgtgagtgcagcgtggtgagtcgtaggaggngtcttgactccgaggtccggttcggggtccctaggaacgtccttcgtccgtggtcgacgtaccggtccttcggttacggtaccgtaccgtacgtacgttaccaacctaccgttacgtaggtacggaccggttcgtcggggtacccacggtacggtaccgttaccggggaagggggtaccggtcgtacggggacgttcggtccgtttacgttttacgttttaagttaaccggtagggttacggttcggtaaaccgttactaacgtcccgttaccggaaccgtacggtaacccgttcggggtacggtaccggggtacctcttaacccgtacgttaaccgtccgtaacgacggtaaacgttacctaaaccgttaccgaaacgttaccgggtacttcgggttttaacttaccgtaaacgaacgttaccggtaacgaccgtttacggtaggtaccggtaaccgtaccggttaaccgacgggtaaccccggttacggttaaccctttagggttacctagggttccgaagggttaccggacggtaacgttaccgggtacccggtaacccgttaaggttacccgttaccggtagttacggtacggtacgggttaccggcggttaagggaaacccgtaccggg

SEQ ID NO: 221627 - DNA, 732 bp, Homo sapiens
  misc_feature: GYAE6OF01BXA7B.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcgaggagtccgggcccaggagtggtgaagccttcggacgaccctcgtccctcagttgtaatgtgtcgtggtgctcctaagtaggtactacttactacgtgggctggactccggcaccgcccgaggggaagggcgtggaggtggagttggggatagtctacttagtaggtgggagtacgaactacaactccgtcctacgaagacgtacgacgtacattcaatactaccggtacgaacgacggtaccgaaaggtaaaccgtaactttaccgtacccgtaagggtaaacgttgtaacggttttacgtacggttacggaccggttacgacgtacggtaaccgtaccggtcgttacgttactttaagtttagtttagggtacgaccggaacgggtaacggaaccttaaagttacggtttacgggttacggaagggttacggttaccggtaaccgttacgggtacgggggtacccggtaaacggggtaaccccttacgggtaccctaacccgggttccctaccccgttacggacccgtaccccgtaacccgtaaccccggaaccgggtacccccc

SEQ ID NO: 221628 - DNA, 796 bp, Homo sapiens
  misc_feature: GYAE6OF01BP412.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctggttttccttattactattttaaaggtgtccagtgtgaggtgctagttggtggagtcgtgggaggaggtcttggtccgacgggcccgggggggttcctggagactctcatgtgcggcctcgtgggctcaccgtacaacacctaactacatgagtccgtgggtccgccgaggcctaccgaaggggaaggacgggccggtaggtcggggtcttacgtagttttatttagtcggtcggtacggttcgacctacgtactttccgtaaccggccaagtaccgttcccgggtagggtaaccgggggtcccggtttaccaaccccgtacttcccgtacccgtaaggtaccgtaaaccgttaacgttaacccgaaaacgtaaccggtaaccggttagttaaccttaccgtttaacgaaaacgttacggaacccggtacctaaggaggtaacgtacggaacggtaacccgtacgggcccgttaattaccgttagtacgggttacgaacggtaaagtacgtaggacgtaacgggacgggtacccggggtacccccgttaagggtcgggggtacccgttagggggttcgggtttaacgggtttcctttacgggtttaggtaccggtgggtccggtccgggggacccgtaaacccgggg

SEQ ID NO: 221629 - DNA, 862 bp, Homo sapiens
  misc_feature: GYAE6OF01D8JT0.13.33.C11.1.454.CMB.1.raw
  modified_base (353)..(353): a, c, t, g, unknown or other
  misc_feature (353)..(353): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggtagttttggctgagcttgggttttccttattacttaattttaaaggtgtccagtgtgaggtgcagttggtggagtctgggaggaggcttggtccgagggccggggggtccctgagactctcatgtgcgcctcgtggctcaccgtcaaccaccaactacatgagctgggtccgccaggctccgagggaagcggccggagtgggtctcgagtttatttagngtcggacggtcgccaacgtattctacgcacgactccggtaggacggggtccgttaccaccgtatcctaccgaagtacgaacctaacgtttacccgaaaacggtaaacccgtaccggggtttacgttaacgtttaccgtttaacgtaaaacgttacgggtaaacccgtaacccgttaagggaacgggtaacggttaaccgggaaacgggaacccggtaacccggggtacccggttaaccgtttaaacgtttaccggttacgggttaacggtaaaccggggtaaaaacggtacgtacgggtaaccgaaacggggtaaacccggggtaaccccggggggttaaaccccccccgggtttaaagggggttcccgggggggttaccccggtttaggggggtttacgggggttaacccgggggttttttccgttttaccgggttttaccgggttaaccggtttccggggttacccggggttaccggggggtaccccgggttaaaacccccgggggg

SEQ ID NO: 221630 - DNA, 551 bp, Homo sapiens
  misc_feature: GYAE6OF01D53VM.13.33.C11.1.454.CMB.1.raw
  modified_base (446)..(446): a, c, t, g, unknown or other
  misc_feature (446)..(446): n is a, c, g, or t
  modified_base (478)..(478): a, c, t, g, unknown or other
  misc_feature (478)..(478): n is a, c, g, or t
  modified_base (515)..(515): a, c, t, g, unknown or other
  misc_feature (515)..(515): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtctcttttatttatagtagtggtagtacatactccgcagactccgtgaggggccattcaccatctccagagacaattcccaagtaacacgtctagttttcttacaaatgaaacngcctgagagccgatgacacggcctgtattacngtgcgtagagagtcggggccccaacggaccgtttacnccgactctagggacgtcgtggggccctaaacggggg

SEQ ID NO: 221631 - DNA, 800 bp, Homo sapiens
  misc_feature: GYAE6OF01DI0WM.13.33.C11.1.454.CMB.1.raw
tcagtcacgtactacacgaccggtgctcgatttagagtgagctcgttgggtttgggggggagaggagcccagcactgggattccgaggtatttcccattcggtagatcagcactgaacacagaggactcaccatggagttttgctgagcttgggttttccttattacttagttttaaaaggtgtcctagtgtgaggtgctaggttggtaggtagttcgtgggagggaggtcgtttggtcccgaggggtcccgggggggtccctaggacgtaccttacgtccagttggcggccggtcccttcggtcgggccttccgaccgtaaccaaccaaccgaacctaacagtcggacgtccgttcggggtacccctcggacggtccgttaccggaagggggtaacggacggggccggtaggtcgggttacctacgttagttttacttttagtcggtacggcggtccgacctactacttccgtacactacggtaccgttccggagggtaccggggtcccgttaaccacgtactccgtacgagtaacgactaacgttaaccgaaagtaaccgtacggtcgttacttaccgttaactaaacgtacgtaaccgtacgtaggacggtaggtacggaacggaccgaccggtaccgttacttacgtttacgtaggtacgaacgtaagtacgtgacggacggtacgggacccgggtacccggtacgggtaccgggtaccggttggggttacggttacggtttcgtttacgtttcggtaccgttacggtccgggtcggggtacccggtaacccgggg

SEQ ID NO: 221632 - DNA, 847 bp, Homo sapiens
  misc_feature: GYAE6OF01BEKI5.13.33.C11.1.454.CMB.1.raw
  modified_base (172)..(172): a, c, t, g, unknown or other
  misc_feature (172)..(172): n is a, c, g, or t
tcagtcacgtactacacgaccggtgctcgatttagagtgagctcgttgggtttggggatgctttctgagagtcatggatctcatgtgcaagaaaatgaagcacctgtggttcttcctcctgctggtcggcggctcccgagagtggggcctgtcccagctgcagctgcgaggngtccgggcccaggtagtggtcgaacgtccgttcgggactaccctcggtccctacgtagtttagtaagttgtcgttcgtcggtcggtcctacccgttaaggtacggtaccttaccgttaccgtacggtcgggtacgtcggtacgtccggaccgaccggtaccccggaagggggaacgggtcgtagggtacgtagggtaggtttaggggtacttacgtcgttacgttaggtaggtacgggtaacgtaacgtaacgtaaccgtaccgttaccccgtacccgtaacgtaacggtacggtacgtaacgtaccgtacgttacctaagttaccgttacccggtaacgtaaccgtaccggtaaccgaaacgggtaaaccgttaacttacccgttaccgtaacggtaaacgttgttaacgtttcgtacggtaccggtaccgtccgacgacgtaaccgtccggtacgttcgttacctttagttacggttcggtacgtaccggtaacggtacgtaaacgttaacgttaggttacgggttaacgacgggttaacgttacccggtacgtttaacccggggaccgggtaacccggtaacccgggttaccgtacccgggttaccgtaccccgttccttaccccgtacgaccccgtacccgttacccgaacccgggtacccggttaccccg

SEQ ID NO: 221633 - DNA, 841 bp, Homo sapiens
  misc_feature: GYAE6OF01EEDH6.13.33.C11.1.454.CMB.1.raw
tcagtcacgtactacacgaccggtgctcgatttagagtgagctcgttgggtttggggtgggagaggagcccagcactgggattccgaggtatttccattcggtgatcagcactgaacacagaggactcaccatggtagttttggctggagtcttgggtttttccttgttgtacttaattttaaaaggtcgccctaggtgtggaggtgcagtcgtgggtggtagtcgtgggaggaggtcttgactccgacggtcccggtcggggggtccctggagtacctccttccgtgtgccgtacgtccttcggttcgggttactaccgttacgacgtaccacctaacctactaacgtcgacggtccggttacggggtccccgcccggtacgggtaccggtacccggggaagggggggtaacggggtccgggttgggaacggttcggtccgttttaccgttttaacttttttaagtttaaggttacgggttaaggttacggttacgttaaactacgttaccgtaccgtaccgtaaacggtccgttaccggggtacggggtacggggtaccccttacttacccgtaaccctacgtaccctaacgaacggtaacgtaacttaaacgtaaccgtaaacggaccgtaaccgttcgttttactttacctaaagtaacgttacgaaccggtaccgtacgttagggaacgaccggtaaccgtagtaccgggacgttacccggttacgttagttaccggtttagacggtacgacggtaaggacgtacccggggtaacggacccggtaataacggtcctaacggttcacggtacggtacggtcgggtcggaaacccggg

SEQ ID NO: 221634 - DNA, 772 bp, Homo sapiens
  misc_feature: GYAE6OF01D4YKX.13.33.C11.1.454.CMB.1.raw
  modified_base (262)..(262): a, c, t, g, unknown or other
  misc_feature (262)..(262): n is a, c, g, or t
tcagtcacgtactacacgaccggtgctcgatttagagtgagctcgttggggtttgggggggggtctcaggaggcagcgctctcggggcgtctccaccatggcctgggctctgctattcctcaccctcctcactcagggcacagggtcctgggcccagtctgccctgactcagcctgcctcgtgtctgggtctccgtggacagtcgatcaccatcctctgcacgtacggaaccaccagtgactagttggtatatttataattntgtcctcgtgtaaccactagtcgacccgaggaccaaaccaccccctaaactactaactttaactttttactgtctagtcctagttcccggccttcgtacgggtttactaagtttccgtttctcgtcggtcctacgtagttcgtcggaccgaaaccgcccggtccctacccgtacgtaccctacgttccgtcgggtacggtacctaccgtacggtcctaaggaacggtaccgggtagtacgttagtaacttttaacgttacgtcgtacgtacgtccttataacgttacaaccggaacggccggtactacggttcctttcttttactttacgttacccgttacgggtttacggggtacgggttaaccgggtaaaccgtaaacggggtttccccgtaaccccggtttaacttaaaccgggtccccgaaccccgggtaaacccccggtaaaccccggtaccccctaaaacccccggttcgtttaccccggtacccgttaaccccgtttcccccg

SEQ ID NO: 221635 - DNA, 536 bp, Homo sapiens
  misc_feature: GYAE6OF02HK8S3.13.33.C11.1.454.CMB.1.raw
  modified_base (340)..(340): a, c, t, g, unknown or other
  misc_feature (340)..(340): n is a, c, g, or t
tcagtcacgtactacacgaccggtgctcgatttagagtgagctcgttgggtttggggggggtctcgaggaggcagcgctctcgggggcgtctccaccatggcctgggctctgctattcctcaccctcctcacctcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaaactcattatttacggggtcaataagcggccctcagggtctttcngatcgcttctctggctccaagtctggcaacacggcctccctgacatctctggtctccaggctgaggacgaggctgcctattactgctgctcatatgctaggttcttctgtcggttcttcgggcggtagggtccaaggtcgaccgtccgtaggtccaggcccgaaggcctcggcccctggtcaccttctcgttcccc

SEQ ID NO: 221636 - DNA, 606 bp, Homo sapiens
  misc_feature: GYAE6OF02G3H7E.13.33.C11.1.454.CMB.1.raw
  modified_base (487)..(487): a, c, t, g, unknown or other
  misc_feature (487)..(487): n is a, c, g, or t
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctcctaagtaggacttacttactacgtggggctggatccggcacgcccccgagggaagggctggagtggagttggggatagtctcttagtagtgggagtacgaactacaactccgtcctacgagagtcgagtcatcaatactacgtagacaggtccaggaacgtacttcgtaccctaggtaaacgtcgtaagtttcctagtcgtaccgtcgacacggacgacggtcttcgtcttattgtgtcgcgaaggtaccgganaaagttcgtaggttcgagggtacgtacgtacctacggtcgggaccgtaacgggtacccttgggtaccctacccgttcctacccgtcgaccgcccgttacccgaccgtaccggtaccccg

SEQ ID NO: 221637 - DNA, 759 bp, Homo sapiens
  misc_feature: GYAE6OF02JSOJ0.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactattttaaaggtgtccagtgtgaggtgcagttggtggagtctggaggaggcttggtccgaggcccgggggggtccctggagactctcatgtgcggcctcgtgggctcaccgtcaacaccaactacatgagctgggtccgccaggctccgaggggaagacgggccggagtgggtctcgtagtttatttagtggtaccggagggtcgccactattccgtacgcagacctcggtggacggggccgttcaacctatccgtaccaacggagacaacttacccgaaagaaccgacggtacgtacgttacttaacgaaatacggaaaccgtaccgttggaacgacggttacccggaaggaacccgacgggtacccgttacgtaacgtttaaccgtgggtacggaaccggttaaaagtacgtacggtaccgaagggtaaccggggtacccggggtaaccccccggttaaaggggtcggggggttaccccggttaggggggttaacccggggttacgggggttttacctttttaccggttttacgggtaaacccggttcggggacccgggtttacgggggggacccccgttaaacccgggggg

SEQ ID NO: 221638 - DNA, 645 bp, Homo sapiens
  misc_feature: GYAE6OF02H1G7D.13.33.C11.1.454.CMB.1.raw
tcagtcacgtactacacgaccggtgctcgatttagagtgagctcgttgggtttgggggggagaggagcccagcactgggattccgaggtatttccattcggtgatcggcactgaacacagaggactcaccatggagttttggctgagctgggttttccttattactattttaaaggtgtccagtgtgaggtgcagttggtggagtctggaggaggcttggtccaggccgggggggtccctggagactctcatgtgcggcctctgggctcaccgtcaacaccaactacatgagctgggtccgccaggctccgagggaacgagccggagtgggtctcagttatttatgtcgacggtgaccacattctacgcagactccggaggaggggtccggttcacctattctacccgagacgactaacttaccgaagaaccgaacggtgtactcttacaaagtcgaacgacctagaggtacgtacgacggacacgggccgttacgttaagttaccgtgtcgaacgaaagtatcgaacagggaacggaccggggacccccgttaaggttcgggggcccttggggtcgggtacgggttttcctttcggtttacgacgttcggtccggttcgggggaccctaacggggtaaccccgg

SEQ ID NO: 221639 - DNA, 547 bp, Homo sapiens
  misc_feature: GYAE6OF02G0807.13.33.C11.1.454.CMB.1.raw
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcgggagaccctgtccctcagttgtaatgtgtctggtggctccctaagtaggactacttactactgggctggatccggcacgcccccagggaagggctggagtggattggggatntcttcttatagtgggagtacgaactacaatccgtccctnaagagtcgagtcatcatatccgtagacagtccaggaacattctccctagaagtgagttctgtcgacgtcgcagacgacggtcttgtctagttatgtcgngagacganaaatgtgttcgaggtagtcgagtacgtcgggccgaagggacccgtggtacctaccgtcttccgtccgatcccgcccgtaccgacggtaccccg

SEQ ID NO: 221640 - DNA, 591 bp, Homo sapiens
  misc_feature: GYAE6OF02GY6BO.13.33.C11.1.454.CMB.1.raw
  modified_base (302)..(302): a, c, t, g, unknown or other
  misc_feature (302)..(302): n is a, c, g, or t
  modified_base (456)..(456): a, c, t, g, unknown or other
  misc_feature (456)..(456): n is a, c, g, or t
tcagtcacgtactacacgaccggtgctcgatttagagtgagctcgttggttttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccggggggggtccctggagactctcatgtgcggcctctgggctcaccgtcaacaccaactacatgagctgggtccnccaggctccagggaagaggccgagtgggtctcagtttattatgtcgacggtgccacattctacgcagacctccgtggacggggtccggttacacccatcctacccagagtacaattaccaagaacgacggtgtatcttacaatgaacactgagngtcgagacacggcgtctattacctgtcgacgaagatgacagagaccggggccccgtaaggtcggggtacccgtgggtcggtacgggtttcttacgtttcggaccttggaccggttgggggaccctaacccggggg

SEQ ID NO: 221641 - DNA, 582 bp, Homo sapiens
  misc_feature: GYAE6OF02GVMJS.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactgggctggatccggcacgcccccgagggaacgggctggagtggagttggggatagtctcttagtaggtgggtagtacgaactacaacgtccgtcctcgaagagtcgagtcatcatactccgtagacacggtacaggaacgtaattcgtacctagaaagtgagttctgtcgaccgtcgacagacgacggtctagtctattgtgtgacgagacggataaagtgtggttacgaggtacgttacgacgtacgtcggggaccgtaacgggtaacccttgggtaccgtaaccgtctacccgtcgaccgtccctaccgacccgacggtaccccg

SEQ ID NO: 221642 - DNA, 658 bp, Homo sapiens
  misc_feature: GYAE6OF02GRK5I.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctacctaagtaggactacttactacgtggggctggactccggcacgcccccgagggagggcgtggagtggagtggggatatctcgttagtaggtgggagtacgaactacaacgtcccgtacctacgaagtacgtcgtagtactatctaagtactaccggtaagaccgtaggtaccgaaggtaaaccgtaactttccctaccgtaaggtaaacgttcggtaagtttcctggtacggacccgttcgacgtaacggaaccgtacggcttacggtacttattacgtttgacgcggaacgtacgggactaaagttagttgggttacgagggtacgttacgaacgttcgtacggggaccgtaacgggtaacccgttggtaccctacccggttctacccgtcgaccgtaccctaccgtacccggacggtaccccg

SEQ ID NO: 221643 - DNA, 1094 bp, Homo sapiens
  misc_feature: GYAE6OF02GK2IL.13.33.C11.1.454.CMB.1.raw
tcagtcacgtactacacgaccggtgctcgatttagagtgagctcgttgggtttggggggggggtctcaggaggcagcgctctcggggcgtctccaccatggcctgggctctgctattcctcaccctcctcactcagggcacagggtcctgggcccagtctgccctgactcagcctgcctccgtgtctgggtctctggacagtcgatcaccatctcctgcacgtacggaacccaccgagtagactagtttgggtagtaattttaataaactttagttcgttccttcccgttacgggttaaccccaaaacgtaacggttccgaacccccgtaagggaacccaaaaacccggacccccccctaaaacttaccttaaaacgttttaaacttttttttaaccgtcgttaaccgtaacgttaccgtaaccgtttcccgggtaccccccgtttacgggttaaccggggggttttttacctttaaaaccggtttttccccggtttttccctttccggtttaccggggttaccccgtttaaccccgtaaaacggggttttcccgttaccggggtaacccgtaaaaccccggtaccccggggttaccccccgtttacccccgttaaccgggtaacccctttaaccgtttccccgtttacccgggttaccggggttaccccgttacccggtaacggggttacccgttaaacggggaaaacccggtacgggggtaaccgggttaccgtttacggtttaaacgttttaaaccgttttaaccggttacggttaaccgtaacccggttccgtttaaccgtaaacgtttaacgttaaaacccgggtaaccgggtacccggggaacttaacccggttcccgtttttaacccttttaccgttttttaacccgttccggtttttacccgggtttaaccgggggtaagggggtttaaccccgggttaacccggtaacgggtttaccccccggttaaacccggttaaccccggtttaaacggaccccgttaacccgggaacccccggttaaacccggtaccccccgtaaaaccccgttacggtttaccccgttacccggtaccgtttacccccgg

SEQ ID NO: 221644 - DNA, 632 bp, Homo sapiens
  misc_feature: GYAE6OF02ILYEO.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtagaagccttcggagaccctgtccctcagttgtaactgtgtctggtcgcctacccgtaagtaggacttacttactacgtgggctggatccggcacgcccccgagggaagggctaggagtggagttgggatagtctacgttataggtggagtacgaaactacaacgtccgtacctacgaagtacgtcgtacgtacacttactatacgtaccgtacgacgacggtaccgaacggaacgtaacgttcctacccgtagtaaacgttcgtacgtttcgtcgtacgaccgtcgacgacgaccgacgtcgtgttacttagttagttgtacgcgtagaccgataagtattacgggttcgagggtacttacgacgttcgacggggtaccacgggtaacccgtggtaccgtaccgtccgtcccgtacgtaccgccgtacccaccgtaccggtaccccg

SEQ ID NO: 221645 - DNA, 600 bp, Homo sapiens
  misc_feature: GYAE6OF02FOO0E.13.33.C11.1.454.CMB.1.raw
  modified_base (305)..(305): a, c, t, g, unknown or other
  misc_feature (305)..(305): n is a, c, g, or t
  modified_base (515)..(515): a, c, t, g, unknown or other
  misc_feature (515)..(515): n is a, c, g, or t
tcagtcacgtactacacgaccggtgctcgatttagagtgagctcgttgggtttggggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggcccggggggggtccctgagactctcatgtgcggcctcgtgggctcaccgtcaacaccaactacatgagctgggtccncaggctccagggagaggccggaggtgggtctctagttatttatgtcgacggtgccactattctacgcagacctcgtggacggggtccgttcaccatcctaccgagacgactaacttacccaaagaacacggttgtaacttcttacaaagtacgaaacgtacctagagagtacggaagacaccggtccgtctaattactgtcgacgaaagngtacgcgagagaccgggaccccgtaggtcgggccgtgggtcggtacggttcgttcgttggacgtgtcggtcgggccgtaaccggg

SEQ ID NO: 221646 - DNA, 773 bp, Homo sapiens
  misc_feature: GYAE6OF02FW0AH.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactatttaaaaggtgtccagtgtgaggtgcagttggtggagtcgtggaggaggcttggtccaggcccgggggggtccctggagactctcatgtgcgtcctcgtgggctcaccgtcaaacaccaactacatgagcgtcgggtcccgccaggcctaccgaggggaacgacgggcccgggaggtcgggtcctacgtagtttagtttatcggtcgtacggtcgaccactattccgtacgcgtacgaccgtccggtcggacgggggtcccgttacacccgtagttcccaccgaagacgaactaacttaacccgaaagtaaccgtacgggtagttaacttactttaaccgaaagttaccgaaaccgtaaccgtaggaagtacggttaccgggaacggtaccgaccgggtcccgtttactacgttacgtaggtacggaacgaaagtcgtaggaccgaaacgggacgggaccccggggtacccccggttaaaggggttcccgggggtacccggttcgggggttaccggggttaaggggttttccccgttttacgggttttacgggtacccggtttacgggtacccgggttaccgggggaccccggttaaacccggggg

SEQ ID NO: 221647 - DNA, 643 bp, Homo sapiens
  misc_feature: GYAE6OF02F54DY.13.33.C11.1.454.CMB.1.raw
  modified_base (267)..(267): a, c, t, g, unknown or other
  misc_feature (267)..(267): n is a, c, g, or t
  modified_base (503)..(503): a, c, t, g, unknown or other
  misc_feature (503)..(503): n is a, c, g, or t
tcagtcacgtactacacgaccggtgctcgatttagagtgagctcgttgggtttggggtggagaggagcccagcactgggattccgaggtatttccattcggtgatcagcactgaacacagaggactcaccatggagtttggctgagcgtgggttttccttgttgcttaattttaaaaggtgcccagtgtgaggtgcagctggtggagtctgggaggaggcttgatccagccgtcgggggtccctgagactctcctgtgcagccttcnggattctacctttgatgtattatcgccatgcacgtcggggtccgacaacgctccgaagggggaacggccgtgggaggtcgggtctcgtaggttattaggttaggtaattaggtggtagactagtaggtactagtggacggtactcgtggtaggaacgggccgtatccacctatcctacgagacgaaccaaccgaccaaacgacccttccttagtatcgtagacctaaagtcgaacncgtccgtagagtacgtcgtacggaacgaccgtaccggtccgtttagttaactttacgtgtacgtaaaccgtaaaacgtacccttaaccccttaaccccggtttaacgtttagtttttacgggacggtttaggttaacccg

SEQ ID NO: 221648 - DNA, 794 bp, Homo sapiens
  misc_feature: GYAE6OF02F91PY.13.33.C11.1.454.CMB.1.raw
  modified_base (271)..(271): a, c, t, g, unknown or other
  misc_feature (271)..(271): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagtcacgtactacacgaccggtgctcgatttagagtgagctcgttgggtttggggggggagaggagcccagcactgggattccgaggtatttccattcggtgatcagcactgaacacagaggactcaccatggagtttggctgagcgtggttttccttgttgctaattttaaaaggtgcccagtgtgaggtgcagctgggtggagtcgtagggaggaggtcttgatccacggccgtcggggggtccctgagactctcctgtgcagcctntggttccaccgtctagtacactaccacatggtagccgtgggcccncgacggtccnccggaagggggaacgggtcgtggggacgtgcgttcttactttttatttagtaggttaggtcggtaagtacctagttacctccgactacgtaccgttccgggtagggacgggggtaccctacgtttaccgaaccgtacttaccgtacccgaaaggtaaccgtaaacgttaaaccgttaacccgtaaaaacgtaaacctaaccgggttccttttaacggttttacccttaaaccgttaaaacgtctaaaaccggacgtaccgtaggaaccggacgttaccggtaagttacggtaaacccggtaccgggcccggtttttaaaggtaaaccgtttacgtacgggtacggtaacggtagggaacggtaccgggtaccggggaaccccgttaaacggtaaccggttttaaccgaccggttagttaaccggtacgggtacggttcccggggtacggggtaaccccgtaaccgggg

SEQ ID NO: 221649 - DNA, 821 bp, Homo sapiens
  misc_feature: GYAE6OF02HFEIU.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttgggtccaggcccgggggggtccctggagactcgtcatggtcgcggcctcgtggctcaccgtcaacaccaactacatgagcgtgggtccgccgaggcctaccgagggaaggacgggccgggtaggtcgggtctacgtacgtttatttagtcggtcggacggttcgaccactacttccgtacgcgtacgtaccgttccggtggacgggggtcccgtttcaacccgtatcccgtaccgacggaacgaacctaactttacccgaaaggtaaacccgtacggttacggtaactttaccttaaaccgtaaaacgttcggtaaacccggtaccgttacggggaaaggtacggtaaccgggtaaacgggtaacccggaacccggggtacccgtttaaccgtttaacggtttaaccgtggggttaccggaacgggtaaaacggtaggttacggaaccggtaaagggaaccggggttacccgggacccccgggttaaaggggttcccgggggtaaccggttggggggtacggtttaaccggggttttcgttttaccgggtttacggttacgtcggggttaccgggtcgggggtaaccccggtaacccggggg

SEQ ID NO: 221650 - DNA, 930 bp, Homo sapiens
  misc_feature: GYAE6OF02IGCJM.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagagtgggcctgtcccagctgcagctgcaggacggtccgggcccgaggagtggtagaagtccgttacggacgtacccgtcgtcccctacgtagtttacgtaagttggtcgttcgttcgggttcggtcccgttacccgttaaaggttacggtaacctttaaccgttttaaccgttaaccggttcgggggtccgttacgggtacggttccccgggaccgaacccggacccccccggtaaaggggaacgggggtccgtaggggtacggttagggtaggtttacgggggaattaacgtttccgtacgtttaagttaggggtacgggtaacgttaaaccggtaaaccttaaccgtaaaccgttaccccggttacccttaacgaaacggtacgtacggtaagtacctaacgtactaacttaacgtacccggtaagaaccgtaacggtaccgtaaacgggtaaaaccgttaactttcccgttaaccccggttaaaggtaaaacggtttcgttaacggtttacccgtttcggtaaccgtacccgggtccgaccggtaacgacccggtaacgggtccttacggttacctttaaagttttacgtacgggttcggtacgggtaacggtaccggtaacgtaaacgttagggttaccgggtttacgaacggggttacgtttaccggaccggttaaccgggttcggggaacccggtaccgggtaaccccggttgggtaccccgtaccggttcccgttacccgtccggtaccccgacccgttaaccccgacccggtaccggtaaccccg

SEQ ID NO: 221651 - DNA, 790 bp, Homo sapiens
  misc_feature: GYAE6OF02JRAJU.13.33.C11.1.454.CMB.1.raw
  modified_base (319)..(319): a, c, t, g, unknown or other
  misc_feature (319)..(319): n is a, c, g, or t
  modified_base (344)..(344): a, c, t, g, unknown or other
  misc_feature (344)..(344): n is a, c, g, or t
tcagtcacgtactacacgaccggtgctcgatttagagtgagctcgttgggtttgggggggaggaggagcccagcactgggattccgaggtatttccattcggtgatcagcactgaacacagaggactcaccatggagttttggctgagctgggttttccttattactattttaaaggtgtccagtgtgacggtgcagttggtggagtcgtggaggaggcttgggtccaggtcccggggggtcctggagactccgtcatgtagccggcctcgtgggctcgaccgtcaaccaaccgaactacagtcgagcgtcggggtccncgacggtccgtaccgagggaacggnggaccgggacgttcggggtccttacgaacggtttatttacggtcggtacggtaccggtcgaccgtaccgtagttccctaccggtcgaacgtacccggttccggtagggtaccggggtaccgttacccgtaacgtccgtacccttacccgagtaacgtactaaaccgttacaaacggacacggttacgtacgttacgttaacaaacgtacggaaacgtacccgttaagtaccgggtaacgttacggaacggtaacccgtacgggtaaccttaccgttaacgtttacgtaaggtcgaaccgggttaaagtacggtagaaccggtagtaaccgggtccgggtaaccccggtaacggttaccggggtacccggttgggttaacgggtacgggtttacctttggttaccggtacgttacggtccggggtacggccccgggttaaacccggg

SEQ ID NO: 221652 - DNA, 777 bp, Homo sapiens
  misc_feature: GYAE6OF02G65L7.13.33.C11.1.454.CMB.1.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactattttaaaaggtgtccagtgtgagtgcagttggtggagtctggaggaggcttggtccaggcccgggggggtccctgagactctcatgtgcggctcgtggctcaccgtcaaccaccaactacactgagctgggtcccnccgaggcctaccgagggaagacgggcggtaggtcgggtctntagtttatttagtgtcgacgggtcnccatattcctacgctaacggcttccggtaggacggggttcccggttacacccgtactcctacccgagtaacgactaaacgttcccgaaacggtaacgaacgggtttgtaacgttaccttaacctaaaaagttacgaaaccgtaaccgttaggaacggtaacgtacgggaacgggaaccgaccgggttccgttaccgtttaacgtttaaccgtgggttacggtaaccggtaaaaggtacgtacggaacctaacgggaaaccggggaccccggggtaaccccccggttaaaggggtcccggggggtaccgtttacgggggttacggggttaaccgggttttccttttaccggttttcgggtaaccggtttcgggtaccgggttccgggggttacccccggtaacccgggg

SEQ ID NO: 221653 - DNA, 773 bp, Homo sapiens
  misc_feature: GYAE6OF02FS42M.13.33.C11.1.454.CMB.1.raw
tcagtcacgtactacacgaccggtgctcgatttagagtgagctcgttgggtttggggggggagaggagcccagcactgggattccgaggtatttccattcggtgatcagcactgaacacagaggactcaccatggagttttggctgagcttgggttttccttattacttattttaaaaggtgtccagtgtgaggtgcagttggtggagtctgggaggaggcttggtccagggcccgggggggtccctggagactctcatgtgcggcctcgtggctcaccgtacaacaccaactacatgagcgtcgggtcccgccgacggcctccgaaggggaaggacgggccggaggttcgggtctcgtagttttatttagtcggttacggacggttcgacccgactactttcctaacgcctaagacccgttccggtagggaccgggggttcccgttaccaacccgtacttcccgtacccgagaacgtaacctaacttaacccgaaaggtaaacccgtacgggttagttaacttacctttaacgaaaagtaccggtaaaccgtaccgttagacggtaaggtaccggaaagggacccgtaaccgggaccgtttacgtaaacgttttaccgtcggtacggtaaccggtaaaaggtctacggaaccgaaggtacggggacccgggtaccccggtaagggttcccgggggtctttacggggggtacgggtttacggtttctttacggttcgtacggttcggtccggtacggggacccggtaaccggg

SEQ ID NO: 221654 - DNA, 984 bp, Homo sapiens
  misc_feature: GYAE6OF02HV8UU.13.33.C11.1.454.CMB.1.raw
  modified_base (120)..(120): a, c, t, g, unknown or other
  misc_feature (120)..(120): n is a, c, g, or t
tcagtcacgtactacacgaccggtgctcgattttagagtgagctcgttgggtttggggatgctttctgagagtcatggatctcatgtgcaaagaaatgaagcacctgtgttcttcctctnctggtggcggctccagagtgggcctgtcccgagctgcagctgcgagggacggtccgggacccgaaggtaggtagggtagtaacggtcccgttacgggaccgtaccccgttcgtaccccgtcgttaggttacgtttaacggttcggtttcgttccggttcggggttaccggtacccgttaacccggttaaacgggttaacggttaacccttttaacccgtttaaccgttaccgggttacgggggttccgttaaccgggtaccggttccccggacccggaaccccgggtacccccgggggaaacggggggtaaccgggggtcggtaacggggtacggggttacgggttaccgggttaagggggtaactttaacggtttccgttttaacggttttaagggttacgggttaacggggtaaccggttaaaccggtaaacccgtttaaaccgttaaccccgttaccccggttacccgtaacggtaaaccggtacggttaccgtaacgtctaaccgtactaacgttacgtaccggtaacgtaccggtacgtaacggtaacggtaaacgttaccgttaccttaccggtaaaggttaacgttacggtttacgtttcgtacggtacggtaccgtacgaccgtaacggaccgtaccggtttactacgtttaacgttattttacgggtcgacggacggttaacgtaccggtaattaaaggttcgggttaacggtttcgggaacgtcgttaacggaccggttacggggtaccgggaacccggtaaccgggttacccggttacggtaaccctcccgggttccctacccggttccggacccgttaacccccggtacgtaccccggaccggttaccccgg

SEQ ID NO: 221655 - DNA, 670 bp, Homo sapiens
  misc_feature: GYAE6OF02H3DWY.13.33.C11.1.454.CMB.1.raw
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagtcacgtactacacgaccggtgctcgatttagagtgagctcgttggggtttgggggggggagaggagcccagcactgggattccgaggtatttccattcggtgatcagcactgaacacagaggactcaccatggagttttggctgagcttgggttttccttattactattttaaaaggtgtccagtgtgaggtgctagttggtggagtctggaggaggcttgggtccaggccgggggggtccctgagactctcatgtgcggcctcgtggcctcaccgtcaaccaccaactacagtgacacgtcggggccctcgacggcctaccgaggggaacgacggccgggagtcgggtctactacgtttatttagnggtcgacggtgacctanacttacaccgctacgtacctcgggtaggacggggtcccgttacaccgtactcctacgagacgaactacttacgaacgaacgtacggtcttatactacaaatacgaacgacgtcgtacgaggcgtaccgagtacgaccgacgggtactgtacttaagtcgtacgaacggagtaacggacgtccggggacccgttaacggtaaccggttataccggtcgtaacgttcgggtaaccgtcgggtaccgggacccgaaacgggtcccgtacccggtgtaacccccgg

SEQ ID NO: 221656 - DNA, 697 bp, Homo sapiens
  misc_feature: GYAE6OF02HYXCH.13.33.C11.1.454.CMB.1.raw
  modified_base (587)..(587): a, c, t, g, unknown or other
  misc_feature (587)..(587): n is a, c, g, or t
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttcctattactattttaaaggtgtccagtgtgaggtgcagttggtggagtctggaggtaggcgttggtccgaggccgggggggtccctggagactctcatggtgccggctcgtgggcctcgaccgtcaaccgaccaacgtacagtgacgcgtcgggtccgccgacggcctccgaagggaaggtcggaccgggaggtcggtctacgtaggttttacgtttagtcggtaccggtacgggtcgcctaacgtactttaccgtaccgcaacggtccttccgggtacggacgggggtcccgtaccacctatccgtaccgaagacgtactaacgttaccaacggaacgtacggtacgtacttacgtactaaagtcgaacgtacgtagacgaggtacggagaccgaccgggtcttacgtattacgtcgtacgacgtaaagngtacgacgaaggacggacccgggtaccccggtaggtcggggtccggtgggttcgggtacggtttcgtttcgttcggtacggttacggcgggtccgggtaccgtaaccggg

SEQ ID NO: 221657 - DNA, 811 bp, Homo sapiens
  misc_feature: GYAE6OF02J02IY.13.33.C11.1.454.CMB.1.raw
  modified_base (211)..(211): a, c, t, g, unknown or other
  misc_feature (211)..(211): n is a, c, g, or t
  modified_base (559)..(559): a, c, t, g, unknown or other
  misc_feature (559)..(559): n is a, c, g, or t
tcagtcacgtactacacgaccggtgctcgatttagagtgagctcgttgggtttgggggggtaggaggagcccagcactgggattccgaggtatttccattcggtgatcggcactgaacacagaggactcaccatggagttttggctgagctgggttttccttgttgctattttaaaaggtgccctagtgtgaggtgcagctggtggacgtntgggaggaggcttggactccgagccgtggggggtccctgaggacctctccgtgtattaacttcgtggattcaacgttgggtagtattagtggtcctaattggaacgttgggtcccgccgtaaggccgtacccggagggggaacgggtctggggacgtcggtacgttcgtttacgtttttatttaagttaggtaagttggttagtactaagttaccgtccgcgtaacgaccgtcccggtagggtacgggggccctaagttccgtaaccctaaccgttccgtaccgaggtaggaaaccttaacgtccctaaaaggtaaccccaaccggttcgttacgttttaccctttanaaaacgtacgtaaaaccgttagccccttaacggaagaccggaaccgtacggttacgaacccggttaacgggaccccgtttaggttaaacggttaccgttagtacgggacgttaaagggaacgtaaccgggttcggggaccccgtaaaccgggtaacccgggttaaacccttccgtaaccggttaacgtagggttacccggtcgggtaacccggggcttaaaacggggggacccccgtaacgggtacccccgg

SEQ ID NO: 221658 - DNA, 985 bp, Homo sapiens
  misc_feature: GYAE6OF02GQLKD.13.33.C11.1.454.CMB.1.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagagtgggcctgtcccagctgcagctgcaggagtcgggcccaggagtggtagaacgtccgttacggacgaccccgtgtcccctcgtaggtttgtaagttggttcgttccgttggggttcggtccttaccccgttaaaggtaacggtaacctttaaccgtttaaccgttaaccggttcgggggtacgttacgggtaccttccccgggaccacccggacccccccggaagggggtaacgggggtccggttaggggaacgggttacggggtaagggtttacggggggtaatttaaccgttaccggtttacgttttaaggttaacgggtagggggtaaacgttaacccgtaaaaccttaaccgtaaaccggttcccccggttacccgtaaccgtaaacggtacggtaccggtaacgttactaacgttacgtaacgttacggttacccggtaaggtaacccgttaacgggtaacccggtaaggtaaaaccgtaaccgtttacccgtaaccccggtaaaggtaaacggtttacgggttaacggttttccgttacggtaccgggtaacccggttaccgaccggtaaaccggtaaccggtaaccgggttccgtttaaacggttaccgtttaaagtttttcggttacggttacgggaccgggtaacgggtaaccggtaaacgttaaaggttaccggttagggtttaaccggaaacggggtttacgtttaccggtaaccggttaccgggtaccggggtaaccggtaacccgggtaaccgtttaccgggtaacccgtaaccccgttccgtacccgtacgacccgttaccccgtacccgtacccggtaccggtaccccccg

SEQ ID NO: 221659 - DNA, 740 bp, Homo sapiens
  misc_feature: GYAE6OF02GMN1W.13.33.C11.1.454.CMB.1.raw
  modified_base (300)..(300): a, c, t, g, unknown or other
  misc_feature (300)..(300): n is a, c, g, or t
tcagtcacgtactacacgaccggtgctcgatttagagtgagctcgttgggtttgggggggggagaggagcccagcactgggattccgaggtatttccattcggtgatcagcactgaacacagaggactcaccatggagttttggctgagctgggttttccttattactaattttaaaaggtgtccagtgtgaggtgcaggttggtggagtctgggaggaggcgttggtccgagggcccgggggggtccctggacgactctcatgtgcgcctcgtggctcaccgtacaacaccaactacancgagcgtcgggtccgcgacggctaccgaagggacggacgggccggaggtcgggtctacgtagtttattagtcggtcgtacggtcgacctacgtgttaccgtaggctacggtacctcggtacgggtaccgggggtcccgtttaaccgaacctccgtacctaccgagtaaccgtaacgtaactaaccgaaacggtaaccgaacgttaggtaacttacttacgtaaaagtaccgtaaacgtaccgtaggtaacgtacggtaacggaacggtaccgacgttcccggtagttaaccttacgtggacgtaacgaagtactacggagaacggacgtacccgggtaccggtacggtcggggttccggttagggtccgggttaagggtttccttttacgggttcgtaaccggttccggtaacgggttcgggtaccccggtaacccgggg

SEQ ID NO: 221660 - DNA, 872 bp, Homo sapiens
  misc_feature: GYAE6OF02HELS3.13.33.C11.1.454.CMB.1.raw
tcagtcacgtactacacgaccggtgctcgatttagagtgagctcgttgggtttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtcgtggaggaggcgtttggtccgaggcccggggggtccctggacgactctcagtgtgcggcctcgtggctcaccgtcaaccaccaactacagtgagtcgtcgggtcccgccgacggcctaccggaaggggaaacggacgggtccgggaaggtcgggttacttacgtaagttttacttttagtacggttcgtacgggtcgacctactacgtttactacgtacgacgtacccgttccgggtcggtacgggggtacccgttaccgaaccctacgttaccccgtaccgtaaggtacgtaaacccgtaacgtttaacccgaaacggtaaaccgtaacgggtttacgttaaacttacctttaaaccgtaaaacgtaaccggtaaaccgtaacccgttacggtaaacggtaccggttaccgggaaacgggtacccggacccgggtacccgtttaccttaacgttaccgtttacggtaggtaaccggtaaacgtaacgtacggtaaaccggtacgggtaaccggggtaccccggggttacccccggttaaggggtaccccgggggtaccgggtttgggggttaaccggggtttacgggtttttccgttttaccgggttttacggtacccggttcgggtacccgggttccggggtaccccgggttaaacccggggg

SEQ ID NO: 221661 - DNA, 541 bp, Homo sapiens
  misc_feature: GYAE6OF01A7SNS.38.4.A04.1.454.CMB.1.raw
  modified_base (539)..(541): a, c, t, g, unknown or other
  misc_feature (539)..(541): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaccctggtcaccgtctcctcagccctccaccaagggcccatccggtccttccccctggccaccctccctccaacgacgccacccgtcgtcgggggccacgacggccggcccgtggggcctcggccctgggtccaagggacctacttcccacgtgactcgacgtggagcgggctgggcaaggcgcatgnnn

SEQ ID NO: 221662 - DNA, 514 bp, Homo sapiens
  misc_feature: GYAE6OF01A2CBZ.38.4.A04.1.454.CMB.1.raw
  modified_base (508)..(508): a, c, t, g, unknown or other
  misc_feature (508)..(508): n is a, c, g, or t
  modified_base (513)..(514): a, c, t, g, unknown or other
  misc_feature (513)..(514): n is a, c, g, or t
tcagtcgatcacgtcacgaccggtgctcgatttagagtagtgatcaggggtccctgagactctcctgtgcagcctctgcattcacctttagtaactatttaatgagctgggtccgccagcctccagggaaggggctggagtgggtggccagcattaaccaagatggacgtgaaaatactatgtggactctgtgaagggccgattcgccatctccagagacaacgccaagaactcactgtggctgcacatgaacggcctgagaggcgacgacacggctgtgtacttctgtgcgagacgccccatgagggctacagtgggagctacgactttgactacgtggggccagggaaccctggtcaccgtctcctcagcctccaccaagggcccatcggtcttccccctggccaccctcctccaagacgcaccctcgtggggaccacgagccggccctgggcctcgcctggtcaaggactactccacgtgatcgactgagcgggctggcaaggcncatgnn

SEQ ID NO: 221663 - DNA, 523 bp, Homo sapiens
  misc_feature: GYAE6OF01EAH7R.38.4.A04.1.454.CMB.1.raw
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
  modified_base (523)..(523): a, c, t, g, unknown or other
  misc_feature (523)..(523): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactactggggccaggggaaccctggtcaccgtctcctnacgcctccaccaagggcccatccggtccttccccctggccaccctcctccaacgagccacctcgtcgggggcacgagccggccctgggcctgcctggtcaacggactacttccacgtgatcgactgagcgggctggcaaggcgacatagn

SEQ ID NO: 221664 - DNA, 524 bp, Homo sapiens
  misc_feature: GYAE6OF01D5XDF.38.4.A04.1.454.CMB.1.raw
  modified_base (323)..(323): a, c, t, g, unknown or other
  misc_feature (323)..(323): n is a, c, g, or t
  modified_base (368)..(368): a, c, t, g, unknown or other
  misc_feature (368)..(368): n is a, c, g, or t
  modified_base (518)..(518): a, c, t, g, unknown or other
  misc_feature (518)..(518): n is a, c, g, or t
  modified_base (523)..(524): a, c, t, g, unknown or other
  misc_feature (523)..(524): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactacgtggggccagggaaccctggtcaccgtcncctcagcctccaccaagggcccatccggtccttccccctggcccaccctccctccaagacgccacctcgtgggggccacgagccggcccgtgggcctgcctggtcaaggactacttccacgtgatcgactgagcgggctggcaaggcganatagnn

SEQ ID NO: 221665 - DNA, 508 bp, Homo sapiens
  misc_feature: GYAE6OF01DQKCW.38.4.A04.1.454.CMB.1.raw
  modified_base (323)..(323): a, c, t, g, unknown or other
  misc_feature (323)..(323): n is a, c, g, or t
  modified_base (418)..(418): a, c, t, g, unknown or other
  misc_feature (418)..(418): n is a, c, g, or t
  modified_base (506)..(508): a, c, t, g, unknown or other
  misc_feature (506)..(508): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtggganctacgactttgactactggggcaagggaaccctggtcaccgtctcctcagccctccaccaagggcccatcgtcttcccctgcaccctcctccagngcacctctggggcacgagcggccctgggctgcctggtcaaggactacttccacgtgatcgacgtgagcgggctggcaaggcgcatagnnn

SEQ ID NO: 221666 - DNA, 516 bp, Homo sapiens
  misc_feature: GYAE6OF01E3AKT.38.4.A04.1.454.CMB.1.raw
  modified_base (515)..(516): a, c, t, g, unknown or other
  misc_feature (515)..(516): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacagtgggagctacgactttgactactggggccagggaaccctggtcaccgtctcctcagcctccaccaagggcccatccggtccttccccctggccaccctcctccaagacgcaccctcgtgggggccacagcggccctgggcctgcctggtcaaggctacttccacgtgatcgactgagcgggctgggcaaggcgcatgnn

SEQ ID NO: 221667 - DNA, 530 bp, Homo sapiens
  misc_feature: GYAE6OF01C7C1J.38.4.A04.1.454.CMB.1.raw
  modified_base (406)..(406): a, c, t, g, unknown or other
  misc_feature (406)..(406): n is a, c, g, or t
  modified_base (529)..(530): a, c, t, g, unknown or other
  misc_feature (529)..(530): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacaggtgggagctacgactttgactacgtggggccagggaaccctggtcaccgtctcctcagcctccaccagggcccatcggtcttcccccnggccaccctcctccaagacgccacctcgtgggggccacgacgccgggccctgggcctcggccctgggtcaaggacctacttccgacgtgactcgacgtgagcgggctggcaaggcgacatagnn

SEQ ID NO: 221668 - DNA, 505 bp, Homo sapiens
  misc_feature: GYAE6OF01BYJG8.38.4.A04.1.454.CMB.1.raw
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (503)..(505): a, c, t, g, unknown or other
  misc_feature (503)..(505): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagcctccaccaagggcccatccggtcttccccctggcaccctcctccaagngcacctctggggcacngcgcctgggctgcctggtcaaggctactccacgtgatcgactgagcgggctggcaaggcacatagnnn

SEQ ID NO: 221669 - DNA, 533 bp, Homo sapiens
  misc_feature: GYAE6OF01EFKXD.38.4.A04.1.454.CMB.1.raw
  modified_base (531)..(533): a, c, t, g, unknown or other
  misc_feature (531)..(533): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccaggggaaccctggtcaccgtctcctcagcctccaccaacgggcccatccggtccttccccctcggccaccctcctccaacgacgccacctcgtcggggccacgacgccggcccgtgggcctcggccctggtcaaggactacttccacgtgactcgactggagcgggctggcaaggcgcatagnnn

SEQ ID NO: 221670 - DNA, 606 bp, Homo sapiens
  misc_feature: GYAE6OF01C5JZ4.38.4.A04.1.454.CMB.1.raw
  modified_base (602)..(603): a, c, t, g, unknown or other
  misc_feature (602)..(603): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggagctacgactttgactacgtggggccagggaccctggtccaccgtctcctcacgccctccaccgaacgggcccctacgtccggttcccttccccccgtcggcccctaccccttccctacccaaacgacgccacccgtcgtcgggggccacgacggccggcccgtgggcctcggcccgttcggtaccaacgggtaccttaccgttcccgacgtgacgtccggaaccgttggacgggccggggtccgtacgggaccgaaacgggccgacgaagtacgnngcg

SEQ ID NO: 221671 - DNA, 516 bp, Homo sapiens
  misc_feature: GYAE6OF01C24X1.38.4.A04.1.454.CMB.1.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (515)..(516): a, c, t, g, unknown or other
  misc_feature (515)..(516): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccaggggaaccctggtcaccgtctcctcagcctccaccagggcccatccggtcttccccctggccaccctcctccaagngcacctcgnggggcacagccggccctgggctgcctggtcaaggactactccacgtgatcgactggagcgggctgggcaaggcgacatagnn

SEQ ID NO: 221672 - DNA, 528 bp, Homo sapiens
  misc_feature: GYAE6OF01BMW9R.38.4.A04.1.454.CMB.1.raw
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(528): a, c, t, g, unknown or other
  misc_feature (526)..(528): n is a, c, g, or t
tcagtcgatcacgtcacgaccggtgctcgatttagagtagtgatcaggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagccctccaccaagggcccatcggtcctccccctggccaccctcctccaagacgccaccctcgtcggggccacaggccggcccgtgggcctcggccctggtccaaggacctacttccgacgtgactcgactggagcgggctggcaaggcncangnnn

SEQ ID NO: 221673 - DNA, 549 bp, Homo sapiens
  misc_feature: GYAE6OF01EZ08P.38.4.A04.1.454.CMB.1.raw
  modified_base (547)..(549): a, c, t, g, unknown or other
  misc_feature (547)..(549): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaccctggtcaccgtctcctcagcctccaccaagggcccatccggtccttccccctggccaccctcctccaacgacgccaccctcgtcgggggccacgacggccggcccgtggggcctcggcccgtgggtccaacgggtacctaccttcccacggtcgactccgacgtggaggcgggctcgggcaacgggcgcatgnnn

SEQ ID NO: 221674 - DNA, 537 bp, Homo sapiens
  misc_feature: GYAE6OF01C0XUP.38.4.A04.1.454.CMB.1.raw
  modified_base (534)..(537): a, c, t, g, unknown or other
  misc_feature (534)..(537): n is a, c, g, or t
tcagtcgatcacgtcacgaccggtgctcgatttagagtagtgatcagggggtccctgagactctcctgtgcagcctctgcattcacctttagtaactatttaatgagctggtccgccagcctccagggaagggctggagtgggtggccagtattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccaggggaaccctggtccaccgtctcctcagcctccaccgaagggcccagtccggtccttccccctcggccacccctcctccaacgacgccaccgtcgtgggggcacgacggccggcccgtgggctcgccgtgggtcaaggacttacttccacgtgactcgactggacgcgggctggcgaaggcgcatagnnnn

SEQ ID NO: 221675 - DNA, 530 bp, Homo sapiens
  misc_feature: GYAE6OF01DWRYE.38.4.A04.1.454.CMB.1.raw
  modified_base (528)..(530): a, c, t, g, unknown or other
  misc_feature (528)..(530): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagagcccccatgagggctacaggtgggagctacgactttgactacgtggggccagggaaccctggtcaccgtctcctcagccctccaccgaagggcccatccggtccttccccctggccaccctcctccaagacgccacctcgtcggggcacgacgccggccctgggcctcgccgtggtccaaggactacttccacgtgactcgacgtgagcgggctggcaaggcgacatgnnn

SEQ ID NO: 221676 - DNA, 554 bp, Homo sapiens
  misc_feature: GYAE6OF01D7YXP.38.4.A04.1.454.CMB.1.raw
  modified_base (552)..(554): a, c, t, g, unknown or other
  misc_feature (552)..(554): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagcgcccccatgagggctacagtgggagctacgactttgactacgtggggccagggaaccctggtccaccgtctcctcagcctccaccaacgggcccatccggtccttcccccgtggcccaccctccctccaacgacgccaccctcgtcgggggccacgacggccggccctggggcctcggcccttgggtaccaagggtacctaccttcccacgttgacttccgacgtgaggcgggctgggcaacggcgacatagnnn

SEQ ID NO: 221677 - DNA, 534 bp, Homo sapiens
  misc_feature: GYAE6OF01BAXUW.38.4.A04.1.454.CMB.1.raw
  modified_base (533)..(534): a, c, t, g, unknown or other
  misc_feature (533)..(534): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactactggggccagggaaccctggtcaccgtctcctcagcctcaccaagggcccatcggtcttcccccgtggccaccctcctccaacgacgccacctcgtgggggccacgacggccggccctggggcctcgcccgtggtccaaggacctaccttccgacgtgactcgacgtggagcgggctggcaaggcgcatacgnn

SEQ ID NO: 221678 - DNA, 645 bp, Homo sapiens
  misc_feature: GYAE6OF01EQM0C.38.4.A04.1.454.CMB.1.raw
  modified_base (299)..(299): a, c, t, g, unknown or other
  misc_feature (299)..(299): n is a, c, g, or t
tcagtcgatcacgtcacgaccggtgctcgatttagagtagtgatcgtagggggggttcccgtgagactctcctgtgcagcctctgcattccacctttagtaactatttaatgagctgggtccgccagcctccgagggaaggggcttggagttgggtggccagcattaaccagatggacgtgaaaaatctatgtggactctgtgaagggccgattcgccatctccagagacaacggccaagactcactgtggctgcacatgaacggcctgagaggcgacgacacggctgtgtactttcgngtgcgagacgcccccagtggagggctacaggtgggagtcttacgactttgaactacgtggggccaagggaaccctggtaccaccggttctccctcgacgccctccaccgtaacgggcccaacgttccggtaccttcccccgtggaccctaacccctcctaccaacgcgccgaccctcgtcggggccacgacgccggaccccgttgggccgtcggcccgttgggtaccgtaacggtaccttaccgttcccgtaacggttcggtaacgtccggtaaccgttcggtaacgggtcccggggttcgttcggggtaccgaaacggggtccgtaccgaagttacggtgtcgtg

SEQ ID NO: 221679 - DNA, 541 bp, Homo sapiens
  misc_feature: GYAE6OF01DZVRY.38.4.A04.1.454.CMB.1.raw
  modified_base (540)..(541): a, c, t, g, unknown or other
  misc_feature (540)..(541): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagcctccaccaagggcccatcggtccttccccctggcccaccctcctccaacgacgccacctcgtcgggggccacgacgccggccctggggcctcggcccgtggtccaagggtacttaccgttccacgtgactcgacgtggagcgggctggcaaggcgacatagnn

SEQ ID NO: 221680 - DNA, 549 bp, Homo sapiens
  misc_feature: GYAE6OF01ERX43.38.4.A04.1.454.CMB.1.raw
  modified_base (547)..(549): a, c, t, g, unknown or other
  misc_feature (547)..(549): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtgggagctacgactttgactacgtggggccagggaaccctggtccaccgtctcctcagccctccaccaagggcccatccggtccttccccctcggccaccctcctccaacgacgccaccctcgtcgggggccacgacgccggcccgtggggcctcggcccgtggtccgaacggtacctaccgttccacggtcgactcgacgtggagcgggctggcaacgggcgcatgnnn

SEQ ID NO: 221681 - DNA, 512 bp, Homo sapiens
  misc_feature: GYAE6OF01B2SQ9.38.4.A04.1.454.CMB.1.raw
  modified_base (511)..(512): a, c, t, g, unknown or other
  misc_feature (511)..(512): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagcctccaccaagggcccatcggtcttccccctggcaccctcctccaagacgcacctcgtggggcacgagccggccctggggctgcctggtcaacggctactccacgtgatcgacgtgagcgggctggcaggcgcatgnn

SEQ ID NO: 221682 - DNA, 545 bp, Homo sapiens
  misc_feature: GYAE6OF01DGNJS.38.4.A04.1.454.CMB.1.raw
  modified_base (543)..(545): a, c, t, g, unknown or other
  misc_feature (543)..(545): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtgggagctacgactttgactacgtggggccagggaccctggtccaccgtctcctcagcctccaccgagggcccatccggtccttccccctcggccaccctccctaccaacgacgcacccgtcgtgggggccacgacgccggcccgtgggcctcggcccgtggtcaacggacctaccttccgacgtgactcgacgtggaggcgggcgtggcaaggcgacatagnnn

SEQ ID NO: 221683 - DNA, 534 bp, Homo sapiens
  misc_feature: GYAE6OF01EN00V.38.4.A04.1.454.CMB.1.raw
  modified_base (533)..(534): a, c, t, g, unknown or other
  misc_feature (533)..(534): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagccctccaaccaagggcccatccggtccttccccctggccaccctcctccaacgacgccaccctcgtcgggggccacgacgccgggccctgggcctcgccgtggtcaaggactactccacgtgactcgacgtggagcgggcgtggcgaacggcgacatagnn

SEQ ID NO: 221684 - DNA, 623 bp, Homo sapiens
  misc_feature: GYAE6OF01D8HK6.38.4.A04.1.454.CMB.1.raw
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtccaccgtctcctcacgccctccaccgaacggggcccacgtccggtccttcccccgtcggcccaccctcctccaacgacgccacccgtcgtcgggggccacgacggccgggcccgtcggggcctcggcccgttcgggtaccgaaacgggtaccttaccgtttcccgaaccggttcggacgttccggtaaccgttcgggaacgggtcccgggggtccgttcggggacccgaaaacggggtccggaccgaagttaacggcgngng

SEQ ID NO: 221685 - DNA, 547 bp, Homo sapiens
  misc_feature: GYAE6OF01BP1V1.38.4.A04.1.454.CMB.1.raw
  modified_base (543)..(544): a, c, t, g, unknown or other
  misc_feature (543)..(544): n is a, c, g, or t
  modified_base (546)..(547): a, c, t, g, unknown or other
  misc_feature (546)..(547): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtgggagctacgactttactactggggccagggaaccctggtcaccgtctcctcacgccctccaccgaacgggccccacgtccggtccttcccccctcgggccaccccctcctcccaacgacgccacctccgtgggggccacgacgcggcccgtgggctgcccgtgggtcaaggtactacgttccacgtgatcgactggacgcgggctgggcaaggcgcatagnngnn

SEQ ID NO: 221686 - DNA, 539 bp, Homo sapiens
  misc_feature: GYAE6OF01ADH6U.38.4.A04.1.454.CMB.1.raw
  modified_base (537)..(539): a, c, t, g, unknown or other
  misc_feature (537)..(539): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactacgtggggccagggaccctggtcaccgtctcctcagcctccaccgaacgggcccatccggtccttcccccgtggcccaccctcctccaagacgccaccctcgtcggggccacgaggccggccctcgggcctcgcctggtcgaaggacctacttccacgtgactcgactggagcggcgtcgggcaacggcgacagtagnnn

SEQ ID NO: 221687 - DNA, 526 bp, Homo sapiens
  misc_feature: GYAE6OF01AJN7M.38.4.A04.1.454.CMB.1.raw
  modified_base (524)..(526): a, c, t, g, unknown or other
  misc_feature (524)..(526): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagcctccaccaagggcccatcggtccttccccctggccaccctcctcccaagacgccaccctcgtcgggggccacgacgccggcccgtgggcctgcccgtggtccaaggactacttccacgtgactcgactgagcgggctggcaaggcgcatgnnn

SEQ ID NO: 221688 - DNA, 619 bp, Homo sapiens
  misc_feature: GYAE6OF01DBSDP.38.4.A04.1.454.CMB.1.raw
  modified_base (321)..(321): a, c, t, g, unknown or other
  misc_feature (321)..(321): n is a, c, g, or t
  modified_base (614)..(614): a, c, t, g, unknown or other
  misc_feature (614)..(614): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgccatctccagagacaacgccaaagaactcactgtgctgcacatgaacggctgagaggcgacgacacggctgtgtacttctgtgcgagacgcccccatgaggctacagtggganctacgactttgactacgtggggccagggaaccctggtccaccgtctcctcacgccctccaccgagggcccagtccggtccttcccccgtggccctaccctcctacccaagacgccaccgtccgtcggggccaccgaggcccgggcccgtggggcctcggacccgttgggtaccgaaacggtaccttacccgttcccgaaccggttcgaacgttacccggaaccgttcgggaacgggtcccgggggtccgttacgggggacccctaaacgggggcccgaccgtaagttaacggngcgag

SEQ ID NO: 221689 - DNA, 536 bp, Homo sapiens
  misc_feature: GYAE6OF01DCGLL.38.4.A04.1.454.CMB.1.raw
  modified_base (325)..(325): a, c, t, g, unknown or other
  misc_feature (325)..(325): n is a, c, g, or t
  modified_base (534)..(536): a, c, t, g, unknown or other
  misc_feature (534)..(536): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtactttctgtgcgagacgcccccatgagggctacagtggganctacgctttgactacgtggggccagggaaccctggtccaccgtctcctcacgccctccaccgaagggcccagtccggtcttccccctggcccacccctcctccaacgacgccacctcgtcggggccacgacgccggcccgtgggcctcggcctggtcaaggctacttccacgtgactcgacgtggagcgggctgggcaagggcacatgnnn

SEQ ID NO: 221690 - DNA, 540 bp, Homo sapiens
  misc_feature: GYAE6OF01EZOP8.38.4.A04.1.454.CMB.1.raw
  modified_base (538)..(540): a, c, t, g, unknown or other
  misc_feature (538)..(540): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactacgtggggccagggaaccctggtcaccgtctcctcagccctccaccaagggcccatccggtcttccccctggccaccctcctccaagacgcacctcgtcgggggccacgacggccggccctggggcctcggcccgtgggtccaaggacctacttccgacgtgactcgacgtgaggcgggctgggcaacgggcgacatgnnn

SEQ ID NO: 221691 - DNA, 556 bp, Homo sapiens
  misc_feature: GYAE6OF01BJW6C.38.4.A04.1.454.CMB.1.raw
  modified_base (554)..(556): a, c, t, g, unknown or other
  misc_feature (554)..(556): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccatgagggctacgagtgggagctacgactttgactacgtggggccagggaccctggtcaccgtctcctcacgccctccaccgaacgggcccatccggtccttcccccgtggcccacccctcctcccaagacgccacccgtcgtcggggccacgacggccggcccgtgggcctcggcccgttgggtccaacggaccttaccgttccgacgtgactcgacgtggacgcggggctcgggcgaacgggcgacatgnnn

SEQ ID NO: 221692 - DNA, 555 bp, Homo sapiens
  misc_feature: GYAE6OF01D9FRW.38.4.A04.1.454.CMB.1.raw
  modified_base (326)..(326): a, c, t, g, unknown or other
  misc_feature (326)..(326): n is a, c, g, or t
  modified_base (458)..(458): a, c, t, g, unknown or other
  misc_feature (458)..(458): n is a, c, g, or t
  modified_base (552)..(553): a, c, t, g, unknown or other
  misc_feature (552)..(553): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtgccagcattaaccaagatggacgtagaaaaatactatgtggactctgtgaagggccattcgccatctccagagacaacgccaagaactcactgtggctgcacatgaacggcctgagaggcgacgacacggctgtgtacttctgtgcgagacgcccccatgagggctacgaggtggganctacgctttgactacgtggggccagggaaccctggtcaccgtctcctcacgccctccaccgaacgggccctagtccggtccttcccccgtggccctaccctcctccaagacgccaccgtcgtggggccacgngccggccctgggcctgcccgtggtccaaggtcctacgttccacgtgacgtcgacgtcggaggcgggctcgggacgaacgggccgacgagtacgnngc

SEQ ID NO: 221693 - DNA, 546 bp, Homo sapiens
  misc_feature: GYAE6OF01CJ0HJ.38.4.A04.1.454.CMB.1.raw
  modified_base (543)..(544): a, c, t, g, unknown or other
  misc_feature (543)..(544): n is a, c, g, or t
  modified_base (546)..(546): a, c, t, g, unknown or other
  misc_feature (546)..(546): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggcccaggggaaccctggtcaccgtctcctcagccctccaccaagggcccatccggtccttcccccgtggcccaccctcctccaagacgccaccctcgtcgggggccacgacggccggcccgtgggcctcggccctgggtccaacgggtacctacgttccacgtgactcgactggagcgggctggcaaggcgcatagnngn

SEQ ID NO: 221694 - DNA, 534 bp, Homo sapiens
  misc_feature: GYAE6OF01D78G2.38.4.A04.1.454.CMB.1.raw
  modified_base (300)..(300): a, c, t, g, unknown or other
  misc_feature (300)..(300): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtactttctgtgcgagngcccccatgagggctacgaggtgggagctacgactttgactacgtgggggcccaggggaaccctgggtccaccgtctcctcacgcctccaccaagggcccagtccggtccttcccccgtggccaccctcctccaacgacgccacctcgtgggggccacgacgccggccctgggctcgcctggcaaggactacttcacgtgatcgactgagcgggctggcaaggcgacatagngn

SEQ ID NO: 221695 - DNA, 612 bp, Homo sapiens
  misc_feature: GYAE6OF01EHXFU.38.4.A04.1.454.CMB.1.raw
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtgctgcacatgaacggctgagaggcgacgacacggctgtgtacttctgtgcgagcgcccccatgagggctacgagtgggagctacgactttgactacgtggggccagggaccctggtccaccgtctcctcacgccctccaccgaagggcccagtccggtccttcccccgtggcccaccctcctaccaacgacgccacccgtcgtcggggccacgacggccggcccgtgggcctcggcccgttgggtaccgaaacgggtacccttaccgttcccgaaccggttcgaacgttccggaaccgttcgggaacggggcccggggccgttacggggacccgtaaacggggtcccggacgtaagttaacggngngacg

SEQ ID NO: 221696 - DNA, 547 bp, Homo sapiens
  misc_feature: GYAE6OF01DG0IP.38.4.A04.1.454.CMB.1.raw
  modified_base (545)..(547): a, c, t, g, unknown or other
  misc_feature (545)..(547): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccagggagggctggagtgggtgccagcattaaccaagatggacgtagaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacaggtgggagctacgactttgactacgtggggccagggaaccctggtccaccgtctcctcacgccctccaccaacgggcccatccggtccttcccccgtggcccaccctccctaccaacgacgccaccctcgtcggggcacgacggccggcccgtgggcctcgccgtggtcgaaggaccttacttccgacgtgactcgacgtggagcgggctgggcaagggcgacatagnnn

SEQ ID NO: 221697 - DNA, 624 bp, Homo sapiens
  misc_feature: GYAE6OF01ALHD9.38.4.A04.1.454.CMB.1.raw
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
tcagtcgatcacgtcacgaccggtgctcgatttagagtagtgatcagggggggtcccgtgagactctcctgtgcagcctctgcattcacctttagtaactatttaatgagctgggtccgccagcctcagggagggctggagtggtgcagcattaaccagatggacgtgaaaatctatggtggactctgtggaagggccggattcgccatctccagagacacgccaagactcactgtgctgcacatgacggcctagagacggcgacgacgacggctgtgtacttctgtgacgagccgccccagtggaggtctacgaggtgggatcgtacgtacgtttgacgtacgtcggggccacgggtaccctggtccaccgttctcccgtagaccgtccctaccgaaccgtacggggttcctacgttccggttccttaccccgtacggtaccctaacccttccgtacccgaacggaccgtaccgacccggttcgtacggggccacgtacggcccgggtccgtgggacctcggtcgttcggtacaacggttacgtaccgttaccgtacggtcgtcgtccgacggtcggacgggtccggtcgtacggaccgtacggccgtacgagtcgngtcncg

SEQ ID NO: 221698 - DNA, 517 bp, Homo sapiens
  misc_feature: GYAE6OF01CCIOX.38.4.A04.1.454.CMB.1.raw
  modified_base (325)..(325): a, c, t, g, unknown or other
  misc_feature (325)..(325): n is a, c, g, or t
  modified_base (516)..(517): a, c, t, g, unknown or other
  misc_feature (516)..(517): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagagcccccatgagggctacagtggganctacgactttgactacgtggggccagggaaccctggtcaccgtctcctcagcctccaccaagggcccatccggtccttccccctggccaccctcctccaagcgcaccctcgtggggcacgagccgccgtgggctcgccgtggtcaaggactactccacgtgactcgactgagcgggctggcaggcgcatgnn

SEQ ID NO: 221699 - DNA, 536 bp, Homo sapiens
  misc_feature: GYAE6OF01DRHVA.38.4.A04.1.454.CMB.1.raw
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (536)..(536): a, c, t, g, unknown or other
  misc_feature (536)..(536): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacgagtgggagctacgactttgactacgtggggccagggaaccctggcaccgtctcctcacgcctccaccgaacgggcccacgtccgtccctcccgcgcccaccctccacaagcncctacgtcggcgggacacgnggccgccgtggcctcgccgtgacgacgtactactaccgcgtgctacgacgtcggaggcggtcgcggacgacggcgatagngnngn

SEQ ID NO: 221700 - DNA, 518 bp, Homo sapiens
  misc_feature: GYAE6OF01DDIRV.38.4.A04.1.454.CMB.1.raw
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtggtggccagcattaaccaagatggacgtgaaaaatctatgtggatttctgtgaagggccattcgccatctccagagacaacgccaaagaactcactgtggctgcacatgaacggcctgagaggcgacgacacggctgtgtacttctgtgcgagagcccccatgagggctacagtgggagctacgactttgactacgtggggccagggaccctggtcaccgtctcctcagccctcaccaaggccatcggtcttcccctcggcaccctcctcaacgagcacctcgtggggccacgagccggccctgggctgccgtggtcaaggactaccttccacgtgactcgacgtgagcgggcgtggacaaggtcgcatagnngn

SEQ ID NO: 221701 - DNA, 572 bp, Homo sapiens
  misc_feature: GYAE6OF01D274S.38.4.A04.1.454.CMB.1.raw
  modified_base (571)..(572): a, c, t, g, unknown or other
  misc_feature (571)..(572): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtactttctgtgcgagacgcccccatggagggctacaggtgggagctacgactttgactacgtggggccaggggaaccctggtccaccgtctcctcacgccctccaccgaacgggcccagtcccggtccttccccccgtcggccctacccctccctaccaacgacgccacccgtcgtcggggccacgacggcccggcccgtggggccttcggcccgttgggtacaacgggtacctaccgttccgacgtgactcgacgtggaggcgggctgggcaacgggcgacatagnn

SEQ ID NO: 221702 - DNA, 555 bp, Homo sapiens
  misc_feature: GYAE6OF01EMVG1.38.4.A04.1.454.CMB.1.raw
  modified_base (554)..(555): a, c, t, g, unknown or other
  misc_feature (554)..(555): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggctgagaggcgacgacacggctgtgtacttctgtgcgagacgcccccatgagggctacgaggtgggagctacgactttgactacgtggggccagggaaccctggtccaccgtctcctcacgcctccaccaacgggccactccggtccttccccctcggccaccctcctaccaacgacgccacctccgtcggggccgacacggccggcccgtcgggcgtcgccgtcggtacgaacggaccgtaccttcccgtacgtcggtactcgacgtggacggcgggcgtggcgagcgcaatgnn

SEQ ID NO: 221703 - DNA, 550 bp, Homo sapiens
  misc_feature: GYAE6OF01DT4OW.38.4.A04.1.454.CMB.1.raw
  modified_base (548)..(550): a, c, t, g, unknown or other
  misc_feature (548)..(550): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacaggtgggagctacgactttgactacgtggggccagggaaccctggtcaccgtctcctcacgccctccaccgaacgggcccagtccggtccttcccccgtcggcccaccctcctccaacgacgccaccgtcgtcgggggccacgacgccgggccgtcgggctcggccgtggtccaaggtacttaccgtccacgtgactcgacgtgaggcgggcgtggcgaggcgacatagnnn

SEQ ID NO: 221704 - DNA, 534 bp, Homo sapiens
  misc_feature: GYAE6OF01EYQCB.38.4.A04.1.454.CMB.1.raw
  modified_base (526)..(526): a, c, t, g, unknown or other
  misc_feature (526)..(526): n is a, c, g, or t
  modified_base (532)..(534): a, c, t, g, unknown or other
  misc_feature (532)..(534): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagcctccaccaagggcccatccggtccttccccctggccaccctcctccaacgacgccaccctcgtcgggggccacgacggccggccctggggctcggcccttggtccaaggcctacttccacgtgatcgacgtgagcgggctggcaaggcncatagnnn

SEQ ID NO: 221705 - DNA, 544 bp, Homo sapiens
  misc_feature: GYAE6OF01AYKUB.38.4.A04.1.454.CMB.1.raw
  modified_base (493)..(493): a, c, t, g, unknown or other
  misc_feature (493)..(493): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcgtggtttcgtgtagctatttagaaggtgtcagtgtgaggtgcaactggtggagtcgtgggggaggcttgggtccaggccgggggggtccctgagactctcctgtgcagcctctgcattccacctttagtaactatttaatgagtctggggtcccgccagcctccgaggggaagggctgggagtgggtggccagcagttaaccaagatggacgtagaaaaaatctaagtgtggtactcgtgtgaaggggcctaattcggaccattcaccgagacgacaaccgcaagaacctcacgtgtaggctggcaactgtacggaacggctaggagaggcgaacgacgacggcttgngtacttcgtgtgcgagcgccccagtggacgggtctagngngggngtctacg

SEQ ID NO: 221706 - DNA, 839 bp, Homo sapiens
  misc_feature: GYAE6OF01ESU6Z.38.4.A04.1.454.CMB.1.raw
  modified_base (574)..(574): a, c, t, g, unknown or other
  misc_feature (574)..(574): n is a, c, g, or t
  modified_base (834)..(834): a, c, t, g, unknown or other
  misc_feature (834)..(834): n is a, c, g, or t
tcagtcgatcacgtcacgaccggtgctcgattttagagtagtgatctagggggggttcccggtgaggactctcctcgtgcaggcctctgcattcgacctttagtaactagtttaacctgagctcgggttcccgccggacgtccctccgagggaagggggctgggtaggtcgggttcggccgaggccaaatttaaccgaaggactaggtaccgtaggtaaaaaagtacctaagttcgtcggaacttcctcgtggaacgggccgacttcgcctatctccagagaccaaacgcctaagaacttcgaccgtgtggcgtgctacgatgaacggccttaggacgtagggcgacgacacggactacggtgggtaacttctgtagccgtacgcaaacgtccccttagggacgttacgggacctttaccggaaagggttttcggggaaacgtcggttttaacgggtaccccttttaaagttccggggaaaccgtttcggggggaaaccctacggggggtaacccctaacgggttcggtaacccggtttcctacgggtaaccctaggaccccttttaacccggntaaaccgtacccggggtacctacccccgtaagggttcccctaacccccgttccggtccaacccgttacccgtccaaaccggtccgtacgggaaccctaccggtttcggggccggaaccctaacgggtccgttaccggtccggtggtaaccaacggtttacggttacgttaacccgaacgtttcctacccgttaccggacgtaggtaccgtaacgggtcgtacgggccggtacggtaccggaacgtacgggtacggctagngtacg

SEQ ID NO: 221707 - DNA, 566 bp, Homo sapiens
  misc_feature: GYAE6OF01C5EA2.38.4.A04.1.454.CMB.1.raw
  modified_base (564)..(566): a, c, t, g, unknown or other
  misc_feature (564)..(566): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctcagagacaacgccaagaactcactgtggttgcacatgaacggcctgagaggcgacgacacggctgtgtacttctgtgcgagacgcccccactgagggctacgagtgggagctacgactttgactacgtggggccagggaaccctggtcaccgtctcctcacgcctccaccaagggcccagtccggtccttcccccgtggccacccctcctaccaagacgccacctcgtcgggggcacgacgccggcccgtgggcctcggcccgttgggtaccaacgggtaccttaccgttccgacgttcgactccggactggacggccgggcgtgggccgaagggcgacgataggcnnn

SEQ ID NO: 221708 - DNA, 607 bp, Homo sapiens
  misc_feature: GYAE6OF01D1XFI.38.4.A04.1.454.CMB.1.raw
  modified_base (323)..(323): a, c, t, g, unknown or other
  misc_feature (323)..(323): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgaggctacgagtggganctacgactttgactacgtggggccagggaaccctggtccaccgtctcctcacgccctccaaccgaacgggccccaagttccgggtccctttccccccgtcgggccctaaccccttccctacccgaaacgacgccacccgtcgtcgggggccacgacggccggccccgtggggcctcggcccgtcggtaccgaaacgggtaccttaaccgttccgaacggtgtaaccgtccggaacgtggaacggccggggcctacgggccaaacgggccgacaagtacggnngn

SEQ ID NO: 221709 - DNA, 567 bp, Homo sapiens
  misc_feature: GYAE6OF01ES90V.38.4.A04.1.454.CMB.1.raw
  modified_base (327)..(327): a, c, t, g, unknown or other
  misc_feature (327)..(327): n is a, c, g, or t
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatgaaggctacaggtggganctacgtactttgactacgtcggggccaacgggaccctggtccaccgtctcctcacgccctccaaccgacgggcccacgtccggtccttcccccgtcggcccaccctcctaccaacgcgccacctcggtcggggcacgacggccggcccgtgggcctcgccgtggtacgaacggtaccttacctccgacgtgacgtcgacgtcggaggccgggcgtcggacgaacgggccgacagtgnngn

SEQ ID NO: 221710 - DNA, 568 bp, Homo sapiens
  misc_feature: GYAE6OF01CEZMB.38.4.A04.1.454.CMB.1.raw
  modified_base (566)..(568): a, c, t, g, unknown or other
  misc_feature (566)..(568): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccagggaccctggtcaccgtctcctcagccctccaccgaacgggcccacgtccggtccttcccccgtcggccaccctccctccaacgacgccaccgtcgtcgggggccacgacggccgggcccgtcgggcctcggcccgtgggtaccgaaacggtacctaccgttcccgacgtcgacgtccgacgtggacggcgggcgtcgggcgaacggccgacatgnnn

SEQ ID NO: 221711 - DNA, 522 bp, Homo sapiens
  misc_feature: GYAE6OF01A72DE.38.4.A04.1.454.CMB.1.raw
  modified_base (520)..(522): a, c, t, g, unknown or other
  misc_feature (520)..(522): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactacgtggggccagggaccctggtcaccgtctcctcagcctccaccaagggcccatccggtcttccccctggccaccctcctccaacgacgccacctcgtcgggggccacgagccggcccgtgggcctgccctggtcaaggactacttccacgtgatcgactgagcgggctggcaaggcgcatgnnn

SEQ ID NO: 221712 - DNA, 560 bp, Homo sapiens
  misc_feature: GYAE6OF01CR6UW.38.4.A04.1.454.CMB.1.raw
  modified_base (558)..(560): a, c, t, g, unknown or other
  misc_feature (558)..(560): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaaatactatgtggactctgtgaagggccgattcgccatctccagagacaacgccaaagaactcactgtggctgcacatgaacggctgagaggcgacgacacggctgtgtacttctgtgcgagacgcccccatggagggctacgaggtgggagctacgactttgactacgtggggccaggaaccctggtcaccgtctcctcacgccctccaaccgaacgggcccagtccggtccttccccccgtggcccaccctcctaccaacgacgccacctcgtcgggggccacgacggccggcccgtgggcctcgcccgtggtaccgaaggacctaccttccgacgtgactcgacgtgaggcggcgtggcgaacggcgacatacgnnn

SEQ ID NO: 221713 - DNA, 554 bp, Homo sapiens
  misc_feature: GYAE6OF01CFYVT.38.4.A04.1.454.CMB.1.raw
  modified_base (448)..(448): a, c, t, g, unknown or other
  misc_feature (448)..(448): n is a, c, g, or t
  modified_base (552)..(554): a, c, t, g, unknown or other
  misc_feature (552)..(554): n is a, c, g, or t
tcagtcgatcacgtcacgaccggtgctcgatttagagtagtgatcgaggggggtccctgagactctcctgtgcagcctctgcattcacctttagtaactatttaatgagctgggtccgccagcctccgaggggaaggggctgggagtgggtggccagcaattaaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggagctaacgtactttgactacgtggggaccagggaaccctggtccaccgtctcctcacgccctccaccgacgggcccagtccggtccttcccccgtggcccaccctccaccaagcnccacctcgtggggccacgacggccggccgtgggcctgccgtggtacaaggtctacttccacgtgactcgacgtggagcgggctcggacgaacgggcgacagtgnnn

SEQ ID NO: 221714 - DNA, 519 bp, Homo sapiens
  misc_feature: GYAE6OF01DTNLB.38.4.A04.1.454.CMB.1.raw
  modified_base (299)..(299): a, c, t, g, unknown or other
  misc_feature (299)..(299): n is a, c, g, or t
  modified_base (470)..(470): a, c, t, g, unknown or other
  misc_feature (470)..(470): n is a, c, g, or t
tcagtcgatcacgtcacgaccggtgctcgatttagagtagtgatcaggggctctcggagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactatttaatgagctgggtccnccagcctccgaggggagggctggagtgggtgccagcattaaccagatggacgtagaaaaatctatgtggactctgtgaagggccgattcgacatctaccagagacaacgccaaagaactcactgtgctgcacatgaacgctagagaggcgacgacacggctgtgtacttcnggtgcgagacgcccccagcggagggctacgaggtgggagtcgtagtacg

SEQ ID NO: 221715 - DNA, 570 bp, Homo sapiens
  misc_feature: GYAE6OF01BS6VE.38.4.A04.1.454.CMB.1.raw
  modified_base (323)..(323): a, c, t, g, unknown or other
  misc_feature (323)..(323): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacgcctgagaggcgacgacacggctgtgtacttctgtgcgagacgccccatgagggctacagtggganctacgactttgactacgtggggccagggaaccctggtcaccgtctcctcacgccctccaccgaacgggcccactccggtccttccccccgtggccctaccctccctccaacgacgcctacccgtcgtcggggccacacggccggcccgtgggctcgccgtcggtcaacggacctacgttcccgacgtacgacgtaccggacgtcggaggccggggctacgggcgaacgggccgacgagtagngngng

SEQ ID NO: 221716 - DNA, 539 bp, Homo sapiens
  misc_feature: GYAE6OF01AEHH7.38.4.A04.1.454.CMB.1.raw
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (537)..(539): a, c, t, g, unknown or other
  misc_feature (537)..(539): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttcngtgcgagacgccccactgagggctacagtggganctacgactttgactacgtggggccagggaaccctggtcaccgtctcctcacgcctccaccaagggcccagtccggtccttcccccgtggcccaccctcctccaagacgccacctcgtggggccacgacgccggccctgggcctgcccgttggtccaaggacctacgttccaacgtgactcgacgtggaggcgggctgggcaaggcgacatagnnn

SEQ ID NO: 221717 - DNA, 570 bp, Homo sapiens
  misc_feature: GYAE6OF01BZXYZ.38.4.A04.1.454.CMB.1.raw
  modified_base (569)..(570): a, c, t, g, unknown or other
  misc_feature (569)..(570): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgaggctacgaggtgggagctacgactttgactacgtggggccagggaaccctggtcaccgtctcctcacgccctccaccgaacggcccacgttcccggtccttccccccgtggccccaccccgtccctaccgaacgcgcctacccgtcgtcggggccacgacggccggcccgtcgggcctcgccgtcggtaccgaaggtacctacctccgacgttgacgtcgacgtggacggcgggcgtcgggacgaacggcacagtacgnn

SEQ ID NO: 221718 - DNA, 598 bp, Homo sapiens
  misc_feature: GYAE6OF01EXZL8.38.4.A04.1.454.CMB.1.raw
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccacgggaaccctggtcaccgtctcctcacgccctccaaccgaacgggcccacgtccggttccttccccccgtcggccctaccctccctaccaacgacgccacccgtcgtcgggggccacgacggccggcccgtcgggcctcggccgttcgggtaccgaacggtaccttaccgttcccgacggttcgacgtccggacgttcggacggccggggcgtcgggaccgaacgggccgacgaagtaggnngng

SEQ ID NO: 221719 - DNA, 579 bp, Homo sapiens
  misc_feature: GYAE6OF01A0LK4.38.4.A04.1.454.CMB.1.raw
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacgaggtgggagctacgactttgactacgtggggccaacgggaaccctggtccaccgtctcctcacgccctccaccgaacggcccagtccggtccttcccccgtcggcccaccctcctaccaacgcgccacctcgtggggccacgacggccggcccgtcgggcctcggcccgtgggtaccgaacggtacctaccgttcccgacggtcgactccggacgtcggaggcggggcgtcgggaccgaacgggccggactagtagnngn

SEQ ID NO: 221720 - DNA, 606 bp, Homo sapiens
  misc_feature: GYAE6OF01AB52A.38.4.A04.1.454.CMB.1.raw
  modified_base (602)..(603): a, c, t, g, unknown or other
  misc_feature (602)..(603): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtactttctgtgcgagacgcccccagtggagggctacgaggtgggagctacgacttttgactacgtggggcccagggaaccctggtccaccgtctccctcacgccctccaccgaacggggcccagtccggtccttccccccgtcggcccacccctccctacccaacgacgcctaccgtcgtcgggggccacgacggccggcccgtggggcctcggcccgttcgggtccgaaacgggtaccttaccgttcccgacggtcgtacgtaccggacgtcggacgggccgggcgtcgggaccgaaacgggccgacgtaagtacggnngcg

SEQ ID NO: 221721 - DNA, 550 bp, Homo sapiens
  misc_feature: GYAE6OF01C9C8Z.38.4.A04.1.454.CMB.1.raw
  modified_base (549)..(550): a, c, t, g, unknown or other
  misc_feature (549)..(550): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgaacacggctgtgtacttctgtgcgagacgcccccatggagggctacgagtgggagctacgactttgactacgtggggccagggaaccctggtccaccgtctcctcacgcctccaccgaacgggcccagtccggtccttcccccgtggccctaccctcctaccgaacgacgcacccgtcgtcgggggcacgacgccggcccgtgggctcgccgtggtacaaggtacctacttccacgtgactcgacgtgaggcgggctggacaaggcgacagtagnn

SEQ ID NO: 221722 - DNA, 557 bp, Homo sapiens
  misc_feature: GYAE6OF01CUGAB.38.4.A04.1.454.CMB.1.raw
  modified_base (553)..(554): a, c, t, g, unknown or other
  misc_feature (553)..(554): n is a, c, g, or t
  modified_base (556)..(557): a, c, t, g, unknown or other
  misc_feature (556)..(557): n is a, c, g, or t
tcagtcgatcacgtcacgaccggtgctcgatttagagtagtgatcagggggggtccctgagactctcctgtgcagcctccgcattcacctttagtaactatttaatgagctgggtccgccagcctccagggaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcacgcctccaccgaagggcccagtccggtccttccccctcggccacccctcctccaacgacgccacctcgtcggggccacgacgccggccctgggcctcgccgtcggtcaacggtaccttaccgttccacgtcgactccgacgtcggacggccgggcgtcgggccgaagggccgacagtagnngnn

SEQ ID NO: 221723 - DNA, 536 bp, Homo sapiens
  misc_feature: GYAE6OF01C7OIW.38.4.A04.1.454.CMB.1.raw
  modified_base (329)..(329): a, c, t, g, unknown or other
  misc_feature (329)..(329): n is a, c, g, or t
  modified_base (519)..(519): a, c, t, g, unknown or other
  misc_feature (519)..(519): n is a, c, g, or t
  modified_base (535)..(536): a, c, t, g, unknown or other
  misc_feature (535)..(536): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacgagtggganctacgacttttgactacgtggggacccagggaaccctggtcaccggtctcctcacgcctccaccagggcccagtccggtccttccccctggccaccctcctccaacgacgccacctcgtcggggcacgacgccggcccgtgggctcgccgtggtcaaggtactacttccacgtgatcgactgaggcggcnggcaaggcacatacgnn

SEQ ID NO: 221724 - DNA, 587 bp, Homo sapiens
  misc_feature: GYAE6OF01BZC6M.38.4.A04.1.454.CMB.1.raw
  modified_base (585)..(587): a, c, t, g, unknown or other
  misc_feature (585)..(587): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgaggtgggagctacgtactttgactacgtggggccagggaccctggtcaccgtctcctcacgccctccaccgaacgggcccagtccggtccttccccccgtcggccctacccctccctaccaacgacgccacccgtcgtcgggggccacgacggcccgggcccgtggggcctcggcccgttcgggtaccgaaacgggtaccttaccgttcccgacggttcgactccggacgtggacggccggggctgggcgaacgggcgacagtagnnn

SEQ ID NO: 221725 - DNA, 515 bp, Homo sapiens
  misc_feature: GYAE6OF01DYDW0.38.4.A04.1.454.CMB.1.raw
  modified_base (325)..(325): a, c, t, g, unknown or other
  misc_feature (325)..(325): n is a, c, g, or t
  modified_base (514)..(515): a, c, t, g, unknown or other
  misc_feature (514)..(515): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtggtggccagcattaaccaagatggacgtgaaaaatactatgtggactctgtgaagggccgattcgccatctccagagacaacgccaaagaactcactgtggctgcacatgaacggcctgagaggcgaacgacacggctgtgtacttctgtgcgagagcccccatgagggctacagtggganctacgactttgactactgggggccagggaaccctggtcaccgtctcctcagcctccaaccaagggcccatcggtccttccccctggcaccctcctccaagagcacctctgggggcacagcggccctgggctgcctggtcaaggactacttccacgtgatcgactgagcgggctggcaaggcgacatagnn

SEQ ID NO: 221726 - DNA, 515 bp, Homo sapiens
  misc_feature: GYAE6OF01EUISK.38.4.A04.1.454.CMB.1.raw
  modified_base (513)..(515): a, c, t, g, unknown or other
  misc_feature (513)..(515): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacagtgggagctacgactttgactactggggccagggaccctggtcaccgtctcctcagcctcaccagggcccatcggtcttcccctgcaccctcctccaagacgcacctctcggggcacgacgccggcccgtgggctcgccgtggtcaaggactacttccacgtgactcgacgtgagcgggctggcaaggcgcatagnnn

SEQ ID NO: 221727 - DNA, 541 bp, Homo sapiens
  misc_feature: GYAE6OF01DKXVT.38.4.A04.1.454.CMB.1.raw
  modified_base (324)..(324): a, c, t, g, unknown or other
  misc_feature (324)..(324): n is a, c, g, or t
  modified_base (540)..(541): a, c, t, g, unknown or other
  misc_feature (540)..(541): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtggganctacgactttgactacgtggggccagggaaccctggtcaccgtctcctcagccctccaccaacgggcccatccggtccttcccccctggccaccctcctccaacgacgcacccgtcgtcgggggccacgacgccggcccgtgggcctcggccctgggtccaagggacctaccttccacgtgactcgactggagcgggctgggcaaggcgacatagnn

SEQ ID NO: 221728 - DNA, 529 bp, Homo sapiens
  misc_feature: GYAE6OF01C4F08.38.4.A04.1.454.CMB.1.raw
  modified_base (512)..(512): a, c, t, g, unknown or other
  misc_feature (512)..(512): n is a, c, g, or t
  modified_base (528)..(529): a, c, t, g, unknown or other
  misc_feature (528)..(529): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagccccccatgagggctacagtgggagctacgactttgactacgtggggccagggaaccctggtcaccgtctcctcagcctccaccagggcccatccggtccttcccccctggcccaccctcctacccaagacgccaccctcgtcggggccacgacgccgggcccgtgggcctgcctggtcaaggctacttccacgtgatcgacgtgagcggcnggcaggcgacatacgnn

SEQ ID NO: 221729 - DNA, 553 bp, Homo sapiens
  misc_feature: GYAE6OF01C0CUQ.38.4.A04.1.454.CMB.1.raw
  modified_base (549)..(549): a, c, t, g, unknown or other
  misc_feature (549)..(549): n is a, c, g, or t
  modified_base (551)..(553): a, c, t, g, unknown or other
  misc_feature (551)..(553): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctggagtgggtggccagcaattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatgaggctacaggtgggagctacgactttgaactacgtggggccagggaacccctggtccaccgtctcctcacgccctaccaacaacgggcccagtccgtccttcccccgtcggcccacccctcctaccgaagacgccacctccgtggggccacgacgccgggccgtcgggctcggccgtggtacgaaggacctacttccgacgtgactcgacgtgaggcgggctcggcacggcgacangnnn

SEQ ID NO: 221730 - DNA, 609 bp, Homo sapiens
  misc_feature: GYAE6OF01AYAPO.38.4.A04.1.454.CMB.1.raw
  modified_base (606)..(607): a, c, t, g, unknown or other
  misc_feature (606)..(607): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggagctacgtactttgactcgtggggccacgggaaccctggtccaccgtctccctcacgccctccaccgacgggccccacgtcccggttccttccccccgtcggcccctacccctccctacccgaacgacgcctacccgtcgtcgggggccacgacggcccgggcccgtcggggcctcggccgttcgggtaccgaaacgggtaccttaccgttccgacggttcgtacgtccggacgtcggacggccggggcgtcgggaccgaacgggccgacgaagtacgnncg

SEQ ID NO: 221731 - DNA, 582 bp, Homo sapiens
  misc_feature: GYAE6OF01DHNT3.38.4.A04.1.454.CMB.1.raw
  modified_base (330)..(330): a, c, t, g, unknown or other
  misc_feature (330)..(330): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggggctgggagtgggtggccagcaattaaccaagatggacgtagaaaaatactatgtggactctgtgaaggccgattcgccatctccagagacaacgccaagaactcactgtggctgcacatgaacggcctgagaggcgacgacacggctgtgtacttctgtgcgagacgcccccatggaggctacgaggtgggancgtacgactttgactacgtggggccagggaaccctggtccaccgtctcctcacgccctaccaccgaacgggcccacgtccggtcccttcccccgtggcccctaccctccctaccgaagacgcctaccgtcgtcggggccacgacggccggcccgtgggcctcggcccgtgggtaccaacggtaccttacgtcccgacgtcgactccggacgtcggaggccgggctcgggaccgaagggcgacgaatgntncg

SEQ ID NO: 221732 - DNA, 587 bp, Homo sapiens
  misc_feature: GYAE6OF01AZGXE.38.4.A04.1.454.CMB.1.raw
  modified_base (320)..(320): a, c, t, g, unknown or other
  misc_feature (320)..(320): n is a, c, g, or t
  modified_base (584)..(586): a, c, t, g, unknown or other
  misc_feature (584)..(586): n is a, c, g, or t
tcagtcgatcacgtcacgaccggtgctcgatttagagtagtgatcagggggggtccctgagactctcctgtgcagcctctgcattcacctttagtaactatttaatgagctgggtccaccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgnggtgggagctacgactttgactacgtggggccagggaaccctggtcaccgtctcctcacgccctccaccgaacgggcccacgtccggtcccttcccccgtcggccccacccctccctacccgaacgacgaccacccgtccgtgggggccacgacggccggccccgtgggccgtcggcccgttgggtaccaacgggtaccttaccttcccgacgtcgactccggacgtggacggcgggtcgtgggccgaacgggcgacgagtagnnng

SEQ ID NO: 221733 - DNA, 540 bp, Homo sapiens
  misc_feature: GYAE6OF01B74CZ.38.4.A04.1.454.CMB.1.raw
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgccccccatggagggctacgagtgggagctacgactttgactacgtggggccagggaaccctggtcaccgtctcctcagccctccaccgaagggcccagtccggtccttcccccgtggcccaccctcctccaagacgccacctcgtcggggccacgagccggcccgtgggcctcgccgtggtcaaggtacctacttccacgtgactcgactgagcgggctggacaagggcacatagnngn

SEQ ID NO: 221734 - DNA, 862 bp, Homo sapiens
  misc_feature: GYAE6OF01EJSCC.38.4.A04.1.454.CMB.1.raw
  modified_base (861)..(861): a, c, t, g, unknown or other
  misc_feature (861)..(861): n is a, c, g, or t
tcagtcgatcacgtcacgaccggtgctcgatttagagtagtgatcaggggggtccctgagactctcctgtgcagcctctgcattcacctttagtaactatttaatgagctgggactccgcgacgtccacggaaggggacggtgtaggtggtgggcgacgagacttaaactaaacgaagtagtacggtagtaaaataaaacttactagttggtacgtacttgttggaagggaccggacttacgtcccgactacttccacgaaggaacgaaaccgaaccgaaccgaaaacgtacctacctacggttgggtcgtcgtacgaaccaactaggtaacggaacccgtcgtaaggaaggaccggaccgaaccgaaccggaccggttcgttaggttaccgttttacctttcggttacggtccggaacggaaccggaccccccgacccccgtaggtacggggaccgttacctaacggtaggggtacggtaccgtaaccgttaacccgttttacgtttaccggtaaaccgtttacgggggcccgggaacccgggaaacccggttacccggtttccggtaaccccgttacccgtttcccctacccgtaccgacccgttaccccctaaccccgaaaccggggtaccccggtacccttaccgggtttccccgtttcccccccttaccccggcgtaccccctacccccttccgaaaccgaacgccctacccgtaccgtcgggggaccgaaccacggccgggcccgtcgggtcgtccgtccgtcggttagaacgaacgttaccttcccgtacgtaggtctacgtccgtacggtaggacccgggtcggtacgacggaacggacgggctaagtagcgnc

SEQ ID NO: 221735 - DNA, 556 bp, Homo sapiens
  misc_feature: GYAE6OF01DOO2A.38.4.A04.1.454.CMB.1.raw
  modified_base (332)..(332): a, c, t, g, unknown or other
  misc_feature (332)..(332): n is a, c, g, or t
  modified_base (555)..(555): a, c, t, g, unknown or other
  misc_feature (555)..(555): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagccctccgagggaagggggctgggagtgggtggccagcaattaaccaagatggacgtagaaaaatactatgtggactctgtgaagggccattcgccatctccagagacaacgccaagaactcactgtggctgcacatgaacggcctgagaggcgacgacacggctgtgtacttctgtgcgagacgcccccatgagggctacgagtggganctacgactttgactacgtggggccagggaaccctggtccaccgtctcctcacgcctccaccaacgggcccatcggtccttcccccgtggccctaccctcctccaacgacgccacctccgtgggggccacgacggccgcccgtgggcctcggcccgtggtacaacgggacttacgttcccacggttgactcgacgtggagcgggctgggacaggcgacagtagng

SEQ ID NO: 221736 - DNA, 531 bp, Homo sapiens
  misc_feature: GYAE6OF01A62V0.38.4.A04.1.454.CMB.1.raw
  modified_base (323)..(323): a, c, t, g, unknown or other
  misc_feature (323)..(323): n is a, c, g, or t
  modified_base (529)..(531): a, c, t, g, unknown or other
  misc_feature (529)..(531): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactacgtggggccagggaccctggtcaccgtctcctcagcctccaccgaagggcccagtccggtccttccccctcggcccaccctcctccaacgacgccacctcgtcggggcacgacgccggcccgtgggctcgccgtggtcaaggacctactccacgtgatcgacgtgaggcgggctggcgaaggcgacatagnnn

SEQ ID NO: 221737 - DNA, 575 bp, Homo sapiens
  misc_feature: GYAE6OF01BRM5P.38.4.A04.1.454.CMB.1.raw
  modified_base (573)..(575): a, c, t, g, unknown or other
  misc_feature (573)..(575): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccagggaccctggtccaccgtctcctcacgccctccaccgaacggggcccagttccggtcctttcccccgtggcccaccctcctacccaacgacgccacccgttcgtcgggggccacgacgccggcccgtcgggctcggccgtcggtaccgaacggtacctaccttcccgacggtcgactcggacgtggacggccgggcgtcgggacgaacgggcgacagtagnnn

SEQ ID NO: 221738 - DNA, 542 bp, Homo sapiens
  misc_feature: GYAE6OF01ELGMI.38.4.A04.1.454.CMB.1.raw
  modified_base (535)..(535): a, c, t, g, unknown or other
  misc_feature (535)..(535): n is a, c, g, or t
  modified_base (540)..(542): a, c, t, g, unknown or other
  misc_feature (540)..(542): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtccaccgtctcctcagccctccaccgaagggcccatccggtccttcccccctggcccaccctcctccaacgacgccaccctcgtgggggccacgacggccgggccctgggcctggcccgtgggtcaagggacctacgttccacgtgactcgacgtgaggcgggctgggcaagggcncatgnnn

SEQ ID NO: 221739 - DNA, 607 bp, Homo sapiens
  misc_feature: GYAE6OF01BXILO.38.4.A04.1.454.CMB.1.raw
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggagctacgtactttgactacgtggggccacgggaacctggtcaccgtctcctcacgcctccaccgaacgggccctagtccggtccttcccccgtcggcccaccctccctaccaagcgccacccgtccgtcgggggccacgacggcccggcccgtcgggcctcggcccgttcgggtaccgaacggtaccgttaccgttccgaccggttcgtacgtccggtaccgtcggacgggccggggccgttcggggaccgaaacggggtccgacgtaagttacggngngcg

SEQ ID NO: 221740 - DNA, 637 bp, Homo sapiens
  misc_feature: GYAE6OF01BSNCO.38.4.A04.1.454.CMB.1.raw
  modified_base (392)..(392): a, c, t, g, unknown or other
  misc_feature (392)..(392): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaaatactatgtggactctgtgaagggccgattcgccatctccagagacaacgccaagaactcactgtggctgcacatcggaacggcctggaggacggcgaacggacacgggctgtgtacttcgtgtgcgagaccgcccccatggacgggtctacgaggtgggagctaacgtntttacggacttacggtcggggaccgacgggtaacccgttggtccgaccgtcctccctcgacgccctaccgaccgaacgggcccacgttccggtccctttcccccgcggtccctacccctccctaccaacgacgtccgacccgttcgggtcggggaccaccggacggcccggtcccgtcgggtccgtcggcccgtgggtaccgaaacggtaccttaccgttccgacgttacgcgtccgcgtacggg

SEQ ID NO: 221741 - DNA, 579 bp, Homo sapiens
  misc_feature: GYAE6OF01DU0OO.38.4.A04.1.454.CMB.1.raw
  modified_base (328)..(328): a, c, t, g, unknown or other
  misc_feature (328)..(328): n is a, c, g, or t
  modified_base (575)..(575): a, c, t, g, unknown or other
  misc_feature (575)..(575): n is a, c, g, or t
  modified_base (577)..(578): a, c, t, g, unknown or other
  misc_feature (577)..(578): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgcccccatggagggctacgaggtggganctacgtactttgactacgtggggccagggaaccctggtccaccgtctcctcacgccctccaccgaacgggcccagtccggttcccttcccccgtggcccaccctccctaccgaacgacgcctacccgtcgtcggggccacgacggccggcccgtgggcctcggccgtggtaccaacggtaccttaccgttccgacgtgactccggacgtggacggcgggcgtcgggaccgaagggtccgacagtagngnng

SEQ ID NO: 221742 - DNA, 573 bp, Homo sapiens
  misc_feature: GYAE6OF01BXYOX.38.4.A04.1.454.CMB.1.raw
  modified_base (325)..(325): a, c, t, g, unknown or other
  misc_feature (325)..(325): n is a, c, g, or t
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaagactcactgtggctgcacatgaacgctgagaggcgacgacacggctgtgtacttctgtgcgagacgcccccagtggagggctacgaggtgggacnctacgactttgactacgtggggccagggaccctggtccaccgtctcctcacgccctccaccgaacgggcccacgtccggtcccttcccccgtcggccctacccctccctaccgaacgacgccacccgtcgtcggggccacgacggcccggcccgtcgggcctcggccgttcggtaccaacggaccttaccgttcccgacgtcgacgtcgacgtggacggcgggcgtcggacacgggcgacgatgnngn

SEQ ID NO: 221743 - DNA, 590 bp, Homo sapiens
  misc_feature: GYAE6OF01BZY8L.38.4.A04.1.454.CMB.1.raw
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgagtgggagctacgactttgactacgtggggccagggaaccctggtccaccgtctcctcacgccctccaccgaacgggcccacgttccggtcccttccccccgtcggcccacccctccctacccaacgacgccacccgtcgtcgggggccacgacggcccggcccgtgggcctcggcccgtcgggtccgaacgggtaccttaccgttcccgacggtcgacgtcggacgtcggaggccggggcgtcgggacgacgggcgacagtacgnngn

SEQ ID NO: 221744 - DNA, 534 bp, Homo sapiens
  misc_feature: GYAE6OF01CRQ08.38.4.A04.1.454.CMB.1.raw
  modified_base (327)..(327): a, c, t, g, unknown or other
  misc_feature (327)..(327): n is a, c, g, or t
  modified_base (533)..(534): a, c, t, g, unknown or other
  misc_feature (533)..(534): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacagtggganctacgatttgactacgtggggccagggaaccctggtcaccgtctcctcagccctaccaccgaagggcccatccggtccttcccctcggccaccctcctcccaagacgccaccgttcgcggggcacgagccggcccgtgggcctcgcccgtggacaacggactacttccacgtgactgacctggagcggctggcaagggccacatgnn

SEQ ID NO: 221745 - DNA, 543 bp, Homo sapiens
  misc_feature: GYAE6OF01DMVYP.38.4.A04.1.454.CMB.1.raw
  modified_base (299)..(299): a, c, t, g, unknown or other
  misc_feature (299)..(299): n is a, c, g, or t
  modified_base (451)..(451): a, c, t, g, unknown or other
  misc_feature (451)..(451): n is a, c, g, or t
  modified_base (541)..(543): a, c, t, g, unknown or other
  misc_feature (541)..(543): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtgccagcattaaccaagatggacgtagaaaaatctatgtggactctgtgaagggccattcgccatctccagagacaacgccaaagaactcactgtggctgcacatgaacggcctggagaggcgacgacacggctgtgtacttctgtgcgagngcccccatggagggctaacgagtgggagctagactttgactacgtggggacccagggaccctggtcaccgtctcctcacgcctccgaaccaagggcccaatccggtccttcccccctcggccctaccctcctaccaacgacgccaccgtcgngggggccacgacgccggcccgtggcctcgccgtggtcaaggactacttccacgtgatcgacgtgaggcgggctcggcaaggcgacatagnnn

SEQ ID NO: 221746 - DNA, 525 bp, Homo sapiens
  misc_feature: GYAE6OF01A6AO7.38.4.A04.1.454.CMB.1.raw
  modified_base (324)..(324): a, c, t, g, unknown or other
  misc_feature (324)..(324): n is a, c, g, or t
  modified_base (524)..(525): a, c, t, g, unknown or other
  misc_feature (524)..(525): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactacgtggggccagggaccctggtcaccgtctcctcagccctccaccgaagggcccatccggtccttccccctggcccaccctcctccaagacgccacctcgtggggccacgacgccggccctgggctcgcctggtccaaggcctacttccacgtgactcgactgagcgggctgggcaaggcgcatgnn

SEQ ID NO: 221747 - DNA, 515 bp, Homo sapiens
  misc_feature: GYAE6OF01B2RV0.38.4.A04.1.454.CMB.1.raw
  modified_base (511)..(511): a, c, t, g, unknown or other
  misc_feature (511)..(511): n is a, c, g, or t
  modified_base (513)..(515): a, c, t, g, unknown or other
  misc_feature (513)..(515): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaaggccaaagaactcactgtggctgcacatgaacggcctgagaggcgacgacacggctgtgtacttctgtgcgagagcccccatgagggctacagtgggagctacgactttgactacgtggggccagggaaccctggtcaccgtctcctcagcctccacaacgggcccatcggtcttccccctcggccaccctcctccaagacgcacctcgtggggcacgacgcgccctgggctgcctggtcaaggactacttccacgtgatcgactgagcggcgtggcaagcgcangnnn

SEQ ID NO: 221748 - DNA, 556 bp, Homo sapiens
  misc_feature: GYAE6OF01CWMFN.38.4.A04.1.454.CMB.1.raw
  modified_base (327)..(327): a, c, t, g, unknown or other
  misc_feature (327)..(327): n is a, c, g, or t
  modified_base (554)..(556): a, c, t, g, unknown or other
  misc_feature (554)..(556): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccgagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgagtggganctacgctttgactacgtggggccagggtaaccctggtccaccggtctcctcacgccctccaccgacgggcccatccggtccttcccccgtcggccctaccctcctccaacgacgccaccctcgtcggggccacgacgccggcccgtcgggctcggccgtggtacaacgggtacctacgttccgacgtcgactcgacgtggagcgggcgtggcgaagggcgacatagnnn

SEQ ID NO: 221749 - DNA, 568 bp, Homo sapiens
  misc_feature: GYAE6OF01ETJH9.38.4.A04.1.454.CMB.1.raw
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacgaggtgggagctacgactttgactacgtggggccagggaaccctggtccaccgtctcctcagccctccaccacgggcccactccggtccttccccctcggcccaccctcctaccaacgacgcctacccgtcgtcgggggccacgacggccggcccgtgggcctcggcccgtggtccgaacggtacctaccgttccacgttgactccgacgtggaggcgggcgtgggccgaagggccgacagtagnngn

SEQ ID NO: 221750 - DNA, 798 bp, Homo sapiens
  misc_feature: GYAE6OF01B5ZHG.38.4.A04.1.454.CMB.1.raw
  modified_base (147)..(147): a, c, t, g, unknown or other
  misc_feature (147)..(147): n is a, c, g, or t
  modified_base (795)..(795): a, c, t, g, unknown or other
  misc_feature (795)..(795): n is a, c, g, or t
tcagtcgatcacgtcacgaccggtgctcgatttagagtagtgatcgagggggggtccctgagacctctcctgtgcagcctctgcattcaccgtttagtaactattaatgagcgtcggtccgcagcctcgagggagggctggagtggngcagcataaccagatggacgtagaaaatctagtgtggactcgtgtgaacgggcctattccgccatccaccagacgaccaacgccaaagacctcacgtagtcgctgcaacgagtcgaaccggccgtaggaacggaacggaccgaaccggaaccgtaccggtccgttagttacggttactttccgtaggtcggaccggaacgtacccgacccccgtaggtacggacgggtaccgtaacgagggtacgggtaacgtcgtaaccgtacgtttacgaacgttacgggtacggggacccggtaaccgggaaccccgttcggtacccacccgttcctacccgtacgtaccggcccctacccgaacccggtaaccgggtcccctacgggttcccggttccccccgttacccccggtcggtacccccttacccccgttacctaaccccgtaaggtaccctccccgtaaccggtcccgggtaccgggaacctacccggaaccggtccccgggtcccggttcgggtacccgtccggtcccggttaccgggtaaccgaaccggttaacccgttaccgtacccgacggttacgaccgttaccggaccggtcggaccgggccgggtccgtacgggaccgtaacgggccgtactaacgtcgcngtg

SEQ ID NO: 221751 - DNA, 562 bp, Homo sapiens
  misc_feature: GYAE6OF01EBPMQ.38.4.A04.1.454.CMB.1.raw
  modified_base (559)..(560): a, c, t, g, unknown or other
  misc_feature (559)..(560): n is a, c, g, or t
  modified_base (562)..(562): a, c, t, g, unknown or other
  misc_feature (562)..(562): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtgggagctacgactttgactacgtggggccagggaccctggtccaccgtctcctcagcctccacaacggcccatccgtcttccccctggcccaccctcctaccaagacgccacctcgtcggggccacgacgccggccctgggcctcggcccgtgggtaccaacgggtaccttaccgttcccgaacggtgactccggaacgtggacggccgggcgtcgggacgaacgggccgacagtagnngn

SEQ ID NO: 221752 - DNA, 539 bp, Homo sapiens
  misc_feature: GYAE6OF01EKRVT.38.4.A04.1.454.CMB.1.raw
  modified_base (538)..(539): a, c, t, g, unknown or other
  misc_feature (538)..(539): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtactttctgtgcgagacgcccccactgagggctacaggtgggagctacgactttgactacgtgggggccaggggaaccctggtcaccgtctcctcacgccctccaccgaagggcccatccggtccttcccccgtcggccacccctcctccaagacgccacctcgtggggcacgacgcggccctgggctcgccgtggtccaaggactaccttccgacgtgactcgacgtggagcgggctggcgaacggcgcatgnn

SEQ ID NO: 221753 - DNA, 668 bp, Homo sapiens
  misc_feature: GYAE6OF01CQLXE.38.4.A04.1.454.CMB.1.raw
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggagtgggtggccagcaattaaccaagatggacgtagaaaaaatactatgtggactctggtaggaagggccgattcgccatctccagagacaacgccaaagaactcactgtgctgcacatggaacgctgagaggcgacgacacggctgtgtacttcgtgtgcgagaccgcccccagtggacggctaacgaggtcgggagtacgtacgtactttggaaccgtacggtcggggaccaacggggtaaccctgggtccaccgtctccgtacgacgccctaccgaaccgaacgggcccctagtcccggttccccttcccccgtcggacccctacccctacccgtaccgaaacggaccgccctaacccgtcgggtacggggaccaaccgacggccccgggtcccgtggggccgtcggtaccccgtgggtaaccgaaaccgggtaccttacccgttcccggacgttcgaaaccgttccggaacgtcgggacgggtccgggtcgtcgggaacgaacgggccacaagtacggngn

SEQ ID NO: 221754 - DNA, 607 bp, Homo sapiens
  misc_feature: GYAE6OF01B0AZB.38.4.A04.1.454.CMB.1.raw
  modified_base (327)..(327): a, c, t, g, unknown or other
  misc_feature (327)..(327): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccgattcgccatctccagagacaacgccaagaactcactgtgctgcacatgaacggcctgagaggcgacgacacggctgtgtacttctgtgcgagacgcccccatggaggctacgaggtggganctacgactttgactacgtggggccagggaaccctggtcaccgtctcctcacgccctccaaccgaacggcccacgtccggtccttcccccgtggccctaccctccctaccaacgacgccctaccgtcgtcgggggccaccgcggacccgggcccgtcgggcctcgcccgttcggtaccgaaacgggtaccttaccgttacccgaacggtcggtacgtccggtaacgtcgggaacgggccggggtccgtacgggacgaaacgggccgaccgaagtcgngngn

SEQ ID NO: 221755 - DNA, 575 bp, Homo sapiens
  misc_feature: GYAE6OF01ADQBV.38.4.A04.1.454.CMB.1.raw
  modified_base (318)..(318): a, c, t, g, unknown or other
  misc_feature (318)..(318): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagactcactgtggctgcacatgaacggctgagaggcgacgacacggctgtgtacttctgtgcgagacgcccccatggacgggctacgnggtgggagctacgtactttgactcgtgggccaggacctggcaccgtctcctcacgtcctccgaaccgacggcccacgtccgtccttccccgtcgccctaccctccctaccaacgacgcctaccgtccgtcggggccacgacgccggcccgtcgggccgtcgccgtcggtaccgaacggtaccttaccgtccgtacgtcgtacgtccggtacgtcggacggcgggtcgtcggaccgaacggccgacgagtcgngngcg

SEQ ID NO: 221756 - DNA, 532 bp, Homo sapiens
  misc_feature: GYAE6OF01AOURS.38.4.A04.1.454.CMB.1.raw
  modified_base (514)..(514): a, c, t, g, unknown or other
  misc_feature (514)..(514): n is a, c, g, or t
  modified_base (530)..(532): a, c, t, g, unknown or other
  misc_feature (530)..(532): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactacgtggggcccaggggaacccctggtcaccgtctccctcagcctccaccaagggcccatccggtcttccccctggccaccctcctccaagacgccaccctcgtcgggggccacgacgccgggccctgggcctggcctggtcaaggctacttccacgtgactcgacgtgaggcgggcngggcacggcgcatagnnn

SEQ ID NO: 221757 - DNA, 516 bp, Homo sapiens
  misc_feature: GYAE6OF01EH10J.38.4.A04.1.454.CMB.1.raw
  modified_base (513)..(514): a, c, t, g, unknown or other
  misc_feature (513)..(514): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccagggaagggctggagtgggtgccagcattaaccaagatggacgtgaaaaatctatgtggactctgtgaagggccattcgccatctccagagacaacgccaagaactcactgtggctgcacatgaacggcctgagaggcgacgacacggctgtgtactttctgtgcgagcgcccccagtgagggctacagtgggagctacgactttgactacgtggggccagggaaccctgggtccaccgtctcctcagcctccaccagggcccatcggtctccccgtgcacctcctcagacgcacctctggggcacgacgcggccctgggctcggcctggtacaaggactacgttccagtgactcgacgtgaggcggctggcaaggcgacatagnngc

SEQ ID NO: 221758 - DNA, 577 bp, Homo sapiens
  misc_feature: GYAE6OF01AO28K.38.4.A04.1.454.CMB.1.raw
  modified_base (572)..(572): a, c, t, g, unknown or other
  misc_feature (572)..(572): n is a, c, g, or t
  modified_base (575)..(576): a, c, t, g, unknown or other
  misc_feature (575)..(576): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgccccatgagggctacagtgggagctacgactttgactacgtggggcagggaccctggtcaccgtctcctcacgccctccaccgaacgggcccagtccggtccttccccccgtcggccctaccctcctaccaacgacgcccaccgtcgtcgggggccaccgaggcccggcccgtcggggcctcggcccttgggtaccaacgggtaacctaccgttcccgacgtcgtacgtcggacgtcggacggcgggcgtcgggcgaaacgggccgacanggnnc

SEQ ID NO: 221759 - DNA, 578 bp, Homo sapiens
  misc_feature: GYAE6OF01DIBWM.38.4.A04.1.454.CMB.1.raw
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaaggccgattcgccatctcagagacaacgccaagaactcactgtggctgcacatgaacggcctggagaggcgacgacacggctgtgtacttctgtgcgagacgcccccatggagggctacaggtgggagctacgactttgactacgtggggacccagggaaccctggtccaccgtctcccgtcacgccctccgaaccgacgggccctacgtccggtccctttccccccgtcggtccctacccctacctacccaacgacgcctacccgtccgtcgggggccacgacggccgggcccgtcgggcctcggcctggtccaacggtaccttacgttccaccgtgactccggacgtggaggcgggctgggcaagggcgacatagnngn

SEQ ID NO: 221760 - DNA, 582 bp, Homo sapiens
  misc_feature: GYAE6OF01DNGF7.38.4.A04.1.454.CMB.1.raw
  modified_base (327)..(327): a, c, t, g, unknown or other
  misc_feature (327)..(327): n is a, c, g, or t
  modified_base (580)..(582): a, c, t, g, unknown or other
  misc_feature (580)..(582): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcattaaccaagatggacgtagaaaaatactatgtggactctgtgaaggccattcgcatctcagagacaacgccaagactcactgtggctgcacatgaacgcctgagaggcgacgacacggctgtgtacttctgtgcgagacgcccccagtggacggctacgaggtgggacncgtacgtactttgactacgtcggggccagggaaccctggtccaccgtctcctcgacgccctaccaaccgaacgggcccacgtccggttcccttcccccgtggccctaacccctcctaccgaaagacgccaccgtcggtcggggccacgaggcccggcccgtgggcctcggcccgttggtaccgaaaggtaccttaccgttcccgacgtgactcggacgtgggaggccgggcgtcgggacaaggtcgacagtgnnn

SEQ ID NO: 221761 - DNA, 532 bp, Homo sapiens
  misc_feature: GYAE6OF01CKYYI.38.4.A04.1.454.CMB.1.raw
  modified_base (412)..(412): a, c, t, g, unknown or other
  misc_feature (412)..(412): n is a, c, g, or t
  modified_base (529)..(530): a, c, t, g, unknown or other
  misc_feature (529)..(530): n is a, c, g, or t
  modified_base (532)..(532): a, c, t, g, unknown or other
  misc_feature (532)..(532): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacgaggtgggagctacgactttgactacgtggggccagggaaccctggtccaccgtctcctcagcctccaccaagggcccatccggtcttcccccncggccaccctcctaccaacgacgccacctcgtggggcacgacgccggccgtgggctgcctggcaagctactccgacgtgactcgactggagcgggctgggacgacggcgacagtagnngn

SEQ ID NO: 221762 - DNA, 583 bp, Homo sapiens
  misc_feature: GYAE6OF01CSIE6.38.4.A04.1.454.CMB.1.raw
  modified_base (256)..(256): a, c, t, g, unknown or other
  misc_feature (256)..(256): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (559)..(559): a, c, t, g, unknown or other
  misc_feature (559)..(559): n is a, c, g, or t
  modified_base (579)..(580): a, c, t, g, unknown or other
  misc_feature (579)..(580): n is a, c, g, or t
  modified_base (582)..(582): a, c, t, g, unknown or other
  misc_feature (582)..(582): n is a, c, g, or t
tcagtcgatcacgtcacgaccggtgctcgatttagagtagtgatcaggggggggtccctgagactctcctgtgcaggcctctgcattcgacctttaggtaacttatttaatgagtcctgggtcccgccagcctccgaggggaaggggctgggaggtgggtcggccagcacttaaccaagatggacgtgaaaaactctatgtggactctggtgaagggccgattcgcatctccagagacacgccaagaactcactgnggctgacacatgaacggctgagaggcgacgacgacggactcgtagtacttctgtgtcgagacgccccatggaggctacnggtggganctacgtactttgactacgtcggggaccaagggtacctggtccaccgtctcctcacgccctacaccgacgggcccacgtccggtccgttcccctggaccctaccctctaccgaagacgactaccgtcgtcggggcacgcgccggccgtgggcctcggccgtggtacgaacggtacctacgttaccgtcggtgacgtcggacgtggacggcgggtcgngggacacggcgacagtacgnngng

SEQ ID NO: 221763 - DNA, 549 bp, Homo sapiens
  misc_feature: GYAE6OF01CRGLR.38.4.A04.1.454.CMB.1.raw
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacaggtgggagctacgactttgactacgtggggccagggaaccctggtcaccgtctcctcacgccctccaccgaagggcccagtccggtccttccccccgtggccctaccctccctaccaacgacgccacctccgtcggggcacgacgccggcccgtgggcctcgcccgtggtcaacggacctacttccgacgtgactcgactgaggcgggcgtggcgaaggcacatagnngn

SEQ ID NO: 221764 - DNA, 599 bp, Homo sapiens
  misc_feature: GYAE6OF01CTKFI.38.4.A04.1.454.CMB.1.raw
  modified_base (326)..(326): a, c, t, g, unknown or other
  misc_feature (326)..(326): n is a, c, g, or t
  modified_base (596)..(597): a, c, t, g, unknown or other
  misc_feature (596)..(597): n is a, c, g, or t
  modified_base (599)..(599): a, c, t, g, unknown or other
  misc_feature (599)..(599): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgcccccatggagggctacgagtggganctacgactttgactacgtggggccaggaaccctggtcaccgtctcctcacgccctccaccgaacgggcccatccggtccttcccccctggccctacccctccctaccaacgacgccacccgtcgtcggggccacgacggcccggcccgtcggggcctcggcccgttgggtaccgaacgggtacccttaccgttacccgaccggttcgacgtccggacgtcggacggccggggtccgtagggaccgtaaacgggccggacgtaagtacggnngn

SEQ ID NO: 221765 - DNA, 571 bp, Homo sapiens
  misc_feature: GYAE6OF01DMP9U.38.4.A04.1.454.CMB.1.raw
  modified_base (570)..(571): a, c, t, g, unknown or other
  misc_feature (570)..(571): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctcagggagggctggagtgggtgccagcattaaccaagatggacgtagaaaaatactatgtggactctgtgaagggccattcgccatctccagagacaacgccaagaactcactgtggctgcacatgaacggcctgagaggcgacgacacggctgtgtacttctgtgcgagacgcccccagtggagggctacgaggtgggagcctacgtactttgactacgtggggaccagggaaccctggtccaccgtctcctcacgccctccaaccgaacgggcccagtcccggtccttcccccgtggcccacccctcctccaacgacgccaccctcgtcggggccacgacgccgggcccgtgggcctggtccgtggtcgaaacggaccttaccgttccgaccgtgactccggacgtcggaggccggggctcgggacgaagggccgacaatacggnn

SEQ ID NO: 221766 - DNA, 590 bp, Homo sapiens
  misc_feature: GYAE6OF01DMS2K.38.4.A04.1.454.CMB.1.raw
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaggggctggagtgggtggccagcattaaccaagatggacgtagaaaaatactatgtggactctgtgaagggccgattcgccatcctccagagacaacgccaaagaactcactgtggctgcacatgaacggcctgagaggcgacgacacggctgtgtacttctgtgcgagacgcccccagtggagggctacaggtgggagctacgtactttgactacgtggggccagggaaccctggtccaccgtctcctcacgccctccaccgacgggcccagtcccggtccttcccccgtcggccctacccctcctaccgaacgacgcctacccgtcggtacgggggaccacgacggccggcccgtcgggcctcgccgtggtacgaacggtacctaccgttcccgacggtcgacgttcggacgtggacggtcgggtcgtcggcgaacgggccgacgtatacggngngn

SEQ ID NO: 221767 - DNA, 548 bp, Homo sapiens
  misc_feature: GYAE6OF01BFLNB.38.4.A04.1.454.CMB.1.raw
  modified_base (541)..(541): a, c, t, g, unknown or other
  misc_feature (541)..(541): n is a, c, g, or t
  modified_base (546)..(548): a, c, t, g, unknown or other
  misc_feature (546)..(548): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggagctacgactttgactacgtggggccagggaaccctggtcaccgtctcctcacgccctcccaccgaacgggccccagtccggtcctttccccctggcccaccctcctccgaagacgccacctcgtcggggccacgagccggccctgggcctcggcccgtgggtccaacggacctaccttccgacgtgactcggactggaggcgggcctgggcaagggcncatgnnn

SEQ ID NO: 221768 - DNA, 574 bp, Homo sapiens
  misc_feature: GYAE6OF01BIT3T.38.4.A04.1.454.CMB.1.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaaatctatgtggactctgtgaagggccattcgccatctccagagacaacgccaagaactcactgtggctgcacatgaacggcctggagaggcgacgacacggctggtgtacttctgtgcgagacgcccccagtgagggctacgngtggganctacgtctttgactacgtgggccgagggaaccctggtccaccgtctcctcacgcctccaccgaacggcccactccggtcccttccccgtcgccctaccctccctaccaacgacgccaccgtcgtcggggccacgacggccggcccgtgggcctcggccgtggtccgaacggtacctaccttccgacgtgacgtcgcgtacggg

SEQ ID NO: 221769 - DNA, 590 bp, Homo sapiens
  misc_feature: GYAE6OF01DC5R3.38.4.A04.1.454.CMB.1.raw
  modified_base (331)..(331): a, c, t, g, unknown or other
  misc_feature (331)..(331): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
tcagtcgatcacgtcacgaccggtgctcgatttagagtagtgatcagggggggtccctgagactctcctgtgcagcctctgcaattcacctttagtaactatttaatgagctgggtcccgccagcctccagggaaggggctggagtgggtggccagcattaaccaagatggacgtagaaaaatctatgtggactctgtgaagggccattcgccatctccagagacaacgccaagactcactgtggctgcacatgaacggcctgagaggcgacgacacggctgtgtactttcgtgtgcgagacgcccccagtggagggctacgaggtggganctacgactttgactacgtcggggaccagggaaccctggtccaccgtctcctcacgccctccaaccgaacgggcccacgtccggtccttcccccgtcggccctaccctcctaccaacgacgccaccgtcgtcggggccacgacggccggcccgtgggcctcggccgtggtaccaacggtaccttaccgttacccgacggttcgacgtccggacgtcggacgggccgggcgtcgggacgtaacgggccgacagtacgngnn

SEQ ID NO: 221770 - DNA, 616 bp, Homo sapiens
  misc_feature: GYAE6OF01EXQNW.38.4.A04.1.454.CMB.1.raw
  modified_base (329)..(329): a, c, t, g, unknown or other
  misc_feature (329)..(329): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacaggtggganctacgactttgactacgtggggccagggaaccctggtccaccgtctcctcacgccctaccgaccgaacgggccctagtcccgggttcccttccccccgtgggccctaaccccttccctacccgaaacgacgtccacccgtcggtcgggggccacgacggccgggccccgtggggccttcgggcccgttgggtaccgaaacgggtacccttaccgtttccccgaaggttcgacgtccgacgtggaggccggggctcgggaccgaacgggccgtacaagttacggnngn

SEQ ID NO: 221771 - DNA, 658 bp, Homo sapiens
  misc_feature: GYAE6OF01A0SEA.38.4.A04.1.454.CMB.1.raw
  modified_base (654)..(654): a, c, t, g, unknown or other
  misc_feature (654)..(654): n is a, c, g, or t
tcagtcgatcacgtcacgaccggtgctcgatttagagtagtgatcagggggggtccctgacgtactcttccgtgtgctagcctctgcattccaccgtttagtaactatttaactgagctgggtccgccaggccttccagggtaaggggctggagtgggtggccagcattaaccaagatggacgtagaaaaatacttagtgtggactcttggttcgaagggtccatttcgaccagtctccagagacaacgccaaagaactcgacgtgtggcgtgcacgatgaacggcgtggagaggcgacgacacggctgtgtacttcgtgtgcgagacgccccgagtggacgggtctacgaggtgggagtcgtaacgtacgttttcgacttacggtcggggcccgaacgggaaccgtgggtcgtaccggtcgtccgtcgtacgtcctacaccgtacgggtcccacgtccggttccgtacccccgttaggaccctacccgtcctacccgaacgacgtccgaccgtcggtcggggtacacgcgccggcccgtcgggcctcggtcccgttcggtaccgaacggtacctaccgttaccgtacgtcgtaacgtccgaacgtcggacggaccgggtcgtacgggacgacgggtccggacgacgtacggcngtcg

SEQ ID NO: 221772 - DNA, 595 bp, Homo sapiens
  misc_feature: GYAE6OF01D0X4U.38.4.A04.1.454.CMB.1.raw
  modified_base (592)..(593): a, c, t, g, unknown or other
  misc_feature (592)..(593): n is a, c, g, or t
  modified_base (595)..(595): a, c, t, g, unknown or other
  misc_feature (595)..(595): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggagtgggtggccagcattaaccaagatggacgtagaaaaatactatgtggactctgtgaagggccgattcgccatctccagagacaacgccaaagaactcactgtggctgcacatgaacggcctgagaggcgacgacacggctgtgtactttctgtgcgagacgcccccatggagggctacgaggtgggagctacgtactttgactacgtcggggccacgggaaccctggtaccaccgtctcctcacgccctcccaaccgaacgggcccacgttccggtccctttcccccgtcggccctacccctccctaccgaacgacgcctacccgtcgtcgggggcacgacggccgggtcccgtggggcctcggtccgtgggtaccaacgggtacctaccgttccgacgtgacgtcggacgtcggaggcgggtcgtcgggcgaaggcgacagtagnngn

SEQ ID NO: 221773 - DNA, 550 bp, Homo sapiens
  misc_feature: GYAE6OF01CB8C0.38.4.A04.1.454.CMB.1.raw
  modified_base (330)..(330): a, c, t, g, unknown or other
  misc_feature (330)..(330): n is a, c, g, or t
  modified_base (548)..(550): a, c, t, g, unknown or other
  misc_feature (548)..(550): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatctatgtggactctgtgaaggccattcgccatctccagagacaacgccaaagaactcactgtggctgcacatgaacggcctgagaggcgacgacacggctgtgtacttctgtgcgagacgcccccatgagggctacagtggagctaacgntttgactagtggggacaacgggaaccctggtaccaccgtctcctcacgccctccaaccgaacgggcccagtccggtcctttccccccgtggcccaccctccctaccaagacgccaccctcgtggggccacgagccggcccgtgggcctcgccgtggtaccaaggccttactccacgtcgatccgacgtgagcgggcgtcggacgacggtcgacatagnnn

SEQ ID NO: 221774 - DNA, 542 bp, Homo sapiens
  misc_feature: GYAE6OF01BQ5OW.38.4.A04.1.454.CMB.1.raw
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctggtgcgagacgcccccatgagggctacaggtgggagctacgactttgactacgtggggccagggaaccctggtccaccgtctcctcacgcctccaccagggcccagtccggtccttccccctggcccaccctccctaccaagacgccacccgtcgtcggggccacgacgccggccctgggctcgcctggtcaaggactacttccacgtgactcgactggagcgggtctgggcgaacgggcgacatagnngn

SEQ ID NO: 221775 - DNA, 534 bp, Homo sapiens
  misc_feature: GYAE6OF01BPK6K.38.4.A04.1.454.CMB.1.raw
  modified_base (322)..(322): a, c, t, g, unknown or other
  misc_feature (322)..(322): n is a, c, g, or t
  modified_base (429)..(429): a, c, t, g, unknown or other
  misc_feature (429)..(429): n is a, c, g, or t
  modified_base (532)..(534): a, c, t, g, unknown or other
  misc_feature (532)..(534): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctcagagacaacgccaagaactcactgtggctgcacatgaacggcctgagaggcgacgacacggctgtgtacttctgtgcgagagcccccatgagggctacgagtggganctacgctttgactacgtggggccagggaaccctgggtccaccgtctcctcagccctccaccgagggcccagtccggtccttccccctggccaccctcctccaagacnccacctcgtggggccacgacgccggccctgggcctgccctggtcaacggactacttccgacgtcgatccgacgtgagcgggctcggcaacgggtcgacatcgnnn

SEQ ID NO: 221776 - DNA, 539 bp, Homo sapiens
  misc_feature: GYAE6OF01EE8QN.38.4.A04.1.454.CMB.1.raw
  modified_base (325)..(325): a, c, t, g, unknown or other
  misc_feature (325)..(325): n is a, c, g, or t
  modified_base (537)..(539): a, c, t, g, unknown or other
  misc_feature (537)..(539): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtgctgcacatgaacggcctgagaggcgacgacacggctgtgtacttctgtgcgagacgcccccatgagggctacgagtggganctacgactttgactacgtgggccagggaccctggtcaccgtctcctcagccctccaccgaaggcccagtccggtccttccccctggcccaccctcctaccaagacgccacctcgtggggccacgacgccggcccgtgggcctcggccgtggtaccaacggactaccttccacgtgactcgacgtgaggcgggctggcaacgggcgacatagnnn

SEQ ID NO: 221777 - DNA, 575 bp, Homo sapiens
  misc_feature: GYAE6OF01ERIU8.38.4.A04.1.454.CMB.1.raw
  modified_base (572)..(572): a, c, t, g, unknown or other
  misc_feature (572)..(572): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacagtgggagctacgactttgactacgtggggccacgggaaccctggtccaccgtctcctcacgcctccaccaactcggcccacgtcgtccttccccctggccacccctcctacccaacgacgccacccgtcgtcgggggccacgacggccgggcccgtcggggtcctcggtcccgtcgggtacgaacgggtacctaccgttccgacgtcgagtccgacgtgacggcgggccgtgggacgaacgggtcgacagtgngcg

SEQ ID NO: 221778 - DNA, 621 bp, Homo sapiens
  misc_feature: GYAE6OF01E3LHL.38.4.A04.1.454.CMB.1.raw
  modified_base (334)..(334): a, c, t, g, unknown or other
  misc_feature (334)..(334): n is a, c, g, or t
  modified_base (617)..(617): a, c, t, g, unknown or other
  misc_feature (617)..(617): n is a, c, g, or t
  modified_base (621)..(621): a, c, t, g, unknown or other
  misc_feature (621)..(621): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagcctccgagggaaggggctggagtgggtggccagcattaaccaagatggacgtagaaaaatactatgtggactctgtgaagggccattcgccatctccagagacaacgccaaagaactcactgtggctgcacatgaacggcctgagaggcgacgacacggctgtgtacttctggtgcgagacgcccccagtggacgggctacgaggtggganctacgtactttgaactacgtcggggccaacgggaccctggtccaccgtctccctcacgccctaccaccgacgggccccacgtcccggtcccttcccccgtcggcccacccctcctaccgaacgaccgccgtacccgtcggtcgggggaccacgacggcccggcccgtgggtcctcggcccgttacgggtaccgaacggtaccttaccgtcccgtaacggtcgacgtaccgacgttcggacgggtccgggtccgtcggggaccgaacgggccgacgaagtacgngtgn

SEQ ID NO: 221779 - DNA, 612 bp, Homo sapiens
  misc_feature: GYAE6OF01AMC79.38.4.A04.1.454.CMB.1.raw
  modified_base (607)..(608): a, c, t, g, unknown or other
  misc_feature (607)..(608): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaaagaactcactgtggctgcacatgaacggcctgagaggcgacgacacggctgtgtacttctgtgcgagacgcccccatggagggctacgaggtggggagctacggactttgactacgtcggggccagggaaccctggtccaccggttctccctcacgccctccacccgaacgggcccatccggtccttccccccgtggccctacccctcctacccaagacgccacccgttcgtcgggggccaccgaggcccgggtcccgtggggcccttcggcccgttgggtaccgtaacggtaccttaccgttcccaacggtgacgtccgaccgttcggaaggtccggggtctacgggaccgtaacggggccgacgtaagtacggnngtcg

SEQ ID NO: 221780 - DNA, 550 bp, Homo sapiens
  misc_feature: GYAE6OF01EOCS0.38.4.A04.1.454.CMB.1.raw
  modified_base (374)..(374): a, c, t, g, unknown or other
  misc_feature (374)..(374): n is a, c, g, or t
  modified_base (435)..(435): a, c, t, g, unknown or other
  misc_feature (435)..(435): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgccccatgagggctacagtgggagctacgactttgactacgtggggccacgggaaccctggtcaccgtctccncacgccctccaccgacggcccacgtccgtccttccccgtggcccaccctcctaccaacgcnccaccgtcgcggggcacgcggccggcccgtgggcctcgccgtggtacaaggtacctaccttccgacgtgactcgacgtggaggcgggctcgggacaacgggcgacgagtcgnngn

SEQ ID NO: 221781 - DNA, 603 bp, Homo sapiens
  misc_feature: GYAE6OF01B0L9S.38.4.A04.1.454.CMB.1.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactctgtggaagggccgattcgccatctccagagacaacgccaaagaactcactgtggctgcacatgaacggcctgagaggcgacgacacggctgtgtacttcngtgcgagaccgcccccagtggagggcacgaggtggganctacgtactttgaactacgnggggaccagggaaccctggtcaccgtctcctcacgccctaccgaccgaacggcccatccggtccttcccgacgtcgccctaccctcctaccgaagacgccacccgtcgtcggggacacggacgccgggtccccgtgggtccgtcggtcccgtgggtaccgaacgggtaccctaccgttacccgacggtcgtacgttaccgacgtagggacggtccggggacctggggacgaaacgggcgaacagtagngn

SEQ ID NO: 221782 - DNA, 563 bp, Homo sapiens
  misc_feature: GYAE6OF01CU8ZB.38.4.A04.1.454.CMB.1.raw
  modified_base (417)..(417): a, c, t, g, unknown or other
  misc_feature (417)..(417): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttcgtgtgcgagacgcccccatggagggctacgaggtgggagctacgactttgactacgtggggccagggaccctggtcaccgtctcctcacgccctccaccgacgggcccagtccggtccttcccccgnggcccaccctcctaccacgacgccaccgtcgtcggggccacgacggccggcccgtgggcctcggccgtggtcgaacggtaccttacttccgacggtcgactccggacgtcggaggccgggctgggccgaacggcgacagtagngnn

SEQ ID NO: 221783 - DNA, 567 bp, Homo sapiens
  misc_feature: GYAE6OF01AT69R.38.4.A04.1.454.CMB.1.raw
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacagtgggagctacgactttgactacgtggggccagggaaccctggtcaccgtctcctcagcctccaccaagggcccatccggtccttcccccgtcggcccacccctcctcccaagacgccacctcgtcggggccacgacggccggcccgtggggcctcggcccgtgggtaccgaacgggtaccctaccgttcccgacggtgactccggaccgtggacggcggggctcgggcaagggccgacagtagnngn

SEQ ID NO: 221784 - DNA, 650 bp, Homo sapiens
  misc_feature: GYAE6OF01EW2T8.38.4.A04.1.454.CMB.1.raw
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgttaccnttcgtgtcngcgacgacccgaccccgtaccgtacggacgggtacgtacgtacggtagggacggtaccgtaacgttaccgtttacgtaaccgttacggtaccggggaccggtaaccgggtaacccggtacggtaccgtacccgttccgtccctaccgtaccgtacccgtacccgaacccgaaccggaccgtaccgttcccgttccccgttccccgtccgtcccacctccctcccaacgacgccaccctcgtcggggccgacacgccggcccgtcgggcgtcgccgtcggtcgaacggacgtaccttccacgacgtacgtacgacgtcgacggcgggcgtcggacgaaggacggcgagtag

SEQ ID NO: 221785 - DNA, 559 bp, Homo sapiens
  misc_feature: GYAE6OF01EAB0U.38.4.A04.1.454.CMB.1.raw
  modified_base (262)..(262): a, c, t, g, unknown or other
  misc_feature (262)..(262): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggcccgggggggtccctgagactctcctgtgcagcctntgcattcaccttttagtaacttatttaatgagcgtgggtccgccagccctcgaggggagggctggngtgggtgcagcattaaccagntggacgtagaaaatctatgtagactgtgnggaaggccattcgccatctccagacgaacaacgcaaagactcactgtcggctgcacatggaacgccgtagacggaggcgaacgacgacggcgtgtcgttacttcgtagtcggacggacggaccgaccccccgagtcgggaacgggtcctaacggagggtacggggacgtccggtaaaccgg

SEQ ID NO: 221786 - DNA, 588 bp, Homo sapiens
  misc_feature: GYAE6OF01BGBIV.38.4.A04.1.454.CMB.1.raw
  modified_base (586)..(588): a, c, t, g, unknown or other
  misc_feature (586)..(588): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacgaggtgggagctacgtactttgactacgtggggccacgggaaccctggtccaccgtctcctcacgccctccaaccgacgggccctagtccggtccttcccccgtggcccacccctcctaccaacgacgccaccctcggtcggggaccacgacggcccggtcccgtcgggcctcggcccgttggtaccgaacggaccttaccttcccgacggtgaactcggacgtcggacgggccgggtcgtcgggaccgaacgggtccgacgagtagnnn

SEQ ID NO: 221787 - DNA, 584 bp, Homo sapiens
  misc_feature: GYAE6OF01EI9T7.38.4.A04.1.454.CMB.1.raw
  modified_base (329)..(329): a, c, t, g, unknown or other
  misc_feature (329)..(329): n is a, c, g, or t
  modified_base (582)..(584): a, c, t, g, unknown or other
  misc_feature (582)..(584): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagaccgccccagtgagggctacgaggtggganctacgactttgactacgtcggggccacgggaaccctggtccaccgtctcctcacgccctaccaccgaacgggcccacgtccggtcccttcccccgtcggcccaccctccctaccgaacgacgcctaccctccgtcggggccaccgacggcccgggcccgtcgggccgtcggcccgttggtaccgaaacggtaccttaccgttcccacggtcgacgtcgacgtcggaggcgggcgtcggacgacggcgacatgnnn

SEQ ID NO: 221788 - DNA, 609 bp, Homo sapiens
  misc_feature: GYAE6OF01BPJO0.38.4.A04.1.454.CMB.1.raw
  modified_base (326)..(326): a, c, t, g, unknown or other
  misc_feature (326)..(326): n is a, c, g, or t
  modified_base (606)..(607): a, c, t, g, unknown or other
  misc_feature (606)..(607): n is a, c, g, or t
  modified_base (609)..(609): a, c, t, g, unknown or other
  misc_feature (609)..(609): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatggagggctacaggtggganctacgactttgactacgtggggccaggggaaccctgggtccaccgtctcctcacgccctccaaccgaacgggccccacgttccggtccctttccccccgtcggcccctaccccttccctacccaacgacgccctacccgtccgtcgggggccacgacggcccgggcccgtgggcctcggcccgttgggtaccaaacgggtaccttaccgttcccgacggtcgtacgtccggacgtcggaggccggggtccgtacgggaccgaagggccgacgagtacggnngn

SEQ ID NO: 221789 - DNA, 637 bp, Homo sapiens
  misc_feature: GYAE6OF01A8DS8.38.4.A04.1.454.CMB.1.raw
  modified_base (634)..(635): a, c, t, g, unknown or other
  misc_feature (634)..(635): n is a, c, g, or t
  modified_base (637)..(637): a, c, t, g, unknown or other
  misc_feature (637)..(637): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacaacgccaagactcactgtggctgcacatgaacggcctggagaggcgacgacacggctgtgtacttctgtgcgagcgcccccagtggagggctacgaggtgggagtcgtacgactttgactacgtcggggacccgaacgggaaccctgggtccacccggtctcccgtcacgtccctacccgaaccgaaccgggccctacgttcccggttccctttccccccgtcgggtcccctaccccgtccctacccgaaacgaccgcccgtacccgtccggtcgggggccaccgacggcccggtcccgtcgggcctcggcccgttacgggtaccgaaacggtacccttaccgttcccgtacgtcgtacgtcggaccgtcgggacggccgggcgtcgggacgaacgggccgacgagtaggnngn

SEQ ID NO: 221790 - DNA, 545 bp, Homo sapiens
  misc_feature: GYAE6OF01D3X3L.38.4.A04.1.454.CMB.1.raw
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (543)..(545): a, c, t, g, unknown or other
  misc_feature (543)..(545): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccgattcgccatctccagagacaacgcaagaactcactgtgctgcacatgaacggcctagagaggcgacgacgacgctgtgtacttcgtgtgcgagaccgcccctagtggaggctacaggtgggacgctacgtactttgacctacggtggggacctacgggaaccctggtccaccgttcgtcctcacgtcctaccgaccgacggccacgtccgtcctccccgngccaccctccncaagcgcctaccgtcgtcgggcacgcggcgccgtggctcgctggacaacggcctactccgagtcgactcgacgtcggaggcggtcgtcggacgacggtcagaatgnnn

SEQ ID NO: 221791 - DNA, 808 bp, Homo sapiens
  misc_feature: GYAE6OF01D45RS.38.4.A04.1.454.CMB.1.raw
  modified_base (110)..(110): a, c, t, g, unknown or other
  misc_feature (110)..(110): n is a, c, g, or t
  modified_base (803)..(803): a, c, t, g, unknown or other
  misc_feature (803)..(803): n is a, c, g, or t
  modified_base (807)..(807): a, c, t, g, unknown or other
  misc_feature (807)..(807): n is a, c, g, or t
tcagtcgatcacgtcacgaccggtgctcgatttagagtagtgatcaggggggtcccgtggagacgtctaccgtgtgcagcctctgcattcacctttagtaactatttaangagctgggtccgccagcctccagggaggggctggagtgggtgccagcaattaaccaagatggacgtagaaaaatctatgtggactctgtgaagggccattcgccatctcagacgacaacgccaaagaactcactgtggctgcacatgaacgctaggagaggcgaacgacacggcttgtcgttactttcgtggtcgcgaacggaccgccccccaagtggaacggggtccttaacgaggtcggggaactccgtttaaccggtactttttcggaaacctttaccgggtacggggggacccctaaacgggggtaacccccttggggtttacccaaccccggtttcccttccctaccgtaaccggtccccttaaccccggaacccggtaaaccggggccccctaacgttccccgggtttccctttcccccccgtcgggtaccccctaccccgttccctacccgaaacggtaccgaccctacccgtccgggtacgggggcccaacggtacgggcccgggcccggttcggggcccgttccgggtacccgttacgggtaaccgtaaacggttacccgtttaacccgttacccgtaacggtttacgaccggtttaaccgaccggttacgggaccgggtccgggggtccgttaccgggggaacccgaaaacgggggcccggttaaccgtaaaggttaaccggngtgng

SEQ ID NO: 221792 - DNA, 778 bp, Homo sapiens
  misc_feature: GYAE6OF01D3NEB.38.4.A04.1.454.CMB.1.raw
  modified_base (773)..(773): a, c, t, g, unknown or other
  misc_feature (773)..(773): n is a, c, g, or t
  modified_base (775)..(776): a, c, t, g, unknown or other
  misc_feature (775)..(776): n is a, c, g, or t
  modified_base (778)..(778): a, c, t, g, unknown or other
  misc_feature (778)..(778): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaaagaaccctcacgtggtcgctcgaccacgtagtacggaaccggtccgtaggaggacggacgaaccgacgacggtcttggttacgttacctttcgtggtacggacggacggaccccgaccccctaggtgggacgggtactaacggtagggtagggacgtaccgtaacggtttacgtttacgaaccgttacggggtaccggggaccggaaacccggggtacccgttcggtaccccgtacccgttcccttcccgtacgacccgtacccctacccgaaaccgggacccggacccttaccgggttccccggtttccccccttcccccggtacggtacccccccttacccccgtaccctaaaccggaacggtcccgtaccccgttacccggttcggggtcgggaccctaaccggccgggcccccggtccgggtcgggtaccgtccgtaccgggttacggtaaccggaaccggttacctttacccgtaccgtacggtagtaccgtacgacggtagggaccgggcggtcgacggagaacgggtccatagngnngn

SEQ ID NO: 221793 - DNA, 565 bp, Homo sapiens
  misc_feature: GYAE6OF01B74YM.38.4.A04.1.454.CMB.1.raw
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggagctacgactttgactacgtggggccacgggaaccctggtccaccgtctcctcacgccctccaccgaacgggcccacgtccggtccttcccccgtcggcccacccgtcctccaagcgccaccctcggtcggggcacgacggccggcccgtgggcctcggccgtcgggtacaacggtccttacgttccacggtgacgtcgacgtggacggcgggctgggacgaggccgacgatagngnn

SEQ ID NO: 221794 - DNA, 607 bp, Homo sapiens
  misc_feature: GYAE6OF01CQ9GD.38.4.A04.1.454.CMB.1.raw
  modified_base (327)..(327): a, c, t, g, unknown or other
  misc_feature (327)..(327): n is a, c, g, or t
  modified_base (419)..(419): a, c, t, g, unknown or other
  misc_feature (419)..(419): n is a, c, g, or t
  modified_base (603)..(603): a, c, t, g, unknown or other
  misc_feature (603)..(603): n is a, c, g, or t
  modified_base (607)..(607): a, c, t, g, unknown or other
  misc_feature (607)..(607): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgccccccatggagggctacgaggtggganctacgtactttgactacgtggggccagggaaccctggtccaccgtctcctcacgccctccaccgagggcccacgttccggtccttcccccgnggccctacccctcctacccaagacgccctacccgtccggcggggccaacgacggcccgggcccgtgggcctcggcccgttcgggtaccgaaacgggtaccttaccgttcccgaacggttcgaacgttccggaacgttcgggacggcccggggtctacgggacgaaacgggccgaacagtacggntcgn

SEQ ID NO: 221795 - DNA, 553 bp, Homo sapiens
  misc_feature: GYAE6OF01E0EOR.38.4.A04.1.454.CMB.1.raw
  modified_base (328)..(328): a, c, t, g, unknown or other
  misc_feature (328)..(328): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(553): a, c, t, g, unknown or other
  misc_feature (551)..(553): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaagaactcactgtggctgcacatgaacggcctgagaggcgacgacacggctgtgtacttctgtgcgagacgcccccatggagggctacgaggtggganctacgactttgactacgtggggccagggaccctggtcaccgtctcctcacgccctccaccgaacgggcccagtccggtccttcccccgtggcccacccctcctaccaacgcgccacccgtcgtcggggccacgacggccgggcccgtgggcctcgcccgtggtaccaacggacctaccttccgacgtgactcgacgtggaggcgggctggcaaggcganangnnn

SEQ ID NO: 221796 - DNA, 523 bp, Homo sapiens
  misc_feature: GYAE6OF01A0081.38.4.A04.1.454.CMB.1.raw
  modified_base (522)..(523): a, c, t, g, unknown or other
  misc_feature (522)..(523): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacagtgggagctacgactttgactacgtggggccagggaaccctggtcaccgtctcctcagcctccaccaagggcccatccggtcttccccctggccaccctcctccaagacgcacctcgtgggggccacgagccggcccgtgggctcgcctggtcaaggactacttccacgtgatcgactggagcgggctggcaaggcgcatagnn

SEQ ID NO: 221797 - DNA, 573 bp, Homo sapiens
  misc_feature: GYAE6OF01DAMEY.38.4.A04.1.454.CMB.1.raw
  modified_base (572)..(573): a, c, t, g, unknown or other
  misc_feature (572)..(573): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaaccaagatggaacgtagaaaaaatactatgtggactctgtgaagggccgattcgccatctccagagacaacgccaaagaactcactgtggctgcacatgaacggcctgagaggcgacgacacggctgtgtacttctgtgcgagacgcccccatgaggctacagtgggagctacgactttgactacgtggggccagggaaccctggtccaccgtctcctcgagccctaccaaccgaacggggccccagttccggtcccttccccccgtggccctacccctccctacccaaagacgccaacccgtcggtggggaccacgaggccggcccgtgggcctcggccgttggtacaaacggtacctacttcccagtgactcgacgtgaggcgggctggacgaacggcgacagtacgnn

SEQ ID NO: 221798 - DNA, 579 bp, Homo sapiens
  misc_feature: GYAE6OF01D9PQR.38.4.A04.1.454.CMB.1.raw
  modified_base (327)..(327): a, c, t, g, unknown or other
  misc_feature (327)..(327): n is a, c, g, or t
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtactttctggtgcgagacgcccccatgagggctacgagtggganctacgactttgactacgtggggccaagggaccctggtcaccggtctccctcacgccctccaccgaacgggccccagtccggtccttccccccgtggcccaccctcctaccaacgcgccaccctcgtcgggggccacgacggccggcccgtggggcctggcccgtggttaccgaacgggtacctacgttcccgacgttcgactccggaacgttggacggccgggctcgggaccaagggtcgacagtacgnngn

SEQ ID NO: 221799 - DNA, 545 bp, Homo sapiens
  misc_feature: GYAE6OF01B0XOZ.38.4.A04.1.454.CMB.1.raw
  modified_base (539)..(539): a, c, t, g, unknown or other
  misc_feature (539)..(539): n is a, c, g, or t
  modified_base (543)..(545): a, c, t, g, unknown or other
  misc_feature (543)..(545): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgagtgggagctacgactttgactacgtggggccagggaccctggtccaccgtctcctcagccctccaccgaacgggcccagttcccggtccttccccccgtggcccacccctcctccaagcgccacctcgtggggccacgcggccggcccgtgggcctcgccttggccaaggacctacttccgacgtgactcgactggaggcgggctggcaagggccganatgnnn

SEQ ID NO: 221800 - DNA, 681 bp, Homo sapiens
  misc_feature: GYAE6OF01A14MW.38.4.A04.1.454.CMB.1.raw
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcattaaccaagatggacgtgaaaaatctatgtggactctgtgaagggccattcgccatctcagagacaacgccaagaactcactgtggctgcacatgaacggcctagagaggcgacgtacacggtctggtgtacttctggtgcgagccncccccgagtggagggcctaacgnggtagggacgcttaaccgacgtttggaccttacggtcgggggacccaaggggaacccctgggtaccaccggttctacccgtcgaacgtcctacccgacgaaccgggccctaacgtccggttcccttcccccgtggtcccctacccttccctacccgaaacggccgtacccgtaacccgtccggtacgggggacctaaccgacggccccgggtcccggtcgggtcctccggcccgttacgggtaccgtaaacggtacccgttaccgttacccgaacggttccgtaacgttccggtaaccgttcggaacgggtcccggtcgtacgggccgaaacgggtccgacgtatcgggcngn

SEQ ID NO: 221801 - DNA, 652 bp, Homo sapiens
  misc_feature: GYAE6OF01DJWH3.38.4.A04.1.454.CMB.1.raw
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccaggggaaggggctggagtgggtggccagcaattaaccaagatggacgtgaaaaatctatgtggactctgtgaagggccattcgccatctccagagacaacgccaaagaactcactgtggctgcacatgaacggcctgagaggcgacgacacggctgtgtacttctgtgcgagacgcccccatgagggctacgaggtgggagtctacggactttggaacgttacgtgggggacccaacggggaacccctggtacctacccgtcctccctcacgccctacccaccgaacgggccccacgtcccggttccctttccccccgtcgggtcccctaccccgttcccctacccgtaaacggaccgtacctacccgtcgtcggggggacctaccggaccggcccgggccccgtggggccgttcggcccgttcgggttaccgaaaaccgggtccttaacccgttcccaaccggttgaacgtccgcgtacggg

SEQ ID NO: 221802 - DNA, 578 bp, Homo sapiens
  misc_feature: GYAE6OF01AEWWG.38.4.A04.1.454.CMB.1.raw
  modified_base (324)..(324): a, c, t, g, unknown or other
  misc_feature (324)..(324): n is a, c, g, or t
  modified_base (576)..(577): a, c, t, g, unknown or other
  misc_feature (576)..(577): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccatgatggctacaggtggganctacgactttgactacgtggggccagggaccctggtcaccgtctcctcacgccctccaccgacgggcccacgtccgtccttcccccgtcggcctacccctccctcccgaacgacgccacccgtcgtcgggggccacgacggccggccccgtcgggcctcggtccgtcggtacgaacggtaccttaccgttcccgacgttcgacgtccggtacgtggacggccgggcgtcgggacgtaacgggcgacacgtgnng

SEQ ID NO: 221803 - DNA, 566 bp, Homo sapiens
  misc_feature: GYAE6OF01EP1OS.38.4.A04.1.454.CMB.1.raw
  modified_base (320)..(320): a, c, t, g, unknown or other
  misc_feature (320)..(320): n is a, c, g, or t
  modified_base (562)..(563): a, c, t, g, unknown or other
  misc_feature (562)..(563): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccactggagggctanaggtgggagctacgactttgactacgtggggccagggaaccctggtccaccgtctcctcacgcctcccaccgaacgggcccatccggtccttccccctggcccaccctcctccaagcgccacctcggtcggggccacacggccggcccgtgggcctcgcccgtggtaccgaacggtcctacttcccgacgtgacgtccgacgtggaggcggggctggggaccaaagggcccgacagtacggnngcg

SEQ ID NO: 221804 - DNA, 717 bp, Homo sapiens
  misc_feature: GYAE6OF01A8QIY.38.4.A04.1.454.CMB.1.raw
  modified_base (711)..(711): a, c, t, g, unknown or other
  misc_feature (711)..(711): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaagactcactgtggctgcacatgaacggcctgagaggcgacgacacggctgtgtacttctgtgcgagacgcccccagtggaggctacgaggtgggacgtcgtaacggtacttttggaaccgtacggtcgggggacccaacggggtaacccctgggtcccaccgttcctccctccgacgtccctacccgaaccgaacgggcccctacgttcccggttcccttccccccgtcggcccctacccccgttccctaacccgaacggtaccgacccgtacccgtccgggtagggggacccaaccggtacgggcccgggtccccggtcggggtcccgttcggtccccggttacgggtacccgtaaacgggttaccctttacccgttccccggtaacggttcggaccgttacccggtaccggttaccgggacggggtcccggggtccgttaccggggacccgaaacggggtcccgacggtaaccgtacggngtcgcg

SEQ ID NO: 221805 - DNA, 579 bp, Homo sapiens
  misc_feature: GYAE6OF01CXSYE.38.4.A04.1.454.CMB.1.raw
  modified_base (578)..(579): a, c, t, g, unknown or other
  misc_feature (578)..(579): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccgagggaaggggctggagtgggtggccagcaattaaccaagatggacgtagaaaaaatactatgtggactctgtgaagggccgattcgccatctccagagacaacgccaagaactcactgtggctgcacatgaacggcctggagaggcgacgacacggctgtgtacttctgtgcgagacgcccccatggaggctacgaggtgggagcgtaacggtactttcggaactacgtcgggggacccaaggggtaaccctgggtccaccggtctccctcaacgccctaccgaaccgaacgggcccacgttccggtcccttcccccgtcggcccacccctccctaccgaacgacgcctaccgtcgtcggggccacgagccggcccgtgggctcgccgtggtacgaacgacttacgtccacgtgacgtcgacgtgagcggcgtcggcaacggcacgatagnn

SEQ ID NO: 221806 - DNA, 599 bp, Homo sapiens
  misc_feature: GYAE6OF01EG3JY.38.4.A04.1.454.CMB.1.raw
  modified_base (323)..(323): a, c, t, g, unknown or other
  misc_feature (323)..(323): n is a, c, g, or t
  modified_base (595)..(596): a, c, t, g, unknown or other
  misc_feature (595)..(596): n is a, c, g, or t
  modified_base (598)..(598): a, c, t, g, unknown or other
  misc_feature (598)..(598): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactacgtggggccagggaaccctggtccaccgtctcccgtcacgccctccaacccgaacgggcccacgtccggtccttccccccgtcggcccaccccgtcctaccaacgacgccaccctcgtcggggccacgacgccggcccgtgggcctcggcccttgggtaccgtaaacgggtaccttaccgttcccgaacggttcgacgtccggaccgttcggacgggccgggtccgtacgggaccgaaacgggccgacgaagtaggnngng

SEQ ID NO: 221807 - DNA, 542 bp, Homo sapiens
  misc_feature: GYAE6OF01CTTTG.38.4.A04.1.454.CMB.1.raw
  modified_base (329)..(329): a, c, t, g, unknown or other
  misc_feature (329)..(329): n is a, c, g, or t
  modified_base (376)..(376): a, c, t, g, unknown or other
  misc_feature (376)..(376): n is a, c, g, or t
  modified_base (540)..(542): a, c, t, g, unknown or other
  misc_feature (540)..(542): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacaggtggganctacgactttgacttacgtggggccagggaaccctggtcaccgttcncctcagccctccaccgacggcccatcggtccttccccctggccaccctcctaccaagcgccaccgtcgtggggccacgacgccggcccgtgggctcggcccgtggtcgaacggacctacttccacgtgactcgacgtggagcgggctgggcgaaggcgcatggnnn

SEQ ID NO: 221808 - DNA, 619 bp, Homo sapiens
  misc_feature: GYAE6OF01DRQFF.38.4.A04.1.454.CMB.1.raw
  modified_base (325)..(325): a, c, t, g, unknown or other
  misc_feature (325)..(325): n is a, c, g, or t
  modified_base (374)..(374): a, c, t, g, unknown or other
  misc_feature (374)..(374): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccagggaggggctggagtgggtggccagcaattaaccaagatggacgtagaaaaatctatgtggactctgtgaagggccattcgccatctccagagacaacgccaagaactcactgtggctgcacatgaacggcctgagaggcgacgacacggctgtgtactttctgtcgcgagacgccccagtgagggctagagtggganctacgtactttgactacgtgggccagggaccctggtaccaccgtctccncacgccctaccgaccgtacggccctacgtccgttccttcccccgcggtccctacccctcctaccgaacgacgcctaccgtccgtcggggaccacgacggccggtcccgtggggccctcggtcccgtaggtaccgtaaacggtccttaaccgttacccgtacgttacggtaccgtaccgggtaccgtcgggaccgggtaccgggtcgtacggggaccgaacgggcccgtacgaagtacggtgngtn

SEQ ID NO: 221809 - DNA, 532 bp, Homo sapiens
  misc_feature: GYAE6OF01EIAVD.38.4.A04.1.454.CMB.1.raw
  modified_base (384)..(384): a, c, t, g, unknown or other
  misc_feature (384)..(384): n is a, c, g, or t
  modified_base (484)..(484): a, c, t, g, unknown or other
  misc_feature (484)..(484): n is a, c, g, or t
  modified_base (524)..(524): a, c, t, g, unknown or other
  misc_feature (524)..(524): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggagcttggtccgaggccgggggggtccctggagactctcctgtgcagcctctgcattcaccttttagtaactatttaatgagctgggtcccgccagccctccgaggggaaggggctgggaggtgggtggccagcaattaaccaagatggacgtagaaaaatctatgtggactntgtgaagggcctattcgccatcctaccagagacaacgaccaagaactcactgtggctgcacatgaacgctgagagggcagacgacggctgtcgtacttgngtcgcgagaccgcccccagtcgacgggtctacgaggtggngcgtacgg

SEQ ID NO: 221810 - DNA, 569 bp, Homo sapiens
  misc_feature: GYAE6OF01DBRBE.38.4.A04.1.454.CMB.1.raw
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
  modified_base (566)..(567): a, c, t, g, unknown or other
  misc_feature (566)..(567): n is a, c, g, or t
  modified_base (569)..(569): a, c, t, g, unknown or other
  misc_feature (569)..(569): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaagaactcactgtggctgcacatgaacggcctgagaggcgacgacacggctgtgtacttctgtgcgagacgcccccatggagggctacaggtggganctacgactttgactacgtggggccagggaaccctggtccaccggtctccncacgccctccaccgaacgggccctagttcccggtccttcccccgtggcccctaccctccgtccaacgacgccacccgtcgtcgggggccacgcgccggcccgtgggcctcgccgtaggtaccaacggtaccttaccgttccgacgtcgactccggacgtggaggcgggctggcgaacgggtcacatagnngn

SEQ ID NO: 221811 - DNA, 602 bp, Homo sapiens
  misc_feature: GYAE6OF01BIA0M.38.4.A04.1.454.CMB.1.raw
  modified_base (289)..(289): a, c, t, g, unknown or other
  misc_feature (289)..(289): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccattcgccatctccagagacaacgccaagaactcactgtgctgcacatgaacgcctgagaggcgacgacacggctgtgtacttntgtgcgagaccgcccccatggacggctacgaggtgggagtcgtacgtactttgacttacgtcggggaccgacgggaaccctcggtaccaccgtctcctcgacgccctcccgaccgacgggcccacgtccggtcccttcccccgtcggccctaccctaccctccgaacgacgccacccgtccgtcggggaccacgacggccggccgtcgggctcggccgtcggtcgaacggtacctaccttccgacgtcgtacgtccgtacgtcgggacggccgggtcgtacgggacgaacgggtaccgcgtaagcggngtncg

SEQ ID NO: 221812 - DNA, 584 bp, Homo sapiens
  misc_feature: GYAE6OF01COV39.38.4.A04.1.454.CMB.1.raw
  modified_base (386)..(386): a, c, t, g, unknown or other
  misc_feature (386)..(386): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctcagagacaacgccaaagaactcactgtggctgcacatgaacggcctggagaggcgacgacacggctgtgtacttctggtgcgagacgcccccagtggagggctacgaggtgggagtacgtacgtactttgactacgtcggggccgaacgggaccctggtccaccgttcncctcacgccctccaccgacgggcccacgttccggtcccttcccccgtggccctaccctcctaccgaacgcgccaccgtcgtcggggcacgacggccggccgtcgggctcggccgtggtaccgaagtaccttacgttccgacgtgacgttcggacttggacggtcgggcgtacgggacgaacggccgacagtacgntgn

SEQ ID NO: 221813 - DNA, 551 bp, Homo sapiens
  misc_feature: GYAE6OF01A2K05.38.4.A04.1.454.CMB.1.raw
  modified_base (416)..(416): a, c, t, g, unknown or other
  misc_feature (416)..(416): n is a, c, g, or t
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaagaactcactgtggctgcacatgaacggcctggagaggcgacgacacggctgtgtacttctgtgcgagacgccccatgagggctacgagtgggagctacgactttgactacgtggggccagggaaccctggtcaccgtctcctcacgcctccaccgacggcccatccggtcctccccgtggcccnccctcctccaacgacgcctacctcgtcggggcacgcgccggcccgtgggcctcggcctcgggtacaacggtccttacgtccacggtcgacgtcgacgtggaggccgggcgtgggccgaagggcgacagtagngnn

SEQ ID NO: 221814 - DNA, 698 bp, Homo sapiens
  misc_feature: GYAE6OF01CLDR5.38.4.A04.1.454.CMB.1.raw
  modified_base (328)..(328): a, c, t, g, unknown or other
  misc_feature (328)..(328): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
  modified_base (697)..(697): a, c, t, g, unknown or other
  misc_feature (697)..(697): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactctgtgaagggccattcgccatctccagagacaacgccaaagaactcactgtggctgcacatgaacggctgagaggcgacgacacggctgtgtacttctgtgcgagacgcccccatggaggctacgagtggganctagtactttgactacgtgggccaggtaaccctggtcaccgtcctcctcacgccctaccgaccgaacgggccctagttcccggttcccttacccccccgtcggacccctacccccgtacccttaacccgaaacggtaccgaccctaacccgtccgggtcgggggacccctaacgaccgggtcccgggtccccggtcggggccgttccggacccgtttcggggtaacccgtaaacgggtaacccgtttaccgtttaccccgtaacgggttacggtaaccgttccggtaaccggttacgggacggggtcccgggggtccgttaccggggtaaccggtaaacggggccgtaacccgtaggtaaccggngngng

SEQ ID NO: 221815 - DNA, 798 bp, Homo sapiens
  misc_feature: GYAE6OF01AJPRN.38.4.A04.1.454.CMB.1.raw
  modified_base (793)..(793): a, c, t, g, unknown or other
  misc_feature (793)..(793): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctggagtgggtggccagcattaaccaagatggacgtagaaaaatactatgtggactctgtgaagggccgattcgccatctccagagacaacgccaagaactcactgtgctgcacatgaacggcctggagaggcgacgacgacggctgtgtacttcgtggtcgcgacgaccgcccccagtgggacgggtcctacgagggtagggacgtccgttacgtaccgtttaggaaccgttacggtcgggggacccgtaacggggtaaccccgttcgggttaccctacccggttcccttcccgtaccgtaaccggtcccccttacccgaacccggaaccggggtccccctaacggtttccccgggtttccccctttacccccccggtccgggtaaccccccttaccccccgttaccccgttaaccccgaaacggtacccgtaccccgttaccccggttccggggtccggggggaccctaacccgggaccgggtccccgggtaccccggttcggggtaccgtccgggtcccgttaccgggtaaccgtaaccggtaacccgttacccgttacccgtacgggtacgttaccggtaccggtaccggtacgggaccggggtaccggggcggttaccggggacggtaacgggccggtacgtaagtcgngtgcg

SEQ ID NO: 221816 - DNA, 588 bp, Homo sapiens
  misc_feature: GYAE6OF01CS4UU.38.4.A04.1.454.CMB.1.raw
  modified_base (180)..(180): a, c, t, g, unknown or other
  misc_feature (180)..(180): n is a, c, g, or t
  modified_base (454)..(454): a, c, t, g, unknown or other
  misc_feature (454)..(454): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcaggggagctctgagagaggtagccttagccctggattccgtaagggcctatccacttggtgatcagcactgagcaccgaggattcaccatggaactggggctccgctgggtttccttgttgctatttagaaggtntcagtgtgagtgcagctggtcggagtcgtgggggagcctggtcaagccgtggggggtccctgacgactcgtccgtggtcgcagcctcgtggattcaccttcagtggctttagcatgaacgtgggtcccgccgaggcctccgagggggaacgggcgtagggacggttgggtctcgactccaagtttagtagtaagtagtagtcaacataatactacgacagactcgagtgaaagggccattccaacatcctacagagacaacgaccaaagacctnaactgtatactgaacaaaagtcggaaacacggcctaggaacgacggacccgaagggacccgaaccggtgtacgttaccttaagttactgggtacgaggaacgggtaaactacctaaagtnttaagtnttaaacg

SEQ ID NO: 221817 - DNA, 653 bp, Homo sapiens
  misc_feature: GYAE6OF01CP9C2.38.4.A04.1.454.CMB.1.raw
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcattaaccaagatggacgtagaaaaatactatgtggactctgtgaagggccgattcgccatctcagagacaacgcaaagactcagtgngctgcanatgaacggctgagaggcgacgacacggctgtcgtacttctgtgcgacgaccgcccccagtggacgggctaacgagggtggggagtcgttaacggtacttttcggaaccgttacggagggggacccaaacgggggaaccccttggtacccgacccggttcctaccgtccgaacgcccctacccgaacccggaaacggggcccctaacgttcccggttccccgttaccccgtcggcccctacccctccctaccgaacgacgaccctaccgtcggtcggggaccacggacggcccggtcccgtgggcctcggccgtacggtacgaacgtacctaccgttccgacgtacgacgttccgacgtggacggtccgggtcgcgggaccgaacgggccgacgaagtgcgngng

SEQ ID NO: 221818 - DNA, 581 bp, Homo sapiens
  misc_feature: GYAE6OF01EQWJ3.38.4.A04.1.454.CMB.1.raw
  modified_base (317)..(317): a, c, t, g, unknown or other
  misc_feature (317)..(317): n is a, c, g, or t
  modified_base (577)..(578): a, c, t, g, unknown or other
  misc_feature (577)..(578): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctcgagagacaacgccaagaactcactgtggctgcacatgaacggcctgagaggcgacgacacggctgtgtacttctgtgcgagcgccccagtgaggctacgnggtgggagctacgtactttgactacgtggggaccaagggacctggtaccaccgtctcctcacgccctccaccgaacggcccattccggtccttcccccgcgcccaccctcctaccaacgcaccaccgtcgcggggcacgacggccggtcccgtcgggcctcggcccgttacggtacgaacggtacttaccgttacccgtaacggttgtaccgtacgcgtcggacggcgggtccgagggacgaacgggcgacgaatacggnngcg

SEQ ID NO: 221819 - DNA, 564 bp, Homo sapiens
  misc_feature: GYAE6OF01D6YM3.38.4.A04.1.454.CMB.1.raw
  modified_base (561)..(562): a, c, t, g, unknown or other
  misc_feature (561)..(562): n is a, c, g, or t
  modified_base (564)..(564): a, c, t, g, unknown or other
  misc_feature (564)..(564): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccgagggaagggggctgggagtgggtggccagcattaaccaagatggacgtagaaaaatctatgtggactctgtgaagggccattcgccatctccagagacaacgccaagaactcactgtggctgcacatgaacggcctgagaggcgacgacacggctgtgtacttctgtgcgagacgcccccagtgagggctacaggtgggagctacgtactttgactacgtggggccagggaccctggtccaccgtctcctcacgccctccaccgaacgggcccagtccgtcccttcccccgtggaccctccctcctccaagcgcctaccgtcgtcggggccacgacggccgcccgtgggtcctcggccgttcggtaccgaaggaccttaccgttccgacgtgactcgacgtgaggtccgggctcgggacaggcgacagtagnngn

SEQ ID NO: 221820 - DNA, 549 bp, Homo sapiens
  misc_feature: GYAE6OF01ENH4T.38.4.A04.1.454.CMB.1.raw
  modified_base (547)..(548): a, c, t, g, unknown or other
  misc_feature (547)..(548): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccagggaaggggctggagtgggtggccagcattaaccaagatggacgtagaaaaatctatgtggactctgtgaagggccattcgccatctcagagacaacgcaagactcactgtggctgcacatgaacggcctgagaggcgacgacacggctgtgtacttctgtgcgagacgcccccactgagggctacagtgggagctacgactttgactacgtggggccagggaaccctggtccaccgtctcctcacgcctccaccaacggcccactcgtccttccccctggcccacccgtcctaccaacgacgccaccctcgtcggggccacgacgccggcccgtgggcctggcccgtggtccaaggacctacttcccgacgtcgatccgacgtcgaggccgggcgtcggcgaacgggccgacatagnnc

SEQ ID NO: 221821 - DNA, 732 bp, Homo sapiens
  misc_feature: GYAE6OF01DOH9G.38.4.A04.1.454.CMB.1.raw
  modified_base (208)..(208): a, c, t, g, unknown or other
  misc_feature (208)..(208): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgngggggaggcgttggtccgagggcccggggggtcctggagctctcctgtgcacgcctctgctagttctacctttaagtaacttatttaagtgagtcgtggtcccgccacgtcccgtcgaaggggaaggggtcgtgggaggtggggtcgccagacaaacgtttaaaccgaaggtagtaaggacgttaaagtaaaaatacgtagtggtaggtacttcgtaggtacggtaacgggccgtacgttccgacctacgttcctacgaacggacgaaacccgaaccgtaaccgaaacggtaaacctccgtaacggttcggtaggtccctacggtaccaacgtaacggtacggaaacccgggtccgtaacgggaaggaaccggggtacccggaacccggtaaccgaccgggtacgttaccgggtttaccgtttacgttacccggtggaccggtacccggaacggtaccccgccccccgtaaggtacgggacggtacccgtaggtaggggtacgggacgtacccggtttaaccgg

SEQ ID NO: 221822 - DNA, 733 bp, Homo sapiens
  misc_feature: GYAE6OF01C3I47.38.4.A04.1.454.CMB.1.raw
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaagggctggagtgggtggccagcaattaaccaagatggacgtagaaaaatactatggtggactctgtgaagggccgattcgccatctccaagagacaacgccaagaactcactgtgctgcacatgaacggctgagaggcgacgacacggctgtgtacttctggtcgcgacgacgccccccgtagtggagggcctaacgagggtgggagtctaaccgtactttacgacttacggtcgggggacccaacggggtaaccctggtaccaccggttctccctccacggtccctacccgaccgaacgggccctacgtccggttaccccgtttccccccgtcggacccctaccccgtccctacccgaaacggaccgtcccgtacccgtccgggtacgggggacccaaccggacgggtccccgggtccccgtcgggggtcccttccgggtcccggttaccggggtaaccgtaaaccggggtaaccctttaccccgttacccggtaaccggtttacggaaccgtttaccggaccggttacgggaacgggtcccgggggtccgttaccgggggaccggaaccggggtccggacgtaacggtaggcgngng

SEQ ID NO: 221823 - DNA, 549 bp, Homo sapiens
  misc_feature: GYAE6OF01BUYYP.38.4.A04.1.454.CMB.1.raw
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (374)..(374): a, c, t, g, unknown or other
  misc_feature (374)..(374): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattgggggctgagctgggttttcctgttgctattttagaaggtgtccagtgtgaggtgcaactggtggagtcgtgggggagcttggtccaggccgggggggtcctgagactctcctgtgcagcctntgctattccacctttagtaacttatttaatgagcgtgggtccnccagcctcgaggggagggctgggagtgggngccagcaattaaccagntggactagaaaaatctatgtggactntaggtggaagggccattcgactatctccagacgaacacgaccaagaactcactgtgctgcacagtacggacgcctaggacggaggaccgacgacacggtcgtgtcgtacttcgtgtggcgtaggaccgcccccgagtcggacgggaccgtacgagggtcggacgtcgttaaccgg

SEQ ID NO: 221824 - DNA, 791 bp, Homo sapiens
  misc_feature: GYAE6OF01C59DO.38.4.A04.1.454.CMB.1.raw
  modified_base (786)..(786): a, c, t, g, unknown or other
  misc_feature (786)..(786): n is a, c, g, or t
tcagtcgatcacgtcacgaccggtgctcgatttagagtagtgatcgagggggggtccctgagactctcctgtgcagcctctgcattcacctttagtaacttatttaatgagcgtgggtccgccagcctccgaggggaaggggctgggagtgggtggccagcaattaaccaagatggacgtagaaaaatactatgtggactcgtggtagaacggggcctattccgccatctccagacgacaacgaccaaagactcactgtgctgcacatgaacggcctggagaggcgacgacacggctgtgtacttcgtgtcgcgacgccgcccccagtcggacgggtctaacgaggtacggggactaccgtacgtacgtttacgaccgttacggtcgggggacccgtacggggtaacccgttcgggtaccctacccggttcccttacccgtaccgaccggtacccctacccgaacccggtaaccggggacccccttaacggtcccgggtttaccccccttccccccggtcgggtaccccttaccccccgttaccctaaccgtaaacggaccgtaccccgttaacccggttccgggtaccgggggtacccaacccgttaaccgggtccccgggtaccccggttcggggtacccttccgggaccgtttaccgggaaccgtaaacgggttaccccttaccgttaccccggtacggttacgaaccgttaccggtaacggttccgggacgggtcccggggtagtaccgggaaccggaacggggtccctaacgtaggtacgngcgtg

SEQ ID NO: 221825 - DNA, 606 bp, Homo sapiens
  misc_feature: GYAE6OF01C0HL3.38.4.A04.1.454.CMB.1.raw
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggaggtgggtggccagcattaaccaagatggacgtgaaaaatactatgtggactctgtgaagggccgattcgccatctccagagacaacgccaagaactcactgtggctgcacatgaacggcctgagaggcgacgacacggctggtcgtacttctggtgcgagcgcccccatggagggctagagtgggagctacgctttgacttacgcggggccagggaaccctggtccaccgttctcctcacgcctaccaccgacgggcccacgtccggtccttcccccgtcggccctacccctcctaccaacgacgctacccgtcgtcggggccacgcggcccgggtcccgtcgggcctcggtcccgtcgggtaccgaacgggtaccttaccttacccgtaaccggttcgacgttccggacgtcgggtacggccggggtcgtacggggaccgtaacgggcgacgaagtagngncg

SEQ ID NO: 221826 - DNA, 563 bp, Homo sapiens
  misc_feature: GYAE6OF01BTXU5.38.4.A04.1.454.CMB.1.raw
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (416)..(416): a, c, t, g, unknown or other
  misc_feature (416)..(416): n is a, c, g, or t
  modified_base (561)..(563): a, c, t, g, unknown or other
  misc_feature (561)..(563): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtgctgcanatgaacgcctgagaggcgacgacacggctgtgtacttctgtgcgagacgcccccatgagggctacgagtggganctacgactttgactacgtggggcacgggaaccctggtccaccgtctcctcacgccctccaccgaacgggcccagtccggtccttcccccgnggtcccacccctcctaccaacgacgccaccgtcgtcggggcacgacgccggcctgggcctcggcctcggtaccgaacggacctaccgttccacggtcgactcggtacgtggacggcgggcgtagggccgaaggccgacagtacgnnn

SEQ ID NO: 221827 - DNA, 598 bp, Homo sapiens
  misc_feature: GYAE6OF01D3ZXJ.38.4.A04.1.454.CMB.1.raw
  modified_base (596)..(598): a, c, t, g, unknown or other
  misc_feature (596)..(598): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacaggtgggagctacgactttgactacgtggggcccagggaaccctggtcaccgtctcctcacgccctccaacccgaacggggccccacgtccggttccctttccccccgtcgggccctacccctccctacccaacgacgccaccctcgtcgggggccacgacggccggccccgtcggggcctcggcccgttgggtaccgaaacggtaccttaccttcccacggtgacgttccgaccgtggaggccggggccgtcgggaccgaagggccgacagtacgnnn

SEQ ID NO: 221828 - DNA, 614 bp, Homo sapiens
  misc_feature: GYAE6OF01EHQCS.38.4.A04.1.454.CMB.1.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (613)..(614): a, c, t, g, unknown or other
  misc_feature (613)..(614): n is a, c, g, or t
tcagtcgatcacgtcacgaccggtgctcgattttagagtagtgatcagggggggtccctgagactctcctgtgcagcctctgcattcacctttagtaactatttaatgagctgggtccgccagcctccgagggaaggggctggagtgggtgccagcattaaccaagatggacgtagaaaaaatctatgtggactctgtgaagggccattcgccatcncagagacaacgccaaagaactcactgtggctgcanatgaacggcctgagaggcgacgacacggctgtgtacttctgtgcgagacgcccccagtgacggctacgagtgggagctacgactttgactacgtggggaccacgggaaccctggtccaccgtctcctcacgccctccaaccgaagggccctaacgtccggtccctttcccccgtcggtacccaccccgtaccctaccgaaacgacgacctacccgtcgtacgggggccaacgacggcccggccccgtcggggtcctcgccgttggtaccgtaaacgggtacccttaaccttacccgaacggttgacgttccgaacgtcgggaaggccgggtacgtccgggacaacgggccacgaattggann

SEQ ID NO: 221829 - DNA, 592 bp, Homo sapiens
  misc_feature: GYAE6OF01CRMPL.38.4.A04.1.454.CMB.1.raw
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacaacgccaaagactcactgtggctgcacatgaacggctgagaggcgacgacacggctgtgtacttctgtgcgagacgcccccatggagggctacgaggtgggacgctacgtactttgacttacgtcggggccaacgggtaaccctggtccaccgttctcctcacgccctaccaccgaacgggccctacgtccggttccctttcccccgtcggccctaccccttccctacccaacgacgccctaccgtccgtcggggccacgacggccggcccgtgggccgtcgccgtggtaccgaacggtaccttaccttacccgtacgtcgtacgtcgacgtggacggcgggcgtcgggacgacggcgacagtacgngn

SEQ ID NO: 221830 - DNA, 759 bp, Homo sapiens
  misc_feature: GYAE6OF01EVIQU.38.4.A04.1.454.CMB.1.raw
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (754)..(754): a, c, t, g, unknown or other
  misc_feature (754)..(754): n is a, c, g, or t
  modified_base (757)..(757): a, c, t, g, unknown or other
  misc_feature (757)..(757): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcaattaaccaagatggacgtagaaaaaatctatgtggactctgtgaagggccgattcgcatctcagagacaacgccaagaactcactgnggctgcanatgaacgctgagaggcgacgacgacggctgtgtacttcgtgtgcgagaccgccccagtggagggctacgaggtgggacgtcgtacgtactttgaaccgttacggtcgggggaccccgtaacggggtaaccccttgggtacccaacccggttccttaccccgtaccgaaccggtcccccttacccgaaaccccggaaacgggggtcccccctaacggtttccccggttaccccgtttacccccccggtcgggtacccccctaacccccttaccccgtacccgtaaaccggaccggtaccccgtaacccgttcccgggtacggggggacccaaccggtaaccgggcccgggtaccccggtcggggcccgttccgggtacccggttaccggggttaaccggtaaaccggtaaccgtttacccttaccggaaccggttacgtaccgtaccggaacgttcgggacggcgggtccgtcgggacgaacggtacccgacgaaggttacngtncg

SEQ ID NO: 221831 - DNA, 644 bp, Homo sapiens
  misc_feature: GYAE6OF01D14NI.38.4.A04.1.454.CMB.1.raw
  modified_base (640)..(640): a, c, t, g, unknown or other
  misc_feature (640)..(640): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggaaggggctggagtgggtggccagcattaaccaagatggacgtagaaaaatactatgtggactctgtgaagggccattcgcatctcagagacaacgccaagactcactgtgctgcacatgaacgctgagaggcgacgacgacggctgtagttacttcgtgtcgcgacgaccgcccccgagtggacggtactacgaggtgggacgtacgtaacgtacgtttacgaccgttacggtcgggggacccaacgggtaaccctcgggtacctacccgtctcccgtcacgccctaccgaaccgaacgggtccctacgtcccgttcccttccccgtcgccctaccccttcccgaccaaacgccgacctacccgtcggtcggggacccacggacggcccggtcccgtgggtcctcggcccgttagggtaccaacggtaccttaccgttaccgacgtcgtaacgtccggtacgtcggtacgggccgggtcgtcgggaaccgacgggtccgagtaagtagnagcg

SEQ ID NO: 221832 - DNA, 628 bp, Homo sapiens
  misc_feature: GYAE6OF01B1XPI.38.4.A04.1.454.CMB.1.raw
  modified_base (220)..(220): a, c, t, g, unknown or other
  misc_feature (220)..(220): n is a, c, g, or t
  modified_base (605)..(605): a, c, t, g, unknown or other
  misc_feature (605)..(605): n is a, c, g, or t
  modified_base (625)..(626): a, c, t, g, unknown or other
  misc_feature (625)..(626): n is a, c, g, or t
  modified_base (628)..(628): a, c, t, g, unknown or other
  misc_feature (628)..(628): n is a, c, g, or t
tcagtcgatcacgtcacgaccggtgctcgatttagagtagtgatcaggggggtccctgagactctcctgtgcagcctctgcattcacctttagtaactatttaatgagcgtgggtccgccagcctccgaggggaagggggctggagtgggtggccagcaattaaccaagatggacgtagaaaaatactatgtggactctgtgaagggccattcgccatcncagagacaacgcaaagaactcacgtgtcggctgacaacagtcgaacggcctgaggaggcgacgacacggctggtgtacttctgtgacgagacgcccccatggaacgggctacgagtgggacgcgtaacgtactttgtaacgtacgtcggggccaacgggtaacctggtaccacgtctccctcacgtccgtaccaaccgaacgggaccctacgtccggtcccttcccccgtcggccctaacccctcccgtacccaaggaaccgccaaccgtccgacgggggccaaccgtacggcccgggcccgtcggggcctcggcccgttagggtaccgaaacggtactaccgttaccgacggttcgaagttcgaaccgtggacgggccggtcgnggtacgaacgcgacgagagnngn

SEQ ID NO: 221833 - DNA, 757 bp, Homo sapiens
  misc_feature: GYAE6OF01B370H.38.4.A04.1.454.CMB.1.raw
  modified_base (746)..(746): a, c, t, g, unknown or other
  misc_feature (746)..(746): n is a, c, g, or t
  modified_base (751)..(752): a, c, t, g, unknown or other
  misc_feature (751)..(752): n is a, c, g, or t
  modified_base (754)..(754): a, c, t, g, unknown or other
  misc_feature (754)..(754): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggagtgggtggccagcaattaaccaagatggacgtagaaaaaatctatgtggactcgtgtggaagggccgattccgccatctccagagacaatccaagagcacactctattgacaaaatgaaacaggcctaggggactcgtaggaacggaccacgggtcttggtacttaagttaccgtggtacgacgaaaacgacccggtcccttagtaggttggggtacgggtatttacgtcggtcggtcgggggacccaaggggaacccctgggacccctaacgttcctaccctcgaacgtcccctaccgaaccggaacggggtccccctaaggtttccccgggtaccccttccccccggtgggcccgtcccccgttggtcccgtacccggaagggaccacccgtacccgtaccggaagtaccgaccgtaaaccggccgggccccgggtacccggttcggggtacccgtaccgggttcccggttacgggtaaccggaaacgggttacccctttaacccgttcccgaacgggttacgaacgttaccggaacgttacgggaccgggtccggggaccgtacgggaaccgtaacgggccgtaccgtaagttaccgnacganngngcg

SEQ ID NO: 221834 - DNA, 700 bp, Homo sapiens
  misc_feature: GYAE6OF01CRC3Q.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcaattaaccaagatggacgtagaaaaatactatgtggactctgtgaagggccattcgccatctccagagacaacgccaagaactcactgtggctgcacatgaacggctgagaggcgacgacacggctgtgtacttctgtgcgagacgcccccatggagggctacgaggtgggagctacgtactttgactacgtggggccacgggaaccctggtccaccgtctccctcgacgccctaccaccgaacgggcccacgttccggttccctttccccccgtcgggtacccctacccccgttccctacccgaaacggaccgaccctaaccccgttccgggtaccggggggacccaaccggtaaccgggccccgggtccccgttacgggggtcccgtccgggtccccggtttacgggttacccgaaacgggtacccctttaacccgtttacccggtaaccgggttacgaaccgttccggtaaccgttcgggaaccggggtcccggggtccgttaccggggaccgaaacggggcccgacgagtaacggctaggc

SEQ ID NO: 221835 - DNA, 741 bp, Homo sapiens
  misc_feature: GYAE6OF01CZQR9.38.4.A04.1.454.CMB.1.raw
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (736)..(736): a, c, t, g, unknown or other
  misc_feature (736)..(736): n is a, c, g, or t
tcagtcgatcacgtcacgaccggtgctcgatttagagtagtgatcgagggggggttcccgtgagactctcctgtgccagccgtctgcattccacctttagtaactatttaatgagtctcgggtccgccagcctccgagggaagggctgggagtcgggtcggccagctaattaaccgaagatggacgtagaaaaactctagtggtggtacttcgtggtaggaaggggccctagttccgccattcctcgaagagacctaacgcaaagactcgagtgtggctgacaacatagaacggctggacgaggcgtacgacncggtctgtgttacttngtgcganaccgccccagtgacgggctagnggtgggactcgtacgtactttggaacttacggtcggggacccgagggtaaccctgggtacccacgttcccgttcacccgtacggccccttacccgaaccgggaaccggtacccgtaacgttcccggtcccctttacccccgtcgggtaccctaccccgttccgtaaccccgtaaggtaacccgtccttaacccgttcgggtaccggggaccaaccggaccggtacccgggtcccgtcgggaccttccgggaccccttacggggtaccgtaaacgggtacccctttaccggtacccgttaacgggtcgtaccgtaccggtaaccgtacgggtacggccggggttcgtacgggacccgaacgggccgtactaagtacggntgtcg

SEQ ID NO: 221836 - DNA, 595 bp, Homo sapiens
  misc_feature: GYAE6OF01CCLUG.38.4.A04.1.454.CMB.1.raw
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
tcagtcgatcacgtcacgaccggtgctcgatttagagtagtgatcagggggaagaccgatgggcccttggtggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttcgtgtgcgagacgccccagtgagggctacgagtggganctacgactttgactacgtgggccaggaccctggtcaccgtctcctnacgcctccaccgaacgggcccagtccggtccttcccccgtgggcccacccgtccctaccgaacgacgtccaaccgtcgtcgggggaccacgacggcccggcccgttaggggcctacggccgttcgggttccgaaacgggtaccttacccgttacccgacgttggtaacctccggacgtacggg

SEQ ID NO: 221837 - DNA, 784 bp, Homo sapiens
  misc_feature: GYAE6OF01ADR9G.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaagggccattcgccatcctccagacgacaacgccaagactcactgtgctgcacatgaacgctagagaggcgacgacgacggctgttcgtacttcgtggtcgcgacgaccgcccctagtggacgggtcctaacgaggtcgggactcgttaacgtacgttttcggaaccgttacggtcgggggacccgtaaccggggtaaccccttgggtacccgtaccggttcctacccgttcgaccgtaccccgtacccgaacccggaaaccggggtccccctaacgttccccgggtttacccctttccccccggtccggtaccccctaacccccgttcccgtaacccgaaacggtacccgtacccgtaacccggttccggggaccgggggaccctaaaccggtaccgggtccccgggtacccccggttggggtcccgttaccgggacccggttacgggtaacccgtaaaccgggttacccctttacccgttaccccgtacggtaccggtaccgttaccgggtaccggtcgggaacggggtcccggggtccgtaccggggaaccgaaacggggttcccgaacgtaaggacggcagcg

SEQ ID NO: 221838 - DNA, 588 bp, Homo sapiens
  misc_feature: GYAE6OF01A4K20.38.4.A04.1.454.CMB.1.raw
  modified_base (319)..(319): a, c, t, g, unknown or other
  misc_feature (319)..(319): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggactagaaaaatctatgtggactctgtgaaggccattcgcatctcagagacaacgccaagactcactgtgctgcacatgaacggcctgagaggcgacgacacggtctgtgtacttctgtgcgagacgcccccatgagggctacgagtggganctacgactttgactacgtggggccagggaaccctggtccaccgtctacctgacgccctccaccgtaacgggcccagtccggtcccttcccccgtgggcccctaccccgtccctaccgaaacgaccgcctaaccgtccgtcgggggaccacggacggcccggcccgtgggcccttcgcccgttaggtaccaacgggtacctaccgttccaacggttgaccgttcgacgtggacggcggtccgtcggacgaacggcgacagtacgngngcg

SEQ ID NO: 221839 - DNA, 654 bp, Homo sapiens
  misc_feature: GYAE6OF01CUTXC.38.4.A04.1.454.CMB.1.raw
  modified_base (212)..(212): a, c, t, g, unknown or other
  misc_feature (212)..(212): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccgagggaggggctggagtgggtggccagcattaaccaagatggacgtagaaaaatctatgtgactctgtgaaggccatcgcatcncagagacaacgcaagactcactgtgctgacacatgaacgctgagaggcgacgacgacggctgtcgtacttctggtgcgacgacgcccccgagtaggacgggctaacgaggtgggacgtcgtaacgtactttacgaacgtacggtcgggggacccgaacggtaaccgtcggttaccgaaccgttcctacctcgaacgtcccgtaccgaaccgaacgggccctacgtcccggttccccgttacccccccggccgtaccccttacccgtacccgtaacgaacgtacccgtacccgtacggtccggggacccgaccgtacgggcccgggtcccgtacgggtccgccgtaccgtccggtacgaacgtaccttaccgttccaacggtagtacgtccgacgttacggcggccgggtcgcggtacggacggacgcgtaacacgtncgngn

SEQ ID NO: 221840 - DNA, 611 bp, Homo sapiens
  misc_feature: GYAE6OF01EQ825.38.4.A04.1.454.CMB.1.raw
  modified_base (322)..(322): a, c, t, g, unknown or other
  misc_feature (322)..(322): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgnggtgggagcttacgtactttgactcgtggggccacgggaaccctggtccaccgtctccctcacgccctaccgaccgaacgggccctacgtccggtccttcccccgtcggccctacccgtccctacccgaacgaccgtccaccgtccggtcggggaccaccgacggccgggcccgtcggggcctcggtcccgtggtaccgaacggtaccttaccgttaccgaccggtcgacgtaccggacgttcggacggccggggtccgtgggaccgaacgggccgacgagtacggngn

SEQ ID NO: 221841 - DNA, 705 bp, Homo sapiens
  misc_feature: GYAE6OF01C1C5T.38.4.A04.1.454.CMB.1.raw
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (700)..(700): a, c, t, g, unknown or other
  misc_feature (700)..(700): n is a, c, g, or t
  modified_base (702)..(702): a, c, t, g, unknown or other
  misc_feature (702)..(702): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagacgcccccagtgagggctaacgnggtgggacncgtacgtacgtttcgacttacgtcggggaccgacgggtaaccctggtccaccgttctccgtcacgccctacccgaccgaaccggggcccctaacgttcccgggttacccctttcccccccgacgggtacccctacccccttcccttaacccgaacgaccgccgtaaccccgttcgggtcggggacccaacgaccgggtcccgggccccggttacggggtcccgttaccgggtcccgttacggggtaccgtaaaccgggtaaccctttaccgtttaccccggtaacggttaccgtaccgttaccggtacgttaccgggagggtccccggggcttaccggggaccgtaacggggcccgactaaggttacgngngcg

SEQ ID NO: 221842 - DNA, 682 bp, Homo sapiens
  misc_feature: GYAE6OF01CH6IA.38.4.A04.1.454.CMB.1.raw
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggagtcgttgggtcccgagggcccgggggggtccctggacgtctcctccgtgtcgcacgcctcgtgctacttcacctttagtaacttatttaatgagcgtcggtccnccgacgccctccgaggggaacgggctggaggttcgggngacccagacgtaattaaacccgaagtagtacggaacgtaaagaaaaacttctaagtcggtaggaccttcgtaggtacgggaacgggtccgtaagttccggacctacgtcctaccgaacgacggaacccgaaaccggaaccaaagtaaccctaccgacgtacggttcggcgtacgaccaacgtagtaccggaaccggtcccgtaggacggacgggaccgaaccgaccggacggtcgtgtgttaccttcgtgttcggccgtacggacccggtccccccagtcgggacggtaccgttaacggagggtcgggacgtccgttaaccggg

SEQ ID NO: 221843 - DNA, 700 bp, Homo sapiens
  misc_feature: GYAE6OF01AIIF4.38.4.A04.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (360)..(360): a, c, t, g, unknown or other
  misc_feature (360)..(360): n is a, c, g, or t
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
tcagtcgatcacgtcacgaccggtgctcgatttagagtagtgatcagggggggtccggtcgagactctcctgtgcagcctctgcattctaccttagttaactattaatgagctcgggtccggccacgcctccgaggggaaggggcgtggaggtggggtggccagcattaaccaagatggacgtagaaaaatactntggtggactctggtaggacgggcctattcgccatctccaganacacgccaagactcagtgtggcctgcacatggacggcctgaggacggccgacgacacggctgtcgttacttcgtggtcgcggacgaccgcccccacgtagggcgggactacgagggtgggacnccttacgtactttagaccgtacgcgggggacccaacggggtaacccgttcggttccaacccggttccttaccccgtaccgacggtaccccctaccggaaccccgaacgggggtcccctacgttcccggttccccttccccccgtacggacccctacccccgtccctacgaaacggccgacccgtacccgttcgggtacggggacccaccacgggcccgggtcccgtcgggccgtcgcccgtagggtaccgtaacggtaccttacccgttcgacgtgtactacccggtacgtgggaccgggacgggccggtacgaccggaacgggtccaccgatcgngcng

SEQ ID NO: 221844 - DNA, 609 bp, Homo sapiens
  misc_feature: GYAE6OF01BVT2T.38.4.A04.1.454.CMB.1.raw
  modified_base (290)..(290): a, c, t, g, unknown or other
  misc_feature (290)..(290): n is a, c, g, or t
  modified_base (605)..(605): a, c, t, g, unknown or other
  misc_feature (605)..(605): n is a, c, g, or t
  modified_base (608)..(608): a, c, t, g, unknown or other
  misc_feature (608)..(608): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttcngtgcgagacgcccccatggagggctacaggtgggagctacgactttgactacgtggggccagggaaccctggtccaccgtctcctcagccctccacgaacgggcccagttccggtccttcccccctggcccctacccctccctaccgaagacgccacccgtccgtcgggggccacgacggcccggcccgtgggcctcggcccgttgggtaccgaacgggtaccttaccttccgaacggtcgtaacgtccggtaaccgtgggaacggtcccgggggtcgtcggggaccggaaacgggtcccggacctaagttaggncgng

SEQ ID NO: 221845 - DNA, 558 bp, Homo sapiens
  misc_feature: GYAE6OF01D9ILM.38.4.A04.1.454.CMB.1.raw
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacgaggtgggagctacgactttgactacgtggggccagggaaccctggtcaccgtctcctcacgcctccaccgaacggcccacgtccgtccttcccccgtcggcccaccctcctccaacgacgccacctccgtcggggccacgacggccggcccgtgggcctcggccgtcgggtaccaacggactaccttccgacgtgactcgacgtgaggcgggctcgggcgaacgggcgacatacgnngn

SEQ ID NO: 221846 - DNA, 746 bp, Homo sapiens
  misc_feature: GYAE6OF01C0V7V.38.4.A04.1.454.CMB.1.raw
  modified_base (745)..(745): a, c, t, g, unknown or other
  misc_feature (745)..(745): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcattaaccaagatggacgtagaaaaatactatgtggactctgtgaaggccgattcgcatctccagagacaacgccaaagaactcactgtggctgcacagtgaacggcctgagaggcgacgacacggctgtgtacttctgtgcgacgacgcccccaagtggacgggctaacgaggtgggacgaccgttacgtacgttttacgaacgttacggtcggggacccgaacgggtacccgtggtaccctaccggttccttaccctaccgacggtccccttacccgaacccggtaaccggggcccctaacggttcccgggttcccccgtttccccccgtccgggtacccctacccccgttcccgtaacccgaaacggaccgtacccgtaacccgtccgggtacgggggacccaacccggtaccgggccccgggtaccccggttcggggacccgttcgggtaccccggttacgggtaacccgaaacgggttacccctttaccgttccccgtaacggttacgtaccgttaccggacggttcgggaaccgggtccgggccggttacgggaccgaaacggggtcccacgtaagacggtgcgng

SEQ ID NO: 221847 - DNA, 708 bp, Homo sapiens
  misc_feature: GYAE6OF01CEHXY.38.4.A04.1.454.CMB.1.raw
  modified_base (703)..(703): a, c, t, g, unknown or other
  misc_feature (703)..(703): n is a, c, g, or t
  modified_base (705)..(705): a, c, t, g, unknown or other
  misc_feature (705)..(705): n is a, c, g, or t
  modified_base (707)..(707): a, c, t, g, unknown or other
  misc_feature (707)..(707): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactctgtggaagggccattcgccatctccagagacaacgcaagactcactgtggctgcacatgaacgcctggagaggcgacgacacggctgtgtacttctgtcgcgagaccgcccccagtggaggtcctacgaggtgggacgtaccgttaacgtaccttttaggaaccgttacggtacgggggacccgaacggggtaacccttcgggtaccctacccgttacctccccttacgaccgtccccgtaccccgaacccggaaaccggggtcccctaacggttcccgggtttacccccgtttccccccgtaccgggtaccccctaacccccgttcccgtaaccccgaaggacccgtcccgtaacccgtccgggtcggggacccacgtacgggccccgccggtcggccgtcggccgtcggtaccgaacggtacccttaccgtccgtaacgtgtaaccgtccgtaacgtcggaccgggcgggtaccgtcgggaccgaagggcccggaactaggtagngngng

SEQ ID NO: 221848 - DNA, 692 bp, Homo sapiens
  misc_feature: GYAE6OF01DIS5H.38.4.A04.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactntgtgaaggccgattcgcatctccaganacaacgccaagactcactgtgctgcacagtgaacggctggagacggcgacgacacggctggtgttacttctggtgcgagaccgcccccagtaggacggacctacgaggtcgggacgtcgttaacgtacgttttaggaccgttacggtcgggggacccgaacggggtaaccccttgggtacccaccggtccttcccgtacgaccgtcccctacccgaacccggaaccggggtcccctacgttcccggtcccccgtttcccccgtcggtacccctaccccgtacccgtaccgaacggtacccgccgtacccgtaccgggtcggggaccctacggacgggcccggtacccgggtcggtccgtcggtcccgttagggtaccgtaacggtacccttaccttaccgtacggtcgacgtaccgacgtcggacgggcggcggtacgggaccgaagggtccgaacgtagtggacngng

SEQ ID NO: 221849 - DNA, 569 bp, Homo sapiens
  misc_feature: GYAE6OF01CBXM0.38.4.A04.1.454.CMB.1.raw
  modified_base (566)..(568): a, c, t, g, unknown or other
  misc_feature (566)..(568): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacgagtgggagctacgactttgactacgtggggccagggaaccctggtccaccgtctcctcacgcctccaccagggcccatccggtccttcccccgtggccctaccctccctaccaacgcgcctaccgtcgtcggggccacgcgccggcccgtcgggcctcggcccgtggtaccgaacggtaccttaccgttccgacgtgtacgtcgacgtggacggcgggtcgtcgggacgaagggccgacagtacgnnng

SEQ ID NO: 221850 - DNA, 708 bp, Homo sapiens
  misc_feature: GYAE6OF01CF6BQ.38.4.A04.1.454.CMB.1.raw
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (375)..(375): a, c, t, g, unknown or other
  misc_feature (375)..(375): n is a, c, g, or t
  modified_base (473)..(473): a, c, t, g, unknown or other
  misc_feature (473)..(473): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccagtggaagttgggggctgagtcgttgggttttccttgttgcttattttagaggtgtccagtgtgaggtgcaacgtggtggagtcggtgggggagtcgttcgggtccgagggtcccgggggggtccctggacgacctctccgtgtgcacgcctctgctattctactttaagtaacttattaangagtcgtgggtcccncacgcctacggagggaggtcgtggaggtgggcgccagctaataaccgagtntaggaacgtaaagaaaatctagtggtacggtactcgtaggtaggaacggtcctagttccgacctagtccacgaacgacgaaccgaaccgtaccgaaanacccttcgaacgttggtacggtcctacgaccacgtaaggtaccgggaaccggccgtagggaacggaccgggtaccgaaccggaacgtaaccgggtccttagggttacggtttacccttacgggttggtaccgggaaccccggtaacgggaccccccgttaccccccggaaggttacggggaaccgggtaccctaacgggtacggggtacgggtacgttccccggtttaaaccggg

SEQ ID NO: 221851 - DNA, 662 bp, Homo sapiens
  misc_feature: GYAE6OF01E0AAF.38.4.A04.1.454.CMB.1.raw
  modified_base (195)..(195): a, c, t, g, unknown or other
  misc_feature (195)..(195): n is a, c, g, or t
  modified_base (326)..(326): a, c, t, g, unknown or other
  misc_feature (326)..(326): n is a, c, g, or t
  modified_base (659)..(659): a, c, t, g, unknown or other
  misc_feature (659)..(659): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcaattaaccaagatggacgtagaaaaatactatgtggactntgtgaaggccgattcgccatctcagagacaacgcaagaactcactgtgctgcacatgaacggcctgagaggcgacgacacggctgtgtactcgtgtgcgagacgcccccagtggacggctacaggtggganctacgtactttgactacgtgggccgacggaaccctgtccaccgtctcctcacgccctaccgaacgaacggcccacgtccggtccttcccccgtcggccctacccctcctacccgaaacgtacgaccgtaacccgtcggtacgggggaccaaccgaacgggcccgggtacccggtcggggtccgtcggtaccccggtacgggttaaccgtaaacgggtacccttaacccgtttacccgtaaccgggttcgttaaaccgtccggtaaccgtagggtaacgggtccggggtaccgttacggggaacccgtaaagggggcccgacgtaaagtgacgngcg

SEQ ID NO: 221852 - DNA, 689 bp, Homo sapiens
  misc_feature: GYAE6OF01D9NJT.38.4.A04.1.454.CMB.1.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (684)..(684): a, c, t, g, unknown or other
  misc_feature (684)..(684): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtgccagcattaaccaagatggacgtagaaaaatctatgtggactctgtgaagggccgattcgccatctccagagacaacgccaagaactcactgtggctgcacatgaacgcctgagaggcgacgacacggctgtgtacttcngtgcgagaccncccccatggacggctacgaggtgggacncgtacgacttttgacgtacggtcggggaccaacgggaaccctcggtccaacccggtctccctcgacgttcctacccgaaccgaaaccggggtcccctaacggttcccgggttcccctttacccccccgtcgggtacccctacccccgttacccgtacccgaaacggaccgtccctaaccccggttcggtaccggggggacccaaccggtacgggccccggtaccccggtcggggtccctacggtcccgttagggtaacccgaaacggtacccttaaccgtttacccggagttaccggacttaccgggacgttcggacgggcgggtcgtcgggacgaaccgggcgacgtaacgtangcgag

SEQ ID NO: 221853 - DNA, 560 bp, Homo sapiens
  misc_feature: GYAE6OF01C65DJ.38.4.A04.1.454.CMB.1.raw
  modified_base (318)..(318): a, c, t, g, unknown or other
  misc_feature (318)..(318): n is a, c, g, or t
  modified_base (434)..(434): a, c, t, g, unknown or other
  misc_feature (434)..(434): n is a, c, g, or t
  modified_base (538)..(538): a, c, t, g, unknown or other
  misc_feature (538)..(538): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagcgcccccatggaggctanggtggagctacgactttgactcgtggggccagggaaccctggtcaccgtctctcacgcctccacgacgggccctagtccggtccttccccctggccctacccctcctaccgaagcncctaccctcggtcgggccacgcggccggcccgtgggccttcggccgtacggtacgaacggtaccttacctccgtacgttgacttcgaccgtggacggcgggtcncgggacaacgggcacagtgngn

SEQ ID NO: 221854 - DNA, 625 bp, Homo sapiens
  misc_feature: GYAE6OF01CFHI3.38.4.A04.1.454.CMB.1.raw
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaaggccattcgccatctcagagacaacgcaaagaactcactgtggctgcacatgaacggctgagaggcgacgacgacggcttgtgttacttcgtggtcgcgagaccgcccccagtggacgggctaacgaggtgggacgcgtacgtactttgaccgtacggtcggggaccgaacgggtaaccctggtaccacccgtcctcctacgacgccctaccgaccgaacgggtccctacgttccggtccccttcccccgtcggccctaccccgtcctaccgaaacgtcgacctaccgtcggtcggggaccaccgacggcccgtccgtcggctcgcccgtggtaccgaacgtcccttacctaccgacgttcgacgttccggacgttaggacggtccgggcgtacgggtacgaacgggtcacgtaaatgngtcng

SEQ ID NO: 221855 - DNA, 683 bp, Homo sapiens
  misc_feature: GYAE6OF01CBFIU.38.4.A04.1.454.CMB.1.raw
  modified_base (680)..(681): a, c, t, g, unknown or other
  misc_feature (680)..(681): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccgattcgccatctccagagacaacgccaaagaactcactgtggctgcacatgaacggcctgagaggcgacgacacggctgtgttacttctgtgcgagaccgcccccatggacggctacgaggtgggatcgtacgtactttgacgttacgtcggggaccagggtaaccctggtccaccggttctccctcgacgtccctacccgaacccgtacgggccccgtacgtccggttcccctttccccccgtcgggacccctacccccttccctaacccgaaacggaaccgtcccgtaacccgttccgggtccgggggaccaaccggacggccccggggtcccgttccgggggccgttacggtccccggttacgggtaccgaaacgggtacccttacccgtttaccgaccggttggtaacgttccgaaccggttcggaccgggcgggtcgtacgggacggaacgggtccgtacgagtacggnngc

SEQ ID NO: 221856 - DNA, 548 bp, Homo sapiens
  misc_feature: GYAE6OF01BPNVM.38.4.A04.1.454.CMB.1.raw
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
  modified_base (545)..(547): a, c, t, g, unknown or other
  misc_feature (545)..(547): n is a, c, g, or t
tcagtcgatcacgtcacgaccggtgctcgatttagagtagtgatcgaggggggttcccggtgagactctcctgtgcagccgtctgcattcacctttagtaactatttaatgagctgggtccgccagcctccagggaaggggctgggagtgggtggccagcatttaaccaagactggacgtgaaaaatctatgtggactctggtgaagggccgattcgccatctccagngacaacgccaaagaactcaactgtggctgcgactatgaacggcctggagagcgacgacacggcctgtgtacttctgtgcgagacgcccccatggaggctacagtgganctacgctttgactacgtgggccagggaccctggtcacgtctcctcncgcctcaccgaaggcccagtcggtccttccccgtggcctaccctcctaccgaagacgcacctcgtcggggcacgacgccggcctcgggctcggccgtgggtacaacggtactacctccgacgtcgatcggactggacgcgggcctcggcaacggtcgcatcgnnng

SEQ ID NO: 221857 - DNA, 803 bp, Homo sapiens
  misc_feature: GYAE6OF01EJ4P5.38.4.A04.1.454.CMB.1.raw
  modified_base (193)..(193): a, c, t, g, unknown or other
  misc_feature (193)..(193): n is a, c, g, or t
  modified_base (800)..(800): a, c, t, g, unknown or other
  misc_feature (800)..(800): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatctatgtgactntgtgaggccgattcgcatctcagagacaacgccaagactcactgtggctgcacagtcgaaccggctggaggacggccgaacgacgacggtctgttgttactttcgtggtcgacggtacggacccgaccccccgtagttacggacggggtcttaacggagggttaggggacgtaccgttacgttacgttttacggaaccgttacgggtcgggggacccgtaaaccggggtaacccgtttcggtacccgtacccggttcccttcccgtacgaccgtaccccttacccgaaacccggaaccgggtcccctaacggttccccggttacccctttcccccccggtggtaccccccttacccccgttccgtaacccgaaacggtccgtacccgtaacccggttccgggtcgggggaccctaccggacgggccccggtccccgggttcggggtcccgttccggtacccgggtttacggtaacccggtaaacgggttacccttaaccgtttcccggaaacgggtttacgaaccgttacccggtacgggttacgggaccggggtacccgggtccggttacgggaaccggtaaacgggccgtaacgtaagtacggcnggc

SEQ ID NO: 221858 - DNA, 535 bp, Homo sapiens
  misc_feature: GYAE6OF01BXCB2.38.4.A04.1.454.CMB.1.raw
  modified_base (435)..(435): a, c, t, g, unknown or other
  misc_feature (435)..(435): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggcccgggggggtccctggagacctctcctgtgcagcctctgcattcaccttttagtaactatttaatgagcgtgggtcccgccagccctccgaggggaaggggctgggagtggggtggcccagcaattaaccaagatggacgtagaaaaatctatgtggactctgtgaagggccattcgcatctccagagacaacgccaagaactcactgngctgcacatgaacgcctgagaggcgacgacacggctgtgtacttcgtgtggcgagaccgcccccagtggacgggtctacggaggttgggagcgttaaccg

SEQ ID NO: 221859 - DNA, 581 bp, Homo sapiens
  misc_feature: GYAE6OF01CNERU.38.4.A04.1.454.CMB.1.raw
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccaggggaaggggctgggaggtgggtggccagcattaaccaagatggacgtagaaaaatactatgtggactctgtggaagggccgattcgccatctccagagacaacgccaagaactcactgtggctgcacatgaacggcctgagaggcgacgacacggctgtgtacttctgtgcgagacgcccccatggagggctacgaggtgggagctacgactttgactacgtggggccagggaaccctggtccaccgtctcctcacgccctccaaccgacgggcccacgtccggtcccttcccccgtcggccccaccctccctacccgaacgcgcctacccgtcgtcggggccacgacggccggcccgtcgggctcgcccgtggtacgaacggaccttacgtccgacggtgacgtcgacgtggaggccgggtcgtacgggacaacgggcgacagtacgnngn

SEQ ID NO: 221860 - DNA, 658 bp, Homo sapiens
  misc_feature: GYAE6OF01D5WK4.38.4.A04.1.454.CMB.1.raw
  modified_base (286)..(286): a, c, t, g, unknown or other
  misc_feature (286)..(286): n is a, c, g, or t
  modified_base (655)..(656): a, c, t, g, unknown or other
  misc_feature (655)..(656): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggaacgtagaaaaatactatgtggactctgtgaagggccgattcgccatcctccagagacaacgccaagaactcactgtggctgcacatggaacggcctggagaggcgacgacgacggntgtgtacttctgtgcgacgccgccccagtggacgggctacgaggtcgggagtcgtaacgtactttacggaaccttacggtcggggacccgaacggggtaaccccgttggtaccctacccggttccttccctacgtaccgccccttacccgaaccgaaccggggcccctaacgttcccggttcccctttccccccgtcgggtacccctaccccctacctacccgaacgtacgccgtaacccgtcggtcggggaccacgacggcccgggcccgtgggcctcggccgtacggtacgaacggtaccttaccgtccgtacgtcgaccgtcgtaccgtcggacgggcgggtcgtcggcggaacgcgacgtagtgnncg

SEQ ID NO: 221861 - DNA, 680 bp, Homo sapiens
  misc_feature: GYAE6OF01BXJUO.38.4.A04.1.454.CMB.1.raw
  modified_base (148)..(148): a, c, t, g, unknown or other
  misc_feature (148)..(148): n is a, c, g, or t
  modified_base (262)..(262): a, c, t, g, unknown or other
  misc_feature (262)..(262): n is a, c, g, or t
tcagtcgatcacgtcacgaccggtgctcgatttagagtagtgatcagggggaagaccgatgggcccttggtggaggcttggtccaggccggggggtccctgagactctcctgtgcagcctctgcattcacctttagtaactatttaangagcgtgggtccgccagcctcgagggaagggctggagtgggtgccagcaattaaccaagatggacgtagaaaaatcgtatgtggactcgtgtggaagggccattcgcctatccncagagacaacgaccaagactcactgtggctgcacgatagaacggcctagagacggcgacgacacggtctgtcgtacttcgtgtgcgaggacccgccccagtcggacgggtcctaacgagggttggacgtcgttaacgacgttttacgacctaacggttcggggaacccgacggggtaacccttgggtccgtaacccggtccttccctcgaacgtccccgtacccgaaccggaaccgggaccctacgttcccgggttcccttccccggtcgaccccgtacccttcccgaaccgaacgacgtcccgtaaccggttcggtacggggaccaccgttaacgggccggccccggttgggccgtcggtcccgagggttaccgaacgttaaccgtccgttaccgagttacacgttcggacgtcggg

SEQ ID NO: 221862 - DNA, 703 bp, Homo sapiens
  misc_feature: GYAE6OF01BX59M.38.4.A04.1.454.CMB.1.raw
  modified_base (699)..(699): a, c, t, g, unknown or other
  misc_feature (699)..(699): n is a, c, g, or t
  modified_base (701)..(701): a, c, t, g, unknown or other
  misc_feature (701)..(701): n is a, c, g, or t
  modified_base (703)..(703): a, c, t, g, unknown or other
  misc_feature (703)..(703): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccattcgccatctccagagacaacgccaaagaactcactgtggctgcacatgaacggcctgagaggcgacgacacggctgtgtacttctgtgcgagacgcccccactggacgggctacgaggtagggagtcgtaacgtctttggacttaacggtcgggggacccaacggggtaaccccttgggtaccgaacccggttcctccctacgacggtcccctacccaacccgaacggggtccccacgttcccggttcccctttcccccccgtgggtacccctaaccccgtcccgtacccaaacggaccgaccctacccgttccggcgggggaccaaccggacggccccgggtcccggtcggggtccgtccggcccgttacgggtaccgtaaacggtacccttaaccgttcccgtaacggttcgtaaccgtttacccggaacgttcgggaaccgggccggggtccggtacgggaccgaaacgggtccgaccgtaagtacggngngn

SEQ ID NO: 221863 - DNA, 679 bp, Homo sapiens
  misc_feature: GYAE6OF01CHNKB.38.4.A04.1.454.CMB.1.raw
  modified_base (334)..(334): a, c, t, g, unknown or other
  misc_feature (334)..(334): n is a, c, g, or t
  modified_base (673)..(673): a, c, t, g, unknown or other
  misc_feature (673)..(673): n is a, c, g, or t
  modified_base (678)..(678): a, c, t, g, unknown or other
  misc_feature (678)..(678): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcattaaccaagatggacgtagaaaaatactatgtggactctgtgaagggccattcgcatctcagagacaacgccaagaactcactgtaggctgcacatgaacggcctgaggaggcgacgacacggctgtgtacttctgtgcgacgaccgcccccagtggacggctacggaggtcgggacncgtaacggtacttttcggacgtacggttcgggggacccaacggggtaacccttggtccgaacccgttctcccacgaaccggtcccctaccaacccgaacgggcccacgttcccggtcccttcccccgttcggaccctaccccgtccctaacccgaagaccgacccaccgtccggtacgggccaacgacggcccgggcccgtcgggaccgtcggacccgttacggtaccgtaaacggtaccctacccgttacccgtaacggtcggtaaccgtacggtaaccggtcgggacgggcccggggtccgtagggaacccggtaacgggcccgacgtaagtacggngtcgng

SEQ ID NO: 221864 - DNA, 590 bp, Homo sapiens
  misc_feature: GYAE6OF01A4IBR.38.4.A04.1.454.CMB.1.raw
  modified_base (587)..(588): a, c, t, g, unknown or other
  misc_feature (587)..(588): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagaccgcccccagtggacgggctacgaggtgggagcgtaacgacgtttgactacgtcggggaccacgggaaccctggtccaccgtcctcctcacgtccctaccaaccgacgggccctacgttcccggttcccttccccccgtgcccctaccccttccctaccgaacgacgtccacccgtcggtcgggccacgcggccggcccgtcggctcggccgtcggacgaacgtacctaccgtccgacgtgacgtcgacgtcggagcgggtctcgggacgaacgggccgacgtagtcgnngc

SEQ ID NO: 221865 - DNA, 587 bp, Homo sapiens
  misc_feature: GYAE6OF01BPB3G.38.4.A04.1.454.CMB.1.raw
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (426)..(426): a, c, t, g, unknown or other
  misc_feature (426)..(426): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgcaagaactcactgtggctgcacatgaacggcctgagaggcgacgacacggctgtgtacttctgtgcgagacgccccagtgaggctagnggtggganctacggtactttgactacggtcggggaccacgggaaccctggtccaccgtctcctcgacgccctaccgacgaacgggcccagtcccggttccttcccccgngggtccccaccccgttcctaccgaacgcgaccacccgtcggtcggggccacgacggccggccgtcgggcctcgccgtacggtaccgaacggtaccttacctcccgagtcgactcggacgtggacggcgggtccgtggaccgacgggcgacagtacgnngng

SEQ ID NO: 221866 - DNA, 581 bp, Homo sapiens
  misc_feature: GYAE6OF01EDUIR.38.4.A04.1.454.CMB.1.raw
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagcctccagggaggggctggagtgggtgccagcattaaccaagatggacgtagaaaaatactatgtggactctgtgaagggccattcgccatctccagagacaacgccaagaactcactgtggctgcacatgaacgctgagaggcgacgacacggctgtgtacttctgtgcgagacgccccagtgagggctacgagtgggagtctacgactttggactacgtcgggggaccaagggtaaccctggtccaccggttctccctcgacgccctccgaaccgacgggccctaacgtccggttaccttcccccgtcggccctaccctccctaccgaacgacgcctacccgtcgtcgggggccacgacggccggcccgtcgggtctcggtccgtggtacaacggacctacgttccacgtgactcgacgtggagcgggcgtacggacgaacggcgacagtacgnngn

SEQ ID NO: 221867 - DNA, 610 bp, Homo sapiens
  misc_feature: GYAE6OF01BBCHF.38.4.A04.1.454.CMB.1.raw
  modified_base (398)..(398): a, c, t, g, unknown or other
  misc_feature (398)..(398): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
tcagtcgatcacgtcacgaccggtgctcgatttagagtagtgatcgaggggggggtccctgagactctcctgtgcagcctctgcattcacctttagtaactatttaatgagctgggtccgccagcctccgagggaaggggctggagtgggtggccagcattaaccaagatggacgtgaaaaatctatgtggactctgtgaaggccgattcgccatctccagagacaacgccaagaactcactgtggctgcacatgaacggcctgagaggcgacgacacggctgtgtacttctggtgcgagaccgcccccagtggacgggctacgaggtggggactcctacgtactttgactcggtcggggaccaagggaccctgggtccctaccgtctccctcgaccnccctacccacgaacggcccacgttccggtccttcccccgtggcccctaccctccctaccgaagaccgcctccgtaccggtcggggccaacggtaccggcccgggtcccgtcgggccgttcgcccggttcgggtaaccgaacggtacccttactaccgtaacgtacgtccgacgtggcggcgggcgtgggacgaaggccactatacggcngnn

SEQ ID NO: 221868 - DNA, 674 bp, Homo sapiens
  misc_feature: GYAE6OF01C3CKO.38.4.A04.1.454.CMB.1.raw
  modified_base (669)..(669): a, c, t, g, unknown or other
  misc_feature (669)..(669): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtagaaaaatactatgtggactctgtgaaggccgattcgcatctcagagacaacgccaagactcactgtggctgcacatgaacggtctgagaggcgacgacacggctagtgtacttcgtagtgacgacgacgcccccagtggacggctacgaggtggagactacgactttgaactacggtcggggaccacgggaacccgtggtaccaccggtctcctcgacgccctaccaccgaacgggccctagtcccggttacccttcccccgtggaccctacccctaccgtacccgaagaccgcctaacccgttcgggtacggggacccaacggtacgccccgggtacccgtcggggtctccggacccgttcgggtaacccgaaccgggttaaccttaccccgttaccgtccggtacggaccgttacggaacccgttacgggacggggtcccgggtccggtacggggaacccgtaacggggtacccggaaccttaagaaccggngtgag

SEQ ID NO: 221869 - DNA, 594 bp, Homo sapiens
  misc_feature: GYAE6OF01CQ33M.38.4.A04.1.454.CMB.1.raw
  modified_base (399)..(399): a, c, t, g, unknown or other
  misc_feature (399)..(399): n is a, c, g, or t
  modified_base (555)..(555): a, c, t, g, unknown or other
  misc_feature (555)..(555): n is a, c, g, or t
  modified_base (592)..(594): a, c, t, g, unknown or other
  misc_feature (592)..(594): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccaacattaaccaagatggacgtagaaaaatactatgtggactctgtggaagggccgattcgccatctccagagacaacgccaaagaacctcactgtggctgcacatgaacggcctgaggaggcgacgacacggctgtgtacttctgtgcgagccgcccccagtggacgggtctaacgaggtgggagtctacgacttttcgactacggtcggggaccgacggggaaaccctggtccacccgtctcctcncgcctacccaccgaacgggccctacgtccggtcccttcccccgtcggccctaccccgtccctaccgaacgacgccacccgtcgtcggggccacgacgccggaccgtggcctcggccgtcggacgtaacgtactaccttccgtacgtcgactaccgngtacggcggcgggcgtcggacgaggcgacgatagcgnnn

SEQ ID NO: 221870 - DNA, 618 bp, Homo sapiens
  misc_feature: GYAE6OF01CYDGI.38.4.A04.1.454.CMB.1.raw
  modified_base (384)..(384): a, c, t, g, unknown or other
  misc_feature (384)..(384): n is a, c, g, or t
  modified_base (614)..(614): a, c, t, g, unknown or other
  misc_feature (614)..(614): n is a, c, g, or t
  modified_base (616)..(617): a, c, t, g, unknown or other
  misc_feature (616)..(617): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccaggggaaggggctggagtgggtggccagcattaaccaagatggacgtagaaaaatactatgtggactctgtggaagggccgattcgccatctccagagacaacgccaaagacctcactgtggctgcacatgaacgcctgagaggcgacgacacggctgtgtacttctgtgcgagacgcccccatggaggctacgaggtgggagcgtacgactttgactacgtggggaccacgggaaccctggtccaccgtctcctcncgccctacccacgacgggccctacgtcccggttcccttccccctcgggccctacccctcctacccaacgtcaccgacccgttccgtcgggggaccacgacggcccgggcccgtaggggcctcggtcccgtaggtaccgtaaacggtaccttaccgtcccgacgttacggacgttaccggacgttggacgggccggggtcgtcggggacgaacgggcccgactaagtacgngnng

SEQ ID NO: 221871 - DNA, 607 bp, Homo sapiens
  misc_feature: GYAE6OF01D5JYV.38.4.A04.1.454.CMB.1.raw
  modified_base (330)..(330): a, c, t, g, unknown or other
  misc_feature (330)..(330): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagaccgcccccagtgagggctacgaggtggganctacgtactttgacttacgtcggggccacgggaccctggtaccaccgtctcctcacgccctaccaccgacggcccacgtccgtcccttcccccgtcggcccaccctcctaccaagacgcctacccgtccggtacggggccacgacggcccgggtcccgtcggggtcctcggtcccgttagggtaccgaaacggtaccgttaccgttcccgtacggtcgaacgttccgacgtcggacggccgggtcgtcgggacgaacgggcgacgagtacggnngng

SEQ ID NO: 221872 - DNA, 766 bp, Homo sapiens
  misc_feature: GYAE6OF01CXQKV.38.4.A04.1.454.CMB.1.raw
  modified_base (761)..(761): a, c, t, g, unknown or other
  misc_feature (761)..(761): n is a, c, g, or t
  modified_base (763)..(763): a, c, t, g, unknown or other
  misc_feature (763)..(763): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccgagggagggctggagtgggtggccagcattaaccaagatggacgtagaaaaatactatgtggactctgtaggaacgggccgattcgccatcctaccgagagaccaacgaccaaagactcactgtggctgcacagtacggaaccggcctggagacggaccgaccgacgacggtctaggtgtaccgttcgtgtcgacgacgaccgacccccagtacggacggacctaacgagggtacgggacgtaccgtaaccgttacgtttacgaccgtaccgggttcgggggacccgtaaccggggtacccgtcggtccccgtaacccgtcccgttccccgtaccgtaccgtcccctaccccggaaccgaacccggggtcccctaaccggtttccccggttccccccgtttacccccccggtccggtacccccgtaacccccgtttaccccgtaacccgaaacggacccgtacccgtacccgttccgggaccgggggtacccaccggacggcccggacccggtggccgttaccggccggtacggtaccgtacggtaccctacgttaccgtacggtacgccgtacggtaccggcgggtaccgggcgggtacggtacgggaccggacggtaccgacgtaggacgngngcg

SEQ ID NO: 221873 - DNA, 792 bp, Homo sapiens
  misc_feature: GYAE6OF01EBH8A.38.4.A04.1.454.CMB.1.raw
  modified_base (787)..(787): a, c, t, g, unknown or other
  misc_feature (787)..(787): n is a, c, g, or t
  modified_base (789)..(789): a, c, t, g, unknown or other
  misc_feature (789)..(789): n is a, c, g, or t
tcagtcgatcacgtcacgaccggtgctcgatttagagtagtgatcaggggggtccctgagactctcctgtgcagcctctgcattcacctttagtaacttatttaatgagctgggtcccgccagcctccgaggggaaggggctgggagtgggtggccagcaattaaccaagagtggacgtagaaaaatctatgtggactctgtaggaaggccgtattccgccatcctaccagacgaaccaacgaccaaagtaacctcacttggtcggctgaccactagtacggaaccggcctaggacggacggccgaaccggaccgaccggtcttggttacgttacctttcgtaggtcggaccggacggtaccccgcccccctagtacgggacgggtactaacggagggttacggggactaccgtaaccgtacgttttacggaaccgttccgggtacggggacccggaaccgggtaaccccttcgggtacccgacccgttcctcccgacgaccgaccccgtacccgaaccgggaccgggtaccccttaccggttccccggtttccccctttccccccggtacggtacccccctacccccgttacccgtacccggaaaccgtaccgtaccccgtacccggttccgggtcggggaccctaaccggacccgggtcccgggtccggtccgggtccctcggtaccgtacggtaccgaaccgttaccgtaccgtaccgtacgtacgacgttaccggacgtcgggaccgggcgggtacgacgggacgaaccggcgactaaggcgngngcg

SEQ ID NO: 221874 - DNA, 609 bp, Homo sapiens
  misc_feature: GYAE6OF01D23WY.38.4.A04.1.454.CMB.1.raw
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
tcagtcgatcacgtcacgaccggtgctcgatttagagtagtgatcagggggttcccgtgagactctcctgtgcagcctctgcattcgaccctttagtaactatttaatgaggctgggtccgccagcctccgagggaaggggctggagtgggtggccagcattaaccaagatggacgtagaaaaatactatgtggactctgtgaagggccgattcgcatctccagagacaacgccaagaactcactgtggctgacacatgaacggcctgagacgcgacgacacggctgtgtacttctgtgcgagacgccccagtggagggactacgaggtagggagactacgactttgacgtacgtggggccgaacgggtaaccctggtaccaccgttctcctcacgcctaccgaaccgaacggtccctacgtccggttccttcccccgtacgggaccctacccgttaccctaccgaacgtacgcctaccgtcgtacggggcacgacgccggtcccgtcgggtccgtcggcccgtaggtaaccgaacggtacctacgttaccgacgtcgacgtcgacgtcggaggtccgggcgtcggacgacggtccgtacagtangntg

SEQ ID NO: 221875 - DNA, 671 bp, Homo sapiens
  misc_feature: GYAE6OF01D76HW.38.4.A04.1.454.CMB.1.raw
  modified_base (665)..(665): a, c, t, g, unknown or other
  misc_feature (665)..(665): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactcgtgtgagggcctattcgccatctcagagacaacgcaagaactcactgtggctgcacagtcggaaccggctggaggaggcgacgacgacggtctggtcgttacttcgtggtcgcggacgacccgccccagtggacgggtctacgaggtgggactctacgtacttcgacgtacggtcggggaccgacggtacctggtacctaccgtctccgtcgacgtccctaccgaccgtacgggccctacgttcccggttcccttcccccgacgtcccctaccctccgtaccgaacggccgtacccgtaccggtcgggtcgggaccacggccggcccgggtcccgtgggtccctccggaccgttcggtaaccgtaacggttacccttaccgttaccgacggttacgaccgttaccggacgtcgggaccgggtccggggtacgtaccggggaccggaaacggggtccgtacgtaagtacgngcgtcg

SEQ ID NO: 221876 - DNA, 723 bp, Homo sapiens
  misc_feature: GYAE6OF01DLFDK.38.4.A04.1.454.CMB.1.raw
  modified_base (298)..(298): a, c, t, g, unknown or other
  misc_feature (298)..(298): n is a, c, g, or t
  modified_base (720)..(721): a, c, t, g, unknown or other
  misc_feature (720)..(721): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctggagtgggtggccagcattaaccaagatggacgtagaaaaatctatggtgactcgtgtaggaagggcctattcgccatcaccagacgacaacgcaagaactcactgtgctgcacatcgaacggctggagaggcgacgacacggctgtcgtacttcgngtgcgacgaccgccccagtggacggtctaacgaggtgggactacgtacgtactttacggaaccgttacggtcgggggaccctaacggggtaaccctcgggtaccctaccgttcctaccctaccgaccgtccccgtacccgaaccggaaccgggaccctacgttcccgggttcccccttcccccggtcggacccccttacccccgttacccgtaacccgaaaggacccgtacccgtaacccggtccgggtacgggggaccctaacccgggacgggtccccgggtacccggttcggggcccttcgggtacccggttacgggtaaccgaaacggttacccttacccggttacccgacggtacgtaaccgtaccggtacggtacgggacgggccgggcgtacgggaccgaacgggtccacgagtcnngc

SEQ ID NO: 221877 - DNA, 478 bp, Homo sapiens
  misc_feature: GYAE6OF01BMJAR.38.4.A04.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(307): a, c, t, g, unknown or other
  misc_feature (304)..(307): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagcctccagggaagggctggagtgggtgccagcattaaccaagatggacgtagaaaaatntatgtggactctgngaagggccattcgccatctcagnacaacgccaagactcactgtgctgcagntgaacggctganaggcacacnggctgtcntctgngcgagcgcccnagnggcagngngnnnntncncgngcgcgacgcgcncncncncncncncncgacgcnctcgtctcncncncncncacncncgcgtcgcgcncgcgcgcgcgcgcgcgtcgtacgacgtaccgtacgtcgcgcgtacgacgacgtacgtacgacggccggacgacgacgtacgacgagtacgacgcgcg

SEQ ID NO: 221878 - DNA, 631 bp, Homo sapiens
  misc_feature: GYAE6OF01BV7QU.38.4.A04.1.454.CMB.1.raw
  modified_base (627)..(628): a, c, t, g, unknown or other
  misc_feature (627)..(628): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgacgacgcccccatggagggctacgaggtgggagtctaacgtactttgactacgtcgggggccaacggggaaccctgggtaccaccgtctccctcgacgccctccgaaccgaacgggcccacgttcccggttccttccccccgtcgggtcccaccccttccctacccgaaacgacgcctaccgtccggtcggggccaaccgacggcccgggtcccgtcggggccgtcggcccgttcgggtaccgaaacggtaccgttacccttcccgacggtcgacgtccgacgtcggacgggccgggtcgtcgggaccgaaacgggccgacgaagtaggnngtg

SEQ ID NO: 221879 - DNA, 844 bp, Homo sapiens
  misc_feature: GYAE6OF01EPTW1.38.4.A04.1.454.CMB.1.raw
  modified_base (840)..(840): a, c, t, g, unknown or other
  misc_feature (840)..(840): n is a, c, g, or t
tcagtcgatcacgtcacgaccggtgctcgatttagagtagtgatcagggggggtccctgagactctcctgtgcagcctctgcattcacctttagtaacttatttaatgagctgggtcccgccagcctccgagggaaggggctggagtgggtggccagcaattaaccaagatggacgtagaaaaatctatgtggactctgtgaagggccattcgcatctccagagacaacgaccaaagaacctcactggtggctgacacagtacggaacggcctaggaaggacggccgaacgacgaccggtcttggttcgttaacctttcgtaggtcggaccggaacggtaccccggaccccccgtaaggtacgggacgggggtaccttaaacggagggttacggggaccgtaccgttaaccggtaccgtttttacggaacccgttacgggtacggggggaccccgtaaacgggggtaaccccttgggtaccctaacccggtccttacccgtaccgaccgtaccccttacccgaaacccggtaacccggggaccccttaaccggttccccgggtttacccccttttcccccccgggtacggtacccccctaacccccgttaccccgtaacccgaaaccggtacccgaccccggtaacccgttaccggggtccggggaacccaaccgggtacccgggccccgggtccccggtcggggtacccgttccggtacccgggttacggtaacccgtaacgggttacccttaaccgtttaccgacggttacgtaccgtaccggtacgtacgggacgggtcgggtccgtacggggaccgaagggtcccgtacaagtcgncgtg

SEQ ID NO: 221880 - DNA, 641 bp, Homo sapiens
  misc_feature: GYAE6OF01BVM5F.38.4.A04.1.454.CMB.1.raw
  modified_base (330)..(330): a, c, t, g, unknown or other
  misc_feature (330)..(330): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcaattaaaccaagatggaacgtagaaaaaatactatgtggactctgtgaaggccgattcgccatctcagagacaacgcaagaactcactgtggctgcacatgaacggcctagagaggcgacgacacggctgtgtactctgtgcgagaccgccccagtgaggctacgaggtgganactacgtacttgaccgtacgtcggggaccacgggaaccctggtacccaccgtctccctcacgccctaccaaccgaacgggcccacgtacccggttccttccccccgtcgggcccaaccccttccctaacccaaacgaccgacctacccggtccgtacgggggccaacgacggacccgggtcccggtcggtccgtcggacccgttaggtaaccgaaacggtaccttaccgttccgaacgttacggaacgttccggacgtggacgggtaccgggtccgacgggtaaccgaaacgggcgacaagtacgngngac

SEQ ID NO: 221881 - DNA, 624 bp, Homo sapiens
  misc_feature: GYAE6OF01A3QC6.38.4.A04.1.454.CMB.1.raw
  modified_base (502)..(502): a, c, t, g, unknown or other
  misc_feature (502)..(502): n is a, c, g, or t
tcagtcgatcacgtcacgaccggtgctcgatttagagtagtgatcagggggaagaccgatgggcccttggtggaggcttggtccagccggggggtccctgagactctcctgtgcagcctctgcattcacctttagtaactatttaatgagctgggtccgccagcctccaggggaaggggctggagtgggtggccagcattaaccaagatggacgtagaaaaatctatgtggactctgtgaagggccgattccgcatctccagagacaacgccaagaactcactgtggctgcacatgaacggcctggagaggcgacgacgacggctgtgtacttctgtgcgacgacgcccccagtcgaggggctacgaggtgggacgtctacgtactttgacgtacgtggggccacgggaaccctggtaccaccgtctcctcgacgccctaccaccgaacggcccacgtcccgttccttcccccgtcggaccctacccgtcctaccaacggcnccctaccgttcggtcgggggaccaccggtacggcccggtcccggtggggtccgtacggtcccgtacgggttccaaacgggtacccttaccgttcccgaacggttgactcgggtaactcgggg

SEQ ID NO: 221882 - DNA, 644 bp, Homo sapiens
  misc_feature: GYAE6OF01AYH1Y.38.4.A04.1.454.CMB.1.raw
  modified_base (319)..(319): a, c, t, g, unknown or other
  misc_feature (319)..(319): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctggtgcgagacgcccccatggagggctacgnggtgggagctacgactttgactacgtcggggccagggaaccctggtccaccgtctcctcgacgccctacccgaccgaacggggccctacgtccggttccctttccccccgtcggcccctaccccgttccctacccgaacgaccgccctacccgtccggtacgggggccaaccgacggcccgggtcccgtcggggtccgtccggtcccggttacgggtaccgaaacgggtacccttacccgttcccgaccggttacgaccgttacccggacgtcgggtacgggccggggcctgggacccggaagggcccgtacaaggtacgngngn

SEQ ID NO: 221883 - DNA, 722 bp, Homo sapiens
  misc_feature: GYAE6OF01DBMG4.38.4.A04.1.454.CMB.1.raw
  modified_base (154)..(154): a, c, t, g, unknown or other
  misc_feature (154)..(154): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (335)..(335): a, c, t, g, unknown or other
  misc_feature (335)..(335): n is a, c, g, or t
  modified_base (719)..(719): a, c, t, g, unknown or other
  misc_feature (719)..(719): n is a, c, g, or t
tcagtcgatcacgtcacgaccggtgctcgatttagagtagtgatcagggggggtccctgagactctcctgtgcagcctctgcattcacctttagtaacttatttaatgagcgtgggtccgccagcctccgaggggaaggggctgggaggtgggngccagcattaaaccaagatggacgtagaaaaatactatgtggactntgngaagggccgattcgccatctcagagacaacgccaaagactcactgtcggctgcacatgaacgcctgagacggcgacgacacggctgtgtacttgtggtgcgacgacgaccccctagtggacgggtctaacgnggtacgggacgtaccgttaacggtacgttttagaaccgttacggtcgggggaacccgaacggggtaacccttcgggtaccgaccggttcctccccttacgaccgtcccctacccgaacccgggtaacgggcccctacgtcccggtttccccttcccccgtcggtcccctaacccctccctaccgaacgaccgccgtaccggttccggcggggaccaaccggcggcccgggtcccgtcgggtccgttccggtccgttaacgggtacccgaaggttaacccgttaccgtttacccgaacgggttacgaccggttaccggaacgttcggggaaccgggtccgggtaccggtacgggtaccgaaacgggcgaaaccggtataacggcngcg

SEQ ID NO: 221884 - DNA, 713 bp, Homo sapiens
  misc_feature: GYAE6OF01CVQM0.38.4.A04.1.454.CMB.1.raw
  modified_base (708)..(708): a, c, t, g, unknown or other
  misc_feature (708)..(708): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggaggtgggtggccagcaattaaccaagatggacgtagaaaaatactatgtggactctgtgaagggccgattcgccatctccagagacaacgccaagactcactgtggctgcacatgaacggcctgagaggcgacgacacggctgtgtacttctgtgcgagacgcccccagtggagggcctacgaggtgggacgctacgtactttcgactaacgtcgggggccgaacggggtaacccctgggtccacccggttccttcccgtcacggtcccctacccgaacccgtaacggggccccgtaacgttcccgggttaccccgtttcccccccgttccgggaccccctacccccgttacccctaccccgaacggtacccgtacccgaaccccgttccggtacgggggacccgacccgaacggcccgggtccccgggtcggggtccgtccggtccggtccgggtccggtaaacgggtaacccttaccgtttccccgtaacggtcgtacgttaccgaccgtacggacgggccggggtcgttcggggaaccgtaacgggccggtacagttaacggngtgcg

SEQ ID NO: 221885 - DNA, 588 bp, Homo sapiens
  misc_feature: GYAE6OF01AF7VK.38.4.A04.1.454.CMB.1.raw
  modified_base (329)..(329): a, c, t, g, unknown or other
  misc_feature (329)..(329): n is a, c, g, or t
  modified_base (585)..(586): a, c, t, g, unknown or other
  misc_feature (585)..(586): n is a, c, g, or t
  modified_base (588)..(588): a, c, t, g, unknown or other
  misc_feature (588)..(588): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaagactcactgtggctgcacatgaacggcctgagaggcgacgacacggctgtgtacttctgtgcgagacgcccccagtggacgggctacgaggtgggancgtacgtactttgactacgtcggggccgacgggaaccctggtccaccgtctcctcgacgccctaccacccgaacgggccctagtccggtcccttcccccgtcgggccctaccctccgttaccaacggcgccaccgttccggtcggggccaccgacggcccgggtcccgtcgggcctcggccgtcgggtacaacggtcctaccgttccgacgtcgacgtcgacgtggacggtcgggctcgggacacgggcgacatgnngn

SEQ ID NO: 221886 - DNA, 727 bp, Homo sapiens
  misc_feature: GYAE6OF01A90UY.38.4.A04.1.454.CMB.1.raw
  modified_base (723)..(723): a, c, t, g, unknown or other
  misc_feature (723)..(723): n is a, c, g, or t
  modified_base (725)..(725): a, c, t, g, unknown or other
  misc_feature (725)..(725): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctcgagggaaggggctggagtgggtggccagcattaaccaagatggacgacgaaaaatctatgtgactctgtgaaggccattcgccatcctcagaagacaacgcaagaactcactgtgctgacacagtgaacggcctggagaggcgaacgacgtacggctagtcgttacttcctgtcggcgagtaccgcccccagtaggacgggtcctagtaaggtggggacgtaccgttaacggtacgtttaggaaccgttaaccgggtcgggggacccacggggtaacccctgggttacccacccggttcctacccgtaccgacgtaccccttacccgaaccgaaccgggtcccctaacggttccccggttccccgttaccccccgttcgggtaaccccctaccccgttacccgttaaccccgaaaggtacccgtacccgtacccggttccgggtaccgggggaccctaaccggaccgggtaccccggtcccggtcgggtcccgtccgggtccggtaccgggttaaccaaaccgggttacccttacgtacccgtacggtcgtaccgtacgtaccgtgacgggccggcgtgaccggagccacgatacgntncg

SEQ ID NO: 221887 - DNA, 634 bp, Homo sapiens
  misc_feature: GYAE6OF01DC5M3.38.4.A04.1.454.CMB.1.raw
  modified_base (338)..(338): a, c, t, g, unknown or other
  misc_feature (338)..(338): n is a, c, g, or t
  modified_base (630)..(630): a, c, t, g, unknown or other
  misc_feature (630)..(630): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggaggtgggtggccagcattaaaccaagatggacgtagaaaaatactatgtggactctgtgaagggccgattcgccatctccagagacaacgccaaagaactcactgtggctgcacatgaacggcctgagaggcgacgacgacggctgtgtacttcgtgtcgcgacgcgcccccagtggagggctacgaggtgggacncgtacgtactttgacttacgtcggggaccacgggaaccctggtccacccgttctcccgtcacgtccctacccgaaccgaacggggcccctacgtcccggttcccttccccccgtacggcccctacccctccctaccgaacgacgcctacccgttcggtcggggaccacgacggccggcccgtgggcctcggccgtgggtaccaaacggtaccttaccgttccgacgttacgacgttacggaccgttcgggacggtccggggtacgtcggacgaacgggccgtaacagtacgntgcg

SEQ ID NO: 221888 - DNA, 704 bp, Homo sapiens
  misc_feature: GYAE6OF01DDP8B.38.4.A04.1.454.CMB.1.raw
  modified_base (699)..(699): a, c, t, g, unknown or other
  misc_feature (699)..(699): n is a, c, g, or t
  modified_base (702)..(702): a, c, t, g, unknown or other
  misc_feature (702)..(702): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggagtgggtggccagcattaaccaagatggacgtagaaaaatctatgtggactctgtgaagggccattcgccatctccagagacaacgccaaagactcactgtggctgcacatgaacggcctgagaggcgacgacacggctgtgtacttctggtgcgagacgcccccatggacgggctaacgagggtggggactacgtacgttacgttacgacgtacgggcgggaccggaacggtacccgtacggtacccgtccgttcctacctacgaccgtaccctacccgaaccgggaccggaccctacggttcccggttcccccttccccggcggacccctaccccgtaccgtaaccgaacgtaccgaccgtacccggtcggggtaccgggacctaccggaccgggtccccgggtaccgggttcggtaccggttccggtaccgggtacgggtaaccggtaaacggttacccgttacccgttaccggtacgttacggtaccgttaccggacggtacgggaccgggtccgggtacggtacgggaacggacgggtaccagacgtagngancg

SEQ ID NO: 221889 - DNA, 636 bp, Homo sapiens
  misc_feature: GYAE6OF01CUCXR.38.4.A04.1.454.CMB.1.raw
  modified_base (337)..(337): a, c, t, g, unknown or other
  misc_feature (337)..(337): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcaattaaccaagatggacgtagaaaaatactatgtggactcgtgtgaagggccattcgcatcctcagagacaacgcaagaactcactgtgctgcacatgaacggctgagaggcgacgacgacggcttgtgtaccttcgtggtcgcgacgaccgccccctagtggagggctacgaggtggggancgtacgtactttgacgtacgtggggcccgaacgggtaccctggtccaccgttcctcctcgacgtccctaccaaccgaacgggccctacgtccggtcccttccccgtacggcccctacccgtcctaacccgaagtacgccgtacccgtacggtacggggaccaaccggaccggccgggtcccggtacgggtcctcggtcccgtagggtaccgtaacggtaccgttacccgttccggaacgtcgtacgtcgtacgtggacgggcgggtcgtcgggaacgtacgggaccganaggtgngngn

SEQ ID NO: 221890 - DNA, 653 bp, Homo sapiens
  misc_feature: GYAE6OF01D6SQN.38.4.A04.1.454.CMB.1.raw
  modified_base (651)..(652): a, c, t, g, unknown or other
  misc_feature (651)..(652): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcaattaaccaagatggacgtagaaaaatactatgtggactctgtgaaggccgattccgccatctaccagagacaacgccaaagaactcactgtggctgcacatgaacggctgagaggcgacgacacggctgtgtactttctggtgcgagaccgcccccagtggagggctagaggtgggagtccgtacgtacttttcgaacgttacggtgggggacccaaggggtaacttcccgtggtacccacccgttcctacctccgacgtcccctacccgaacccgaaccgggtacccctacgttcccgggttcccctttcccccccggtcggtacccctacccccttcccctacccgaaacgaccgacccgtacccgtcggtcggggaccaccgacggccggcccgtcgggcctcggtccgtcggtacgaacggtaccttaccgttccgacgtgacgtccgtacgtggacggccgggtcgtacggacgaacgggccgagactgnng

SEQ ID NO: 221891 - DNA, 613 bp, Homo sapiens
  misc_feature: GYAE6OF01B7R36.38.4.A04.1.454.CMB.1.raw
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccaggggaaggggctggagtgggtggccagcattaaaccaagatggacgtagaaaaatctatgtggactctgtgaagggccattcgccatctccagagacaacgccaaagaactcactgtggctgcacatgaacggcctgagaggcgacgacacggctgtcgtacttctgtgcgagacgcccccagtggacgggctacgaggtgggatcgtacgtactttgaacgttacggtggggcccgaacggggaccctggtccgaccgtctccctcgacgccctaccgaacccgaacgggccccacgtcccggttcccttcccccgtacggcccacccctccctacccgaacgccgaccgtacccgtcggtcgggggccaccggacggccggcccgtgggccgtcggccgtggtacgacggtaccttacctccgacgtagactcgacgtcgg

SEQ ID NO: 221892 - DNA, 628 bp, Homo sapiens
  misc_feature: GYAE6OF01A2S1H.38.4.A04.1.454.CMB.1.raw
  modified_base (626)..(627): a, c, t, g, unknown or other
  misc_feature (626)..(627): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtcgtacttctgtgcgagacgcccccagtggagggctacgaggtgggacgccgtacgacttttggaaccttacgtcgggggacccaaggggtaacccctgggtccaccgttctccctcacgtccctacccaccgaacgggcccctagtccggttccctttccccccgtcggccctaccccgttccctacccgaacggacgcctacccgtcggtcggggccaccgacggccgggcccgtcggggcctcggtccgtcgggtaccgaacggtaccttacccgttcccgtacggtcgtacgtccgacgtcggacggcggggcgtagggccgaacgggccgactagtacggnng

SEQ ID NO: 221893 - DNA, 659 bp, Homo sapiens
  misc_feature: GYAE6OF01DFFUC.38.4.A04.1.454.CMB.1.raw
  modified_base (107)..(107): a, c, t, g, unknown or other
  misc_feature (107)..(107): n is a, c, g, or t
  modified_base (335)..(335): a, c, t, g, unknown or other
  misc_feature (335)..(335): n is a, c, g, or t
  modified_base (656)..(656): a, c, t, g, unknown or other
  misc_feature (656)..(656): n is a, c, g, or t
  modified_base (658)..(659): a, c, t, g, unknown or other
  misc_feature (658)..(659): n is a, c, g, or t
tcagtcgatcacgtcacgaccggtgctcgatttagagtagtgatcagggggggtccctgagactctcctgtgcagcctctgcattcacctttagtaacttatttaangagctgggtcccgccagcctccgaggggaaggggctggaggtgggtggccagcaattaaccaagatggaacgtagaaaaatactatgtggactctgtggaagggccgattcgccatcctcagagacaacgccaaagaactcacgtgtggctgcacagtgaacggcctgagaggcgacgacacggctgtgtacttcgtgtcgcgagacgccccagtggacggctaacgnggtagggacgtcgtacgtactttcgacgtacgtcggggaccacgggaaccctggtaccaccgttcctacccgtcgacgtccctaccgaaccgtaaccggggccctaacgttcccggttcccttcccccgtacggacccctaccccttacctacccgaacgacgccctacccgtcgtacggggaccaacgacggccggtcccgtcgggtacctcggtaccgtacgggtaacggtaccttaccgttacccgacggtacgtacgtaccgaacgttcggaacgggtccgggtgtccgggaacggtacggacgacgaacgtaggcngnn

SEQ ID NO: 221894 - DNA, 590 bp, Homo sapiens
  misc_feature: GYAE6OF01EP5QR.38.4.A04.1.454.CMB.1.raw
  modified_base (256)..(256): a, c, t, g, unknown or other
  misc_feature (256)..(256): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
tcagtcgatcacgtcacgaccggtgctcgatttagagtagtgatcagggggggtccctgagactctcctgtgcagcctctgcattcacctttagtaacttatttaatgagctgggtccgccagcctccgagggaaggggctggagtgggtggccagcaattaaaccaagatggacgtagaaaaaatctatgtggactctgtgaagggccattcgccatctcagagacaacgccaaagaactcactgtggctgacanatgaacggcctgagaggcgaacgacacggctgtgtacttctgtgcgagacgcccccatggagggctacgaggtggganctacgactttgacttacgnggggacccaagggaaccctggtccaccgttctccctgacgtccctaccgaccgaacgggccctacgtccgtccttcccccgtcggccctaccctccctaccgaacgacgccacccgtcgtcggggaccacgacgccggacccgtgggcctcggccgtggtacaacggtaccttacctccgacgtcgacgtccgacgtggacggcgggcgtcggacgaagggccgacgaatagngcgn

SEQ ID NO: 221895 - DNA, 947 bp, Homo sapiens
  misc_feature: GYAE6OF01DSGL3.38.4.A04.1.454.CMB.1.raw
  modified_base (944)..(944): a, c, t, g, unknown or other
  misc_feature (944)..(944): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcaattaaccaagatggacgtagaaaaattactagtgtggactcgtgtaggaacgggccgtattccgccatcctaccagacgacaacgaccaaagaacctcactggtcggctgcacgagtggaaccggccgtaggaggacggacgacgacgacggcttggtcttactttcgtggtacgcggtacgacccgaccccccgtagtacgggacgggtaccttaaccggagggtacggggaacgtaccgtttaaccggttacgtttacggtaaccggtaccgggttaccgggggacccgtaaacccggggtaaccccggtttcgggtacccctacccgttcccgttaccccgtaccgtacccggtacccccgtaaccccggaaaccccggtaaacccggggtccccctaacccggtttccccgggttttacccccccgtttacccccccggtttccgggtaacccccccgtaacccccccgtttaccccgtaaccccggtaaaccggtacccgtaccccggttaaccccgggttacccggggtaccgggggaaccccgtaacccggaacccggggtcccccgggttccccgggttacccggggtccctttcccgggtaccccgtttacggggttaacccccttaaacccgttttaccccgttttaacccccgggaaccggtttccggtaaccgggttaccccggtaaccggttacgggggaaccccggggtcccggggtacgggttaccgggaacccggggtaaccggcccggtagttaacggtacgagttcgngcg

SEQ ID NO: 221896 - DNA, 700 bp, Homo sapiens
  misc_feature: GYAE6OF01CPNAI.38.4.A04.1.454.CMB.1.raw
  modified_base (629)..(629): a, c, t, g, unknown or other
  misc_feature (629)..(629): n is a, c, g, or t
tcagtcgatcacgtcacgaccggtgctcgatttagagtagtgatcagggggagattcccaggtgtttccattcagtgatcagcactgaacacagaggactcaccatggagttgggactgagctggtatttttccgtttggacttaagttttaaaaggtgtccagtgtgaagtgcagctggtggagtcggtgggggagtcgttggacagccgtggcacggtccctgacgctctccgtgtgcacgcctgtggtattcgagttcgtttagagttagtattacgtggactagtcgacgtacggtcgggaccagacgaacgtccgtaccggaaggggtaacggtccgtaggtacgggtcggtacctaggtaaggttagttaggtacgaaggtggtaggtagagtaggtctagtggcgtactcggtagacggtaggaccgtatcagtactactcacgagacgtaaccgacgaactaaactaccttccgtaagtaacttactaaagaagtacgaaacgtcgttagacgacggtacgacgttacggaaccgggtactaaccggtttaccttaagttaacgttacggttacgaacgtaaaagtttaaaaggtttcgtttaaaggttacgggtttaaanagggtttaaacggtaacggtttacctaaaccgttagggtaaccggttaggtccgggtaaccggttacgggg

SEQ ID NO: 221897 - DNA, 657 bp, Homo sapiens
  misc_feature: GYAE6OF01AHCEX.38.4.A04.1.454.CMB.1.raw
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (653)..(653): a, c, t, g, unknown or other
  misc_feature (653)..(653): n is a, c, g, or t
tcagtcgatcacgtcacgaccggtgctcgatttagagtagtgatcagggggtccctgagactctcctgtgcagcctctgcattcacctttagtaactatttaatgagctgggtccgccagccctccgaggggaaggggctgggagtgggtggccagcattaaccagatggacgtagaaaaatctatggtggactctggtggaacgggccattccgccatctccagagacaacgaccaagaacctcacgtgtgctgcaacagnggaccggctggacgaggcgacgagcgtntgtctactgtggcgacgacgcccgaccgnggnggacggactacggnggtagggactaccgtagtacgttacgtaccgtcggggaccggaccggaccgggtaccgtcgtaccgtaccgtctcctccgactccccgaccgaaccggtaccggccttcggtcccgttccccgtcccgcgtaccccctcctaccgactaacggcctaccgtacggtccgggacggtaccgaccggcggtcccgccggtcgggtacctcgtaccgggttaacggaaccgtaaccgtaccgtttacccgtaccgtacgtagttacccgacgggtaccgtcgggaccgggtcggacgtacgggacgcggctacggaatgntcgg

SEQ ID NO: 221898 - DNA, 538 bp, Homo sapiens
  misc_feature: GYAE6OF01CG3ZL.38.4.A04.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (372)..(372): a, c, t, g, unknown or other
  misc_feature (372)..(372): n is a, c, g, or t
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (533)..(538): a, c, t, g, unknown or other
  misc_feature (533)..(538): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggcaactatatcatatgatggaagttttaaagactatgcggactccgtgaagggccattcaccatctccagagacaattccaagngcacactctatttgcaaatgaacagcctgggganctgaggacacggctgtctattactgtgacgaaagaacccggcctctagtgggtcgggtattagtgtcgtggggccagggaaccctggacccaccgtctcctcncgccctaccaccgacgggcccctagtccggtccttcccccgnggcccgtccctgcctccgaggcaccacctcgagcgcacncgccgccgtggctcgcctggacacggtacctcgtaccacgtnactcgactggagccgggcgtggacgaggcgananagcnnnnnn

SEQ ID NO: 221899 - DNA, 712 bp, Homo sapiens
  misc_feature: GYAE6OF01B8NH2.38.4.A04.1.454.CMB.1.raw
  modified_base (223)..(223): a, c, t, g, unknown or other
  misc_feature (223)..(223): n is a, c, g, or t
  modified_base (659)..(659): a, c, t, g, unknown or other
  misc_feature (659)..(659): n is a, c, g, or t
  modified_base (709)..(709): a, c, t, g, unknown or other
  misc_feature (709)..(709): n is a, c, g, or t
tcagtcgatcacgtcacgaccggtgctcgatttagagtagtgatcgagggggggtccctgagactctcctgtgcagcctctgccattcacctttagtaacttatttaatgagctggtccgccagcctccgagggaagggctgggagtgggtggccagcaattaaccaagatggacgtagaaaaattctatgtggaactctgtgaacgggccattcgccatccncagagacaacgccaaagaactcactgtggctagcacatcggaacggcctaggagcggcgacgacacggtctggttgtactttcgtggtcgaccgacgaccgacccccgagtcgggacggtctaaccgagggttacgggactccgtaacggttacgtttacggacgttacgggtcggggacccgtaacgggtaaccccgttgggtccctaacccggttcctccctacgaccgtccccgtacccgaaccggtaaccgggaccctacggttcccggtttccccgttccccccgtagggtacccctaaccccgttccgtaaccgaagtaccgtcctaccggttcggaccgggggacaaccggacggtcccggtcccggtcgggtaccttccgggtccgttacgggtaccgtaacggtaccgttaccgtaccgtacggtanacgttcgacgtcggcggacggtcctagggactacgggcacgtagtagcgntcg

SEQ ID NO: 221900 - DNA, 773 bp, Homo sapiens
  misc_feature: GYAE6OF01BA9BT.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccgagggaggggctggagtgggtggccagcattaaccaagatggactagaaaaatctatgtggactctgtgaaggccattcgcatctacagagacacgacaagaactcactgtggctgcacgatgaacggctaggagaggcgacgacgacggctgtgtacttcgtgtgcgacgaccgaccccgagtggacgggtcctacgaggtcgggacacgttaacgtacgtttacgaacgttacggtcggggaccgtaacgggtaaccctcggtacctaccggtcctccgtacgaccgtccctaccgaaccggaccgggtacccctacgttacccggttccccttccccccggtacggtaccccctaccccgttacccgtaacccgaacggtacccgtacccgtacccggttcgggtaccgggggaaccctaccggtaccgggtccccgggacccgggtttccggggtaccgttaccgggtacccgtttacggggtaaacccgtaaaccgggttaccctttaacccggttacccggtaacgggtttaccgtaccggttaccggtaaaccgggtcgggtaacccgggggacccgggttaccgggtaccggggaaacggaacccggggtacctaaccggttaagtacggcgtggacg

SEQ ID NO: 221901 - DNA, 691 bp, Homo sapiens
  misc_feature: GYAE6OF01DXM6R.38.4.A04.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (686)..(686): a, c, t, g, unknown or other
  misc_feature (686)..(686): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaaccaagatggaacgtagaaaaatactatgtggactctgtgaagggccattcgccatcnccaganacaacgccaagactcactgtggctgcacatacggaacggcctgagacggacgacgacacggctggtcgtacttcgtgtcgcgacgaccgcccccgagtaggacgggctacgaggtgggagcgtaacggtactttcgacgtacggtcggggacccgaacgggtaacccgtcggtacctaccgtctacccgtcacgtcccctaccgaaccgaacgggtcccacgttcccggttacccctccccgtcggtacccctacccgtccctacccgaaagaccgtcccgtaacccgttcggggtcggggaccaaccggtacgggcccggtccggttacggggccttacggccggttacggtaccgtaacgggtacctttaccgtaccgacgtcgtaccgtacggtaccggtcgggacgggtccggggtcgtacgggaaccggtaacgggccgtaacggtaacgtcggntgacg

SEQ ID NO: 221902 - DNA, 577 bp, Homo sapiens
  misc_feature: GYAE6OF01BT25D.38.4.A04.1.454.CMB.1.raw
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
  modified_base (553)..(553): a, c, t, g, unknown or other
  misc_feature (553)..(553): n is a, c, g, or t
  modified_base (573)..(574): a, c, t, g, unknown or other
  misc_feature (573)..(574): n is a, c, g, or t
  modified_base (576)..(576): a, c, t, g, unknown or other
  misc_feature (576)..(576): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaggccgattcgccatctcagagacaacgccaagactcactgnggctgcacatgaacggcctgagaggcgacgacncggctgtgtacttcgtgtgcgagacgcccccagtgagggctacgaggtgggatctacgtactttgactacgtcggggaccacgggaaccctggtccaccgttcctccctcacgccctaccgaccgaacgggccctacgtcccggttcccttccccccgtggcccctaccccgtcctaccgaacgcgccaccgtcgtacggggcacgacgcccggccgtcggcctcgccgtgtacgaacggtactacctccgacgtcgactccgacgtcggaggcgggtcgnggaccgaaggcgacagtcgnngng

SEQ ID NO: 221903 - DNA, 626 bp, Homo sapiens
  misc_feature: GYAE6OF01ACR9V.38.4.A04.1.454.CMB.1.raw
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (623)..(624): a, c, t, g, unknown or other
  misc_feature (623)..(624): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcaattaaccaagatggacgtagaaaaatctatgtgactctgtgaagggccattcgcatctccagagacaacgccaagactcactgtgctgcacatgaaccgctggagaggcgacgacacggctgtcgtacttctggtcgcgacgaccgccccgatggaggctacgnggtgggacncgtacgtctttgaacgttacgtggggccaacgggtaaccctggtccaccgtctccctcgacgccctaccgaaccgaacggccctacgtcccggttcccttcccccgtcggtcccctaccctacccgtaccgaacgaccgtaccctaccgtccggtcggggaccacggtacggcccgggcccgtgggccgtcggcccgttacgggtaccgaacggtaccttaccgttacccgtacgtcgtacgtaccgacgttcggacgggtcgggtcgtcgggaacgacggccggacagtacgnngc

SEQ ID NO: 221904 - DNA, 740 bp, Homo sapiens
  misc_feature: GYAE6OF01E5WAS.38.4.A04.1.454.CMB.1.raw
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccgaggggaaggggctgggagtgggtggccagcaattaaaccaagatgggacgtagaaaaatactatgtggactctgtggaagggccattcgccatctcagagacaacgcaagactcactgtggctgcacagtcggaaccggcctaggaggacgggcgaccggacgacggtctggtcgttaccttcgtggtcggaccgacggacccgccccctaggtgggacggggtactaacggagggttggggaacgtccgttacggtaacgttttacggaaccgttaccgggtacggggggacccgaaccggggtaaccccgttgggtaccctacccggttcctccccgtacgaccggtcccctaacccgaacccgggtaaccgggtccctaccggttcccggttccccgtttccccccgtcgggtcccctaccccgtcccgtaccgaacggtaccgacccgtaccgtccgggtacggggccaccggacggcccgggtccgtcggggtccgtcggtcccggttacggtaccgaacggtaccttaccgttacccgacggtcgtacgtcggacggtcggacggggcggtcgtacgggacgtaacgggccgtagtagtgngntg

SEQ ID NO: 221905 - DNA, 585 bp, Homo sapiens
  misc_feature: GYAE6OF01C5A3H.38.4.A04.1.454.CMB.1.raw
  modified_base (106)..(106): a, c, t, g, unknown or other
  misc_feature (106)..(106): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcagggggggtccctgagactctcctgtgcagcctctgcattcacctttagtaactatttaangagctgggtccgccagcctccgaggggaaggggctgggagtgggtggccagcattaaccaagatggacgtagaaaaatactatgtggactctgtgaagggccgtattcgccatctcagagacaacgccaagaactcactgtggctgcacatgaacggcctggagaggcgacgacacggctgtgtacttctggtgcgagacgccccccagtcggagggctacgaggtgggagctacgactttgacttacgtgggggacaacggggtaccctggtccaccgtctcctnacgcctaccaccgaggcccagtccgtcttcccccgngccaccctcctccgaagcgtccaccgtcgtcggggaccacgcggccggccgtgggcctcgccgttagggtaaaccggacttaccgttccaggttacgagtccgacgtcggacggcgggtcgtcgggaccgtaagggccgtacctagtagcngngacg

SEQ ID NO: 221906 - DNA, 761 bp, Homo sapiens
  misc_feature: GYAE6OF01DP40Q.38.4.A04.1.454.CMB.1.raw
  modified_base (237)..(237): a, c, t, g, unknown or other
  misc_feature (237)..(237): n is a, c, g, or t
  modified_base (756)..(756): a, c, t, g, unknown or other
  misc_feature (756)..(756): n is a, c, g, or t
  modified_base (758)..(758): a, c, t, g, unknown or other
  misc_feature (758)..(758): n is a, c, g, or t
  modified_base (760)..(760): a, c, t, g, unknown or other
  misc_feature (760)..(760): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggagggctggagtggtgccagcattaacaagatggacgtagaaaatctatgtggactctgtgaagggccgattcgccatctccagagacaacgccaagactcacgtgnggctgcacatgacgctgagaggcgacgacacggctgtgtacttcgtaggtcgacgagaccgccccctaagtggacggtctaacgtagggtacgggacgaccgtaaccgtacttttacggacgttaccggttcgggggaaccctaaccggggtaacccctttgggtaccctaacccggttccctcccgtacgaccgtaccccgttacccgaacccgggtaacggggtacccctaacggttccccggttaccccgtttccccccggtacgggtacccctacccccgttacccgtaacccgtaaaccggtaccgacccgtaacccggttccgggtaccgggggaccctaaccggacccgggtacccgggtccccgggtaccgggtccgttccgggtacccgttacgggttaaccggtaacggttaacccgttaccgttacccgtaacggttcgtaaccgttccgacgtacgggacggtcgggtaccggtacgggaccgaacgggtccgtaacgagttacggngngng

SEQ ID NO: 221907 - DNA, 572 bp, Homo sapiens
  misc_feature: GYAE6OF01B6HGY.38.4.A04.1.454.CMB.1.raw
  modified_base (192)..(192): a, c, t, g, unknown or other
  misc_feature (192)..(192): n is a, c, g, or t
  modified_base (348)..(348): a, c, t, g, unknown or other
  misc_feature (348)..(348): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactntgtgaagggccattcgccatctccagagacaacgccaagaactcactgtggctgcacatgaacggcctgagaggcgacgacacggctgtgtacttctgtgcgagacgcccccatggagggcctacaggtgggacgctaacgtactttgactacggnggggccacgggaaccctggtcaccgtctcctcacgccctccaccgacggcccagtccggtccttcccccgtggcccaccctcctaccaacgacgtccgacccgtcgtcgggggccacgacggcccggtcccgtgggcctcgcccgtaggtaccaaggtacctacgttccgacggtcgacgtacgcgtggaggcgggtctacggcgaacggccgacagtacngnn

SEQ ID NO: 221908 - DNA, 731 bp, Homo sapiens
  misc_feature: GYAE6OF01D3Y75.38.4.A04.1.454.CMB.1.raw
  modified_base (415)..(415): a, c, t, g, unknown or other
  misc_feature (415)..(415): n is a, c, g, or t
  modified_base (728)..(728): a, c, t, g, unknown or other
  misc_feature (728)..(728): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgaggggaaggggctgggagtgggtggccagcattaaccaagatggacgtagaaaaatactatgtggactctggtggaacgggccgattccgccatcctccagacgacaaccgccaagaactcactgtcgctgcacatgaacggctgagaggcgacgacgacggctgtgtacttcgtgtcgcgacgaccgcccccgagtggacgggtctacgaggtcgggacgtacgtacgtactttcgaccgtacggtcggggaccgaacgggaaccctggtacctaccgtcctccncacgtccctacccgaccgaacggccctaacgtcccggttaccccttcccccgtcgggcccctaccccgtaccctacccggaaacgaccggtaccctacccggtaccgggtccgggggtaccaaccgggtacgggccccggccccgggttcggggccgttcccgggtacccggtttcgggtaaccgaaaccgggttaaccccttacccgtttacccggtaccggttacggaaccgttccggtaaccggtcggggtaacgggcccgggtccggtacggggaacccgggaccgggaccggaccgttaagacggagncgg

SEQ ID NO: 221909 - DNA, 570 bp, Homo sapiens
  misc_feature: GYAE6OF01BUTFS.38.4.A04.1.454.CMB.1.raw
  modified_base (567)..(568): a, c, t, g, unknown or other
  misc_feature (567)..(568): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggcgattcgccatctccagagacaacgccaagaactcactgtggctgcacatgaacggcctgagaggcgacgacacggctgtgtacttctgtgcgagacgcccccagtcgagggctacgaggtcgggagctacgtactttgactacgtggggccacgggacccgtggtcaccgtctcctcacgcctccaaccgacgggccctacgttccggttcccttccccccgtcggaccctaccctcccgtaccaacgacgtccgacctcggtcgggggccacgcggcccggccgtcgggcctcgccgtggtacacggacctacgtccacgtgactcgacgtcggagcgggcgtggcgaacggcgtacagtcgnngc

SEQ ID NO: 221910 - DNA, 649 bp, Homo sapiens
  misc_feature: GYAE6OF01DWMEZ.38.4.A04.1.454.CMB.1.raw
  modified_base (327)..(327): a, c, t, g, unknown or other
  misc_feature (327)..(327): n is a, c, g, or t
  modified_base (645)..(645): a, c, t, g, unknown or other
  misc_feature (645)..(645): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagactcactgtggctgcacatgaacggcctgagaggcgacgacgacggctgtgtacttctgtgcgagacgccccagtgagggctacgaggtgggngtctacgtacgtttgactacgtcggggaccagggaacccctggttaccaccggttcctccctacgcgtccctacccgaacccgaacgggcccctacgttacccggttccctttccccccgtcgggcccctacccccttcccgtaccgaacgaccgtccgtaacccgtcggtcgggggaccaaccgtacgggcccgggtcccgtcggggcccttcggtcccgttcgggtaccgtaaacggtacccttaccgttccgaaccgttcgtacgtccggtacgtcggacggcgggtcgcgggtccgaagggcccgacgagtcgngtgc

SEQ ID NO: 221911 - DNA, 747 bp, Homo sapiens
  misc_feature: GYAE6OF01BSHID.38.4.A04.1.454.CMB.1.raw
  modified_base (214)..(214): a, c, t, g, unknown or other
  misc_feature (214)..(214): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccagggaaggggctggagtgggtggccagcaattaaccaagatggacgtagaaaaatctatgtgactctgtgaggccattcgccatcncagagacaacgccaagaactcactgtggctgcacatgaacggcctgagaggcgacgacacggctggtgtacttctgtgacgacgccgccccctagtggacgggtctacgagggtgggacgtacgttaacggtactttcggaaccgttacggtcgggggacccgaacggggtaacccctgggtaccctacccggttcctacccgtacgtaccgccccgtacccgaacccgggtaaccgggccccctaacggttccccggttccccctttccccccggtacggtaccccctaacccccgttaccctaacccgtaaacggaccgtacccgtacccgttaccgggtccgggggaaccctaccggaccggcccgggtaccccggtcggggtacccgttaccggtcccggttacgggtaaccgtaaacggttaacccgttacccgttaccccgtacggttacgtaccgtaccgggtaccgttacgggacgggtccgggtcggtaccggaacggaccgggtcgactaaggtacgngntcg

SEQ ID NO: 221912 - DNA, 603 bp, Homo sapiens
  misc_feature: GYAE6OF01A6T91.38.4.A04.1.454.CMB.1.raw
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (593)..(603): a, c, t, g, unknown or other
  misc_feature (593)..(603): n is a, c, g, or t
tcagtcgatcacgtcacgaccggtgctcgatttagagtagtgatcagggggggtcccgtgagactctcctgtgcagcctctggattcacctttagcagctatgccatgagctgggtccgccaggctccagggacgggtctggagtgggtctcacttatcagtaatagtggtggtaccacattcgacgcagactccgtggaagggccggttcaccatctccagagactaattccaagaaccacactatacctgacaaatgaagaccctgagagccgaggacacggccatatattactgtgtaggaaggggcgacggggtnaccgtccgtggggccgaagggaccctggtcaccgtctcctacngccctccaccgaacggcccagtcggtcccttcccccgtcggccctacccctccctaccgaacgacgacccacccgtccggtacgggggcctacccgacggcccgggcccgtcggggtccgtcggtcccgtcgggtaccgaacgggtaccttaacccgttcccgacgttcgacgtaccgtacgtacggacggtcgggcgtacgggacgtacgggccgacgtagtagngncgnnnnnnnnnnn

SEQ ID NO: 221913 - DNA, 581 bp, Homo sapiens
  misc_feature: GYAE6OF01BQLUX.38.4.A04.1.454.CMB.1.raw
  modified_base (579)..(580): a, c, t, g, unknown or other
  misc_feature (579)..(580): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgcccccagtggagggctacgaggtgggagctacgtactttgactacgtggggccagggaccctggtcaccgtctcctcacgcctccaccgaacgggcccagtccggttcccttcccccgtcggccctacccctccctaccaacgacgccacccgtcgtcgggggccacgcggccgggcccgtcgggcctcggcccgtggtaccaacggtacctaccgttccgacggtcgacgtccgacgtcggaggccggggtcgtcgggacgaacgggccgacgagtagnnc

SEQ ID NO: 221914 - DNA, 578 bp, Homo sapiens
  misc_feature: GYAE6OF01BGVJE.38.4.A04.1.454.CMB.1.raw
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
  modified_base (487)..(487): a, c, t, g, unknown or other
  misc_feature (487)..(487): n is a, c, g, or t
  modified_base (555)..(555): a, c, t, g, unknown or other
  misc_feature (555)..(555): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgccatctccagagacaaccgcaaagaactcactgtgctgcacatgaacggcctgagaggcgacgacacggctgtcgtacttntgtgcgagaccgcccccagtggacggctacgaggtgggagctacgtntttgactacgtcggggccacgggtacctggtcaccgtcncctcacgcctaccacgacggaccctacgtccggttccttcccccgtcggacccaccctcctaccgaacgacgccacccgttcgcggggacctacgacggcccgtccgngggcctcggccgtggtaaccgacgtactaccttaccgcggtatacgtcgacgtcgaggcgggtaccgnggaccgaggccganatcgngncg

SEQ ID NO: 221915 - DNA, 743 bp, Homo sapiens
  misc_feature: GYAE6OF01C6VEV.38.4.A04.1.454.CMB.1.raw
  modified_base (741)..(742): a, c, t, g, unknown or other
  misc_feature (741)..(742): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaaggccgtattcgccatctccgagagaacaacgaccaaagaactcactggtcggctgcacagtaggaaccgccgtaggaggacggaccgacgtacgacgggtcttggtacttactttctggtcgacggagacgccctacccacgttggacgggtactacggagggtcgggaactccgtaagtactttacgaccgttacgggtccgggggacctaacggggtaaccccgttcgggtaccctacccggtttccctcccgtacgtaacccgtccccgtaaccccgaaaccggtaacccgggtaccctacggtttccccgttacccccgtttcccccgtacccggtaccccctaaccccgttcccgtaaccgaacgtaccgacccgtacccgtcgggtaccggggaccaccggaccgggcccgggtcccgtgggtaccgtccgtaccggttacggaaccgttaacggtacccttaccgtccgtacggcgtacgtacggtacgcgggacgggtcgggaccgtaggaccgtaacgggcgaacaggtgnng

SEQ ID NO: 221916 - DNA, 848 bp, Homo sapiens
  misc_feature: GYAE6OF01BOF2F.38.4.A04.1.454.CMB.1.raw
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagcgtgggtccgccagcctccgaggggagggctggagtgggtgcagcattaaccaagatggacgtagaaaaatctatgtgactcgtgtaggaacgggccgtattccgcctatctaccgaaggagaccaacgccaaagaactcagtggtggctgacactagtcggaaccggcctaggaggacgggaccgaaccggtacgacggtcgtagtcgtttacttcgtgtacgacgtacgacccgccccaggtggaacgggtcctacggtagggtacggacgtaccgtacggtacgttttacggaccgttacgggtccggggaccgtaaccggggtaccccgttacgggttaccctacccgggtttacccttaccccgtaccggtacccgtaccccgttaaccccgtaaccggggaacccggggtaccccctaaccgggtttacccccggtttacccccggtttccccccgtacggacccccgttaaccccccggttacccttaacccgggaaaccgtacccggttacccctaacccggggttccgggtaccggggacccaccggtaccgggtccccgggtcccggttaaccggggtccgttcccggtacccgggttacggtacccgaaacccgggtttaccctttaccccgttaccccgggtaacggttacccggtaacgggtcccgttacggggtaacccgggg

SEQ ID NO: 221917 - DNA, 681 bp, Homo sapiens
  misc_feature: GYAE6OF01EHH0B.38.4.A04.1.454.CMB.1.raw
  modified_base (391)..(391): a, c, t, g, unknown or other
  misc_feature (391)..(391): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcattaaccaagatggacgtagaaaaatactatgtggactctgtgaagggccgattcgccatctccagagacaacgccaagaacctcactgtggctgcacatagaacggcctgagaggcgacgacacggctgtgtacttctgtgcgagaccgcccccagtcggacggctacaggtggacgtcgtacgtacttgacgtcggtcggggaccacgggacctcgtcgtaccgtctacccncacgccctaccgaccgaacggtcccacgttcccggtcccttcccccgtcggcccctaccccttcccgaccgaacgaccgtccaacccgtcgggtaccggggacctacccggaacgggccccgggtcccggtacggggtcccgttccgggaccccggttcgggttaacccgaaacgggttaccgtttaacccgttcccgtaaacggtcgtaaaccgtccgggaccgttcgggaaccgggccgggtaccggtacggggaacccgaaacggggccgaacgtaagtaggcngng

SEQ ID NO: 221918 - DNA, 649 bp, Homo sapiens
  misc_feature: GYAE6OF01BRT1D.38.4.A04.1.454.CMB.1.raw
  modified_base (220)..(220): a, c, t, g, unknown or other
  misc_feature (220)..(220): n is a, c, g, or t
  modified_base (643)..(643): a, c, t, g, unknown or other
  misc_feature (643)..(643): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggactgaaaaatctatgtggactctgtgaagggccattcgccatctccaganacaacgccaaagaactcactgtggctgacacagtgaaccggcctgagacggcgacgacacggctgtgtacttctgtgcgagacgcccccatggacggctacgaggtgggacgctacgtactttcgactacggtcggggcctacgggaacccctggtccgaccgttctccctcgaacgtcccctacccgaaccgaacgggccctacgtccggttcccttccccccgtacggcccctaccccgtcctacccgaaacggctacccgtaccgtcggtcggggacccacgtaccggtcccggcccgtcggggtcctcggtcccgtggtaccgtaacggtaccttaccgttaccggtacggtcgtacgttcccggaccgtcgggtaacggcggggtcccttacgggaccgtaacgggccgacgtaacgngctgcg

SEQ ID NO: 221919 - DNA, 894 bp, Homo sapiens
  misc_feature: GYAE6OF01CG7XE.38.4.A04.1.454.CMB.1.raw
  modified_base (342)..(342): a, c, t, g, unknown or other
  misc_feature (342)..(342): n is a, c, g, or t
  modified_base (892)..(892): a, c, t, g, unknown or other
  misc_feature (892)..(892): n is a, c, g, or t
tcagtcgatcacgtcacgaccggtgctcgatttagagtagtgatcgagggggggtccctgagactctcctgtgcagcctctgcattcacctttagtaactatttaatgagcgtgggtccgccagcctccgaggggaaggggctgggagtgggtcggccagcaattaaccaagagtggacgtagaaaaatctagtggtggactcgtggaggaacgggcctattccgccatcctaccaagagaaccaacgccaaagaactcactggtggctcgactacagtacggaaccggcctaggaaggacgggaccgaacgaaccgtcgggtctcggtacgttaccttcgnggtacgacggaacgcccgtacccccaggtcgggacggtacctaaggaagggtcgggtaactccgttaacggttacgttttacggaaccgtttaccgggggcggggaacccgtaaccggggtaaccccgttggtaccccgtaacccggttcctttaccccgaacgtacccggtcccccttaaacccggaacccgggtaaacccgggtcccccttaacggtttccccccgggtttaacccccgtttcccccccggtaccggtaccccctaaccccccgttttacccgaaacccggaaacggtaccccgtaaccccgttacccgggttacccgggggtacccggggtaaccccaaccggggttaccccgggcccccgggttaaccccgggttcgggtccccgttacccgggtacccccggtttaagggtaacccccggaaacgggtttccccccttaacgttaaccccggtacggtacggtaaccgttcccgggacggttacgggaccggggttccggcggtacggaaccggtacgggccgagtaagcgcgancg

SEQ ID NO: 221920 - DNA, 680 bp, Homo sapiens
  misc_feature: GYAE6OF01D81RF.38.4.A04.1.454.CMB.1.raw
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccgagggaaggggctggagtgggtggccagcaattaaccaagagtggacgtagaaaaatactatgtggactcgtgtggaagggccgtattccgccatcctaccagacgaccaacgccaaagaactcacgttgtggctgacacataggaaccggcctggaggaggcgaaccgacacggctgtgtacttcgtgtgcgacgccgccccagtggacgggtactaacggagggtcgggagtcgtaacgtacgtttagaccgtacggtcgggaccgtaacgggaccctcgggtaccctaccgtccgtacctcgaaccggtccctacccgaaccggtaaccgggccctacggttacccggttccccttccccggacggtccccacccgttcccgaccgaacgacgcccgtacccgtccgggtcggggaccaccgacgggtcccggccggtcgggtaccgtcggtcccgtagggtacccaacggttacccttccgttacccgagtcgacgtcgacgtcgggagcccgggtgtaggaccggaaacggccgtcgaagcgngngn

SEQ ID NO: 221921 - DNA, 784 bp, Homo sapiens
  misc_feature: GYAE6OF01CQ824.38.4.A04.1.454.CMB.1.raw
  modified_base (348)..(348): a, c, t, g, unknown or other
  misc_feature (348)..(348): n is a, c, g, or t
  modified_base (777)..(777): a, c, t, g, unknown or other
  misc_feature (777)..(777): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccgaggggaaggggctgggaggtgggtggccagcattaaccaagatggaacgtagaaaaatactatgtggactcgtgtggagggccattcgccatctcagagacaacgccaagaactcactgtggctgcacagtagaaccggctgagacggcgacgacgacggctgtgtaccttgtgtggcgacgaccgcccccgacgtggacgggctaacgaggagggacnccgtacgtacgtttagaccgtacggtcgggggtacccgaagggggtaaccccttgggtacccgaaccgttccttccccgtagaacccgtcccctaccccgaacccggtaaccgggtccccgtacggttaccccggttccccgtttccccccgtcgggtcccctacccccgttccctaacccgaaacggtaccgacccgtaacccgttccgggtccggggggacccaacggacccgggtacccgggtcccgggttccgggtcccggttccgggtaccccggtttacggggttaacccgtaaaccgggttaaccctttacccggtttacccgtaaccgggttcgtaaccggttccggaacccggttcgggaccggggtaccggggtaccggttaccggggaccggaaacggggtccgaacgtacgttaagngtacgcg

SEQ ID NO: 221922 - DNA, 701 bp, Homo sapiens
  misc_feature: GYAE6OF01CBTE2.38.4.A04.1.454.CMB.1.raw
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (700)..(700): a, c, t, g, unknown or other
  misc_feature (700)..(700): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtggtggccagcattaaccaagatggacgtagaaaaatactatgtggactctgtgaagggccgattcgccatctccagagacaacgccaaagaactcactgtgctgcacatgaacggcctgagaggcgacgacgacggctgtgtacttctgtgcgagaccgcccccagtcggagggctacgaggtgggagcgtacgtactttagacgtacggtcggggaccaacgggacccgtggtcccaccggtcctccctacgacgtccctacccaaccggtaaccgggcccctacggttcccggttccccctttaccccccgtcgggtaccccctacccccgttacccgtaacccaacggaccgacccgtaacccgtccgggtacgggggacccaaccggacccggcccgggccccggtcgggtccgtccgggtcccggttacgggttacccgtaaacgggtacccttaccgttacccggtacgtaccggtaacgtaccgtaccggttacggacgggtccgggtcgtccgggaaccgtaacgggccgtacgtaagtacgngngng

SEQ ID NO: 221923 - DNA, 907 bp, Homo sapiens
  misc_feature: GYAE6OF01C353D.38.4.A04.1.454.CMB.1.raw
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (902)..(902): a, c, t, g, unknown or other
  misc_feature (902)..(902): n is a, c, g, or t
tcagtcgatcacgtcacgaccggtgctcgatttagagtagtgatcagggggggtccctgagactctcctgcgcagcctctgcattcacctttagtaactatttaatgagctgggtccgccagcctccgagggaaggggctggagtgggtgccagcattaaccaagatggacgtagaaaaatactatgtggactctgtagaagggccatcgccatcncaganacacgaccaagaactcactgtggctgacacatacggaaccggccgtaggaggacggaccggaaccgaaccgacgggtccttggttacgttaccgtttaccgttggttacgaccggacggacccgacccccccaacggttacgggacggggaccttaacggaagggttggggacgaccgttaacggtacttttacggaccgttaaccggtcgggggaacccgtaaccgggggtaaccccgtttcgggtacccgaaccccggtttcccttccccgttaccgacccggtaccccccgttaaccccggaaaccccgggtaacccggggtacccccgttaacccggtttacccccgggtttaccccccgttttccccccccggtaccgggttacccccccttaccccccgttacccccgttaaccccggtaaaccggaacccggtcccctaacccccggttcccggggtacgggggaccccaacccgtaccgggccccgggtccccgggtcggggtcccgttccgggtacccgttacggggtttaaccgaacccgggttaaccgtttacccgtttacccggtaaccggtttacggtaaccgttaccgggtaccggttaccgggtaacggggtccggggtaccggttaccggggaccgggtaaaccgggcccgtaacgaggttacgngacgc

SEQ ID NO: 221924 - DNA, 581 bp, Homo sapiens
  misc_feature: GYAE6OF01BRWES.38.4.A04.1.454.CMB.1.raw
  modified_base (330)..(330): a, c, t, g, unknown or other
  misc_feature (330)..(330): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccagggaaggggctgggagtgggtggccagcattaaccaagatggacgtagaaaaatactatgtggactctgtgaagggccattcgccatctccagagacaacgccaagaactcactgtggctgcacatgaacggcctgagaggcgacgacacggctgtgtacttctgtgcgagacgcccccatggagggctacgaggtggganctacgtactttgactacgtggggccagggaccctggtcaccgtctcctcacgccctaccaccgaacgggcccagtccggtcccttcccccgtggcccaccctcctaccaacgacgccacccgtcgtcggggccacgacgcccggcccgtgggcctcggcccgtcggtaccaacgggtacccttaccgttcccgacgtcgacgtccgacgtggacggccgggctcgggaccgaagggccgacgagtacgngn

SEQ ID NO: 221925 - DNA, 654 bp, Homo sapiens
  misc_feature: GYAE6OF01BEYUS.38.4.A04.1.454.CMB.1.raw
  modified_base (271)..(271): a, c, t, g, unknown or other
  misc_feature (271)..(271): n is a, c, g, or t
  modified_base (649)..(649): a, c, t, g, unknown or other
  misc_feature (649)..(649): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccgaagggaaggggctgggaggtgggtggccagcaattaaaccaagatggacgtagaaaaatactatgtggactctgtggaagggccgattcgccatctcagagacaacgcaaagactcactgtgctgcacatgacggcctgagnggcgacgacacggctgtgtacttctgtgcgagaccgccccgacgtggagggcctaacgaggtgggacgtcgtacgtacgttacgtacgtacgtcggggaacccgaacgggtaacccgtcggtccgtaaccgtccctcctccgacgtccctacccgaaccggaaccgggaccctacgtcccggtccccgtttccccccgtcggtaccctaccccgtccctaccaaccgacgacccgtacccgtcggcggggacaccgacggccggcccgtgggcgtccggccgttcggtacaacggtacctaccgttccgtacggtagtaccgtaccgtacggtcggaggcccgggtcgtcgggacgaacgggtccgtacgaagtacgntgacg

SEQ ID NO: 221926 - DNA, 703 bp, Homo sapiens
  misc_feature: GYAE6OF01BBDCP.38.4.A04.1.454.CMB.1.raw
  modified_base (251)..(251): a, c, t, g, unknown or other
  misc_feature (251)..(251): n is a, c, g, or t
  modified_base (700)..(700): a, c, t, g, unknown or other
  misc_feature (700)..(700): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaaggccgattcgccatctccagagacaacgccaaagaactcactgtggctgcanatgaacggcctgagaggcgacgacacggctggtgtacttcgtgtcgcgagaccgcccccagtcggacgggactacgaggtgggactcgtacgtactttgaccgtaacggtcggggaccgacgggtaacccgtggtaccctacccgttctcccgtactaccgtccccgtacccgaaccggaacgggtcccctacgttcccggttacccttccccccgtagggccccctaccccgttcccgtacccgaacggaccgtacccgtaacccgtccgggtacggggacccaaccggtaccggccccgggtacccgtggggtcccgttcggtcccgttacgggtaccgtaaaccgggtacctttacccgttccgaacggtcgtaccgtaccggacgtcgggaacgggtcccgggtacgtacgggtaccggaacgggtccgaccgttaaggacgtgngtc

SEQ ID NO: 221927 - DNA, 713 bp, Homo sapiens
  misc_feature: GYAE6OF01BERI0.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctggtccgccagcctccgagggaaggggctggagtgggtggccagcaattaaccaagagtggacgtagaaaaatactatgtggactctgtaggaagggccgattcgccatcctccagagacaacgccaagaactcactggtgctgcacagtgaacgctgaggaggccgacgacgacggctgtcgttacttcgtgtggccgagacccgccccagtggacggtcctacgaggtgggacgtctacggtactttgaaccgtacggtcggggacccgaacgggtaccctcggtaccacccggtcttaccgtcaccggtaccctacccgaacccgggtacgggacccctacggttccccggttaccctttccccccggtcggtcccctaccccgtccgtacccgaacggtaccgcccgtacccggtcggtacggggccaccggtaccggcccggtacccggtcgggaccgtccgtccggttcggaaccgtaaccggtacctttacccggttaccgaccgggttacgaccgttaccggtaccgtcgggaccgggaccggggttcccggacgggtaccggaaaccgggtcccggacgtaagtacggcgtgcg

SEQ ID NO: 221928 - DNA, 604 bp, Homo sapiens
  misc_feature: GYAE6OF01C1ZNN.38.4.A04.1.454.CMB.1.raw
  modified_base (332)..(332): a, c, t, g, unknown or other
  misc_feature (332)..(332): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggaacgtagaaaaatactatgtggactctgtgaagggccattcgccatctccagagacaacgccaagaactcactgtggctgcacatgaacggcctgagaggcgaacgacacggctgtgtacttctgtgcgagacgcccccatggagggctaacgaggtggganctacgactttgactacgtggggaccaagggaaccctggtccaccgttctcctcgacgtccctaccgaccgaacggggcccacgttcccggtccctttcccccgcggccctaccccgtcctaccgaacgacgcctacccgtcggtcggggccacgacggcccggcccgtcgggcctcggcccgttggtacgtaacgggtaccttacgttacccgacggttcgacgtcggacgtggacggcgggtcgtcgggacgaacggtcgacgatacgngn

SEQ ID NO: 221929 - DNA, 781 bp, Homo sapiens
  misc_feature: GYAE6OF01ATZFT.38.4.A04.1.454.CMB.1.raw
  modified_base (641)..(641): a, c, t, g, unknown or other
  misc_feature (641)..(641): n is a, c, g, or t
  modified_base (736)..(736): a, c, t, g, unknown or other
  misc_feature (736)..(736): n is a, c, g, or t
  modified_base (777)..(777): a, c, t, g, unknown or other
  misc_feature (777)..(777): n is a, c, g, or t
  modified_base (779)..(779): a, c, t, g, unknown or other
  misc_feature (779)..(779): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccgagggaaggggctgggagtgggtggccagcaattaaaccaagatggactagaaaaatctatgtggactctggtaggaacgggccgtatttccgcctatccgtccaaggacgaaccaaccggaccaaaggtaacctcgacgtggtcggctcggacaaccgatacggaaccggtcctagggacggagggaccggaacgaaccggcggtcgttggttacgttacctttcgtggtcggacggtaccggacccgccccccgagttaacgggacgggtacctaacggagggttacggggaacgttaccgttaacggtccttttaggaacccgttaacgggtccgggggtaacccgaaccgggtaacccgttcgggtacctacccggttccctaccgtccaacggtccctaccccaacgggtaaccggcccctacgttcccggttccccttaccccggtcgtaccccctacccgtccctaccggaaacctccggaccgtacccgttcggggccggggacncggtaccggcccgggtaccggtcgggtacctcggtacccggtcgtaaccggtaaccgttaccgttacgtaccgtaccgtgtaccggtactacggngggacccggcggtcggcggaccgaacgggtccatacggacngncg

SEQ ID NO: 221930 - DNA, 584 bp, Homo sapiens
  misc_feature: GYAE6OF01C008O.38.4.A04.1.454.CMB.1.raw
  modified_base (332)..(332): a, c, t, g, unknown or other
  misc_feature (332)..(332): n is a, c, g, or t
  modified_base (431)..(431): a, c, t, g, unknown or other
  misc_feature (431)..(431): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgagggaaggggctggagtgggtggccagcattaaaccaagatggacgtagaaaaatactatgtggactctgtgaagggccgattcgccatctcagagacaacgccaaagaactcactgtggctgcacatgaacggctgagaggcgacgacacggctgtgtacttctgtgcgagacgcccccatggaggtctaacgaggtgggancgtacgactttgactacgtggggacccaagggaaccctggtaccaccgtcgtcctcacgcctcccaaccgaacgggcccagtccggtaccttcccccgnggccctaccctcctaccgaagcaccacctcgcggggcacgacgccggcccgtgggctacgacgtacggtacgaaacggtaccttacgttccgaacgttgacgtacgacgtggaggcgggtcgtcgggacgaaacggcgacgtataacggnngn

SEQ ID NO: 221931 - DNA, 723 bp, Homo sapiens
  misc_feature: GYAE6OF01DS7B1.38.4.A04.1.454.CMB.1.raw
  modified_base (107)..(107): a, c, t, g, unknown or other
  misc_feature (107)..(107): n is a, c, g, or t
  modified_base (720)..(721): a, c, t, g, unknown or other
  misc_feature (720)..(721): n is a, c, g, or t
  modified_base (723)..(723): a, c, t, g, unknown or other
  misc_feature (723)..(723): n is a, c, g, or t
tcagtcgatcacgtcacgaccggtgctcgatttagagtagtgatcgagggggggtccctgagactctcctgtgcagcctctgcattcacctttagtaactatttaangagctgggtccgccagcctccgagggaaggggctggaggtgggtgccagcattaaaccaagatggacgtagaaaaatactatgtggactcgtgtggaagggccattcgccatctccagacgacaacgaccaaagactcactgtggctgcacatagaacggcctgaggaggcgacgacacggtctgtgttacttctggtgacgacgaccgcccccacgtggaggctaacgaggtagggagtacctacgtactttggacgtaccggtcggggaccaacgggtaaccccttgggtcctacccggttcctccctccgaacgtccccgtacccaaacccggtaacgggaccccgtaacgttcccgggttaccccctttcccccccgtccggggtaccccctacccccgttacccgttaacccgaaaccggtaccgacccgtaccccgtccggttacggggggacctaccggacggcccgggtccccggtaacgggccgtcgggtaccctgggtaacccgtaacgggtaaccttacccgtacccgtaaccgttgaaccgttcgaaccgtcggtaacgggcccggggtcgtacgggcgaaaccgggtccgacgagtacgnngn

SEQ ID NO: 221932 - DNA, 692 bp, Homo sapiens
  misc_feature: GYAE6OF01BHH31.38.4.A04.1.454.CMB.1.raw
  modified_base (209)..(209): a, c, t, g, unknown or other
  misc_feature (209)..(209): n is a, c, g, or t
  modified_base (341)..(341): a, c, t, g, unknown or other
  misc_feature (341)..(341): n is a, c, g, or t
tcagtcgatcacgtcacgaccggtgctcgatttagagtagtgatcagggggaagaccgatgggcccttggtggaggcttggtccaggccgggggggtccctgagactctcctgtgcagcctctgcattcacctttagtaactatttaatgagctgggtccgccagcctccgagggaaggggctggagtgggtgccagcattaaccaagntggacgtagaaaaaatctatgtggactctgtgaagggccgattcgccatctccagagacaacgccaaagaactcactgtggctgacacatgaacggcctaggagaggcgaacgacacggctgtcgtacttcngtcgcgagaccgccccgattcgggagggtcctaacggagtgggactacgtaacgtacttttaggaacctacggtcggggaccctaacgggaccccgtggtccgacccgttacgtccctcgacggtccctacccgaacccgtaacgggcccctacgttcccggttacccttccccccgtcggacccctacccctcccgtaaccaacggtaccgaccctacccggttcgggtaaccgggggccaacggaccggtcccgggcccgtacggggtccgtcggtcccgttagggaccctaaacgggtacccttaacccgttaccgaacggttacgaacgttcccggacggtacgggg

SEQ ID NO: 221933 - DNA, 588 bp, Homo sapiens
  misc_feature: GYAE6OF01BPRUR.38.4.A04.1.454.CMB.1.raw
  modified_base (332)..(332): a, c, t, g, unknown or other
  misc_feature (332)..(332): n is a, c, g, or t
  modified_base (480)..(480): a, c, t, g, unknown or other
  misc_feature (480)..(480): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggccgattcgccatctccagagacaacgccaagaactcactgtggctgcacatgaacggcctgagaggcgacgacacggctgtgtacttctgtgcgacggaccgcccccgagtgacgggctacgagtggganctacgtactttgactacggcgggaccgacgggaccctggtccaccgtctcctcgacgccctaccgaccgaacgggccctacgttccggtcccttcccccgtcggcccctaccctccaccaacgccgacctacccgtcggtcgggaccncgacgcccgggcccgtggccgtcgccgtcggtacgaacggtacctacctaccgacgtgtacgtcgacgtcggtagcgggcggtaggaccgacggtccgacagtcgngn

SEQ ID NO: 221934 - DNA, 558 bp, Homo sapiens
  misc_feature: GYAE6OF01A19RU.38.4.A04.1.454.CMB.1.raw
  modified_base (556)..(557): a, c, t, g, unknown or other
  misc_feature (556)..(557): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgaggtgggagctacgactttgactacgtggggccacggaccctggtcaccgtctcctcacgccctccaccgagggcccagtccggtccttccccctcggccctacccctcctccaacgacgccaccgtcgtcgggggccacgacggccggcccgtgggcctcgccgtcggtcaacggtacctaccttccgacgtgactcgacgtggacggcgggctcggacgaacggcgacagtacgnnc

SEQ ID NO: 221935 - DNA, 550 bp, Homo sapiens
  misc_feature: GYAE6OF01DXXMV.38.4.A04.1.454.CMB.1.raw
  modified_base (191)..(191): a, c, t, g, unknown or other
  misc_feature (191)..(191): n is a, c, g, or t
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (533)..(533): a, c, t, g, unknown or other
  misc_feature (533)..(533): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
tcagtcgatcacgtcacgaccggtgctcgatttagagtagtgatcgaggggggtccctgagactctcctgtgcagcctctgcattcacctttagtaactatttaatgagctgggtccgccagcctccgagggaagggctggagtgggtggccagcattaaccaagatggactagaaaaatctatgtgactntgtgaagggccattcgccatctccagagaccaacgccaaagactcactgnggctgcacatgaacggcctgagaggccacgacacggctgtgttacttctgtgcgagacgcccccatggaggctagagtgggnctacgctttgactcgtgggccagggaccctggtccaccgtctcctcacgcctccaccgtagggccctacgtccgtcccttcccccgtcggccctaccctcctaccgaacgcgtccaccgtccgtggggcctacgacgccggccgtcggccttcgccgtcggtacgacgtacctcgttccgacgtgactcgacgtcgacggcggtctcggnaacggtcacatagngnn

SEQ ID NO: 221936 - DNA, 811 bp, Homo sapiens
  misc_feature: GYAE6OF01C2CEP.38.4.A04.1.454.CMB.1.raw
  modified_base (108)..(108): a, c, t, g, unknown or other
  misc_feature (108)..(108): n is a, c, g, or t
  modified_base (383)..(383): a, c, t, g, unknown or other
  misc_feature (383)..(383): n is a, c, g, or t
tcagtcgatcacgtcacgaccggtgctcgatttagagtagtgatcgagggggggtccctgagactctcctgtgcagcctctgcattcacctttagtaacttatttaangagcgtgggtcccgccagcctccgaggggaggggctgggaggtgggtgccagcaattaaccaagatggaacgtagaaaaatctatgtggactcgtggtaggaacgggcctattccgccatcctccgaagagaaccaacgaccaaagaacctcacgttggtcggctagacctacgagtacggaaccggcctaggaggacggaccgaacgtaccgacggtctagtcgttacttcgtggtcgacgacgaccgacccccgagtgggacggtactaacgngggtacgggacgtacgttaccgtactttacggaacgttaccgggtacggggacccgaacgggtaacccgttggtacccgtaccgttccctccgtacgaccgtcccctacccgaacggtaaccgggccctacgttcccggtcccctttccccgacggacccctaccccgtcgtaaccgaacggaccgtcccacccggttcgggaccggggacccacggacccgggtcccgggtacccggttcgggtacccgttccggtcccggttacgggtacccgtaaaccgggttacccctttacccgttacccggtaaccggttacggtaccggttaccccggtacgggtaccgggtaccggggtcccggggtaccgttaccggggaacccggtaaacggggtcccccgtaaagtaccggttaacgccgtagtacg

SEQ ID NO: 221937 - DNA, 677 bp, Homo sapiens
  misc_feature: GYAE6OF01CZ1OJ.38.4.A04.1.454.CMB.1.raw
  modified_base (431)..(431): a, c, t, g, unknown or other
  misc_feature (431)..(431): n is a, c, g, or t
  modified_base (673)..(673): a, c, t, g, unknown or other
  misc_feature (673)..(673): n is a, c, g, or t
tcagtcgatcacgtcacgaccggtgctcgatttagagtagtgatcaggggggggtccctgagactctcctgtgcagcctctgctatttcctaccttttaagtaaacttaattttaatgagcgtgggtcccgccagcctccgaaggggaggggctgggaggtgggtggccagcaattaaaccaagtatggaacgtaagaaaaatactatgtggactctggtaggaacggggcctattaccgcctatcctccaagacgaacaacgacctaaagacctacacgtgtagctgcacagtagacgactgagacggcgaacgacacggctgtacgtacttcgtgtcgacgacgaccgacccccagaggacggactacgaggtggacgactacgtcttagacgtacgtcgggacgacggacctgtaccaccgtctaccncacgtacctaccgaacgtacgggaccctagtcccggttacccttccccgacgacccctaccccgtacctaacccgaacgacgacctaccgttccggcggggacctacgaccggtaccggtcccgtacggggcttacggacccgttaggtaaccaaagtacccttacgttaccggaacgttcgaacgttaccgtacggtaggacgggtccggtaagcggtaacgaacggcgaacgtataacgntcga

SEQ ID NO: 221938 - DNA, 674 bp, Homo sapiens
  misc_feature: GYAE6OF01BHJMN.38.4.A04.1.454.CMB.1.raw
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaaggccgattcgcatctcagagacaacgcaagaactcactgtggctgcacatcgaacggcctgaggnggcgacgacgacggctggtgttacttcngtcgcgagaccgccccctagtggacgggtcctacgagggtgggacgaccgttacgtacttttggaaccgttacgggtcgggggaccgtaacggggaacccgttcgggtaccgaccccggttcctcccgtaccgtaccgcccttacccgaacccgtaacccggggcccctaaccgttcccggttaccctttcccccgtacggccccgtacccctccctacccgaacgccgtaccctacccgtcggcggggaccacggacggcccggtcccgtcgggccgtcgtccgtcggtaccgaacgggtacccttaccgttaccgtacgtagtactcggacggtcggg

SEQ ID NO: 221939 - DNA, 664 bp, Homo sapiens
  misc_feature: GYAE6OF01CT7W7.38.4.A04.1.454.CMB.1.raw
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (298)..(298): a, c, t, g, unknown or other
  misc_feature (298)..(298): n is a, c, g, or t
  modified_base (451)..(451): a, c, t, g, unknown or other
  misc_feature (451)..(451): n is a, c, g, or t
  modified_base (648)..(648): a, c, t, g, unknown or other
  misc_feature (648)..(648): n is a, c, g, or t
tcagtcgatcacgtcacgaccggtgctcgatttagagtagtgatcgagggggaagaccgatgggcccttggtggaggcttggtccaggccggggggtccctgagactctcctgtgcagcctctgctattcaccttttagtaactatttaatgagcgtgggtccnccagcctcgagggagggctggagtggngccagcctattaaccagatggactagaaaatctatgtgacttngtagaacgggctatccgcatctcagacgacacgcaagactcactgtgctgcacatgaacggtcngagacggcacgacgtacgcctagtagtacttcgtgtcggacgacgtaccggcccctagtcgggaacgggccttaagcgggttacgggactaccgttacgtacgtttagacgttaacggcggggaccacgggtaaccgtcggtccacggttccnccgttcgacgtccaccgaacctaccgggacctacgtcccggtcccttccccgcggccctaccctcccgtacgacggaccgccgtaacccgttgggtaccggggacttaccggaacggttccccggccggtcgggtccgtaacggtcccgacgggttactaaaccgggtacccttaccgtcccggtaacgtcgttacncccggttgaaccgggg

SEQ ID NO: 221940 - DNA, 616 bp, Homo sapiens
  misc_feature: GYAE6OF01B1HKO.38.4.A04.1.454.CMB.1.raw
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtagaaaaatactatgtggactctgtgaagggccattcgccatctcagagacaacgccaagactcactgtggctgcacntgaacggcctgagaggcgacgacacggctgtgtacttctgtgcgagaccgcccccatggagggctacgnggtggganctacgtactttgactacgtcggggaccacgggaccctggtccaccgtctcctcacgccctaccgaccgacgggccctacgtcccggtccttcccccgtcggacccctacccctccctaccgaacgacgccctacccgtcggtcggggccacgacggccggcccgtcgggcctcggcccgttcgggtaccgaacggtaccttaccgttacccgacggttcgacgttccggacgttcgggacgggtccggggtccgtacggggaccgaacggggtccgactagtagnngn

SEQ ID NO: 221941 - DNA, 947 bp, Homo sapiens
  misc_feature: GYAE6OF01EFEL5.38.4.A04.1.454.CMB.1.raw
  modified_base (118)..(118): a, c, t, g, unknown or other
  misc_feature (118)..(118): n is a, c, g, or t
  modified_base (240)..(240): a, c, t, g, unknown or other
  misc_feature (240)..(240): n is a, c, g, or t
  modified_base (938)..(938): a, c, t, g, unknown or other
  misc_feature (938)..(938): n is a, c, g, or t
tcagtcgatcacgtcacgaccggtgctcgatttagagtagtgatcagggggggtccctgagactctcctgtgcagcctctgcattcacctttagtaactatttaatgagctgggtccnccagcctcagggaaggggctggagtgggtggccagcattaaccaagatggacgtagaaaaatactatgtggactctgtgaaggccattcgccatctcagagacaacgccaagaactcactgnggctgcacatgaacgcctgagaggcgacgacacggctgtgtacttcgtagtcggacgtacggaccgccccccaacgttggaacggggtccttaacggaggtttacgggggacgaccgtttaacggtacctttttaggaaacccgttaacggtcgggggggtaacccctaacgggggggaaacccccttttggggggttacccctaaaccccgggtttcccttaaccccggttcccgaaaccggtaccccccgtttaacccccgaaaaccccgggtaaaacgggggtacccccctaaaccggttttccccggggtttaaccccccgttttccccccccgttacccggggtacccccttaccccccggttttaacccccgttaaccccggaaaaacccgggtaacccgtaccccgttaaaccccggtttacccgggtttaccgggggggaaccctaaacccgggaaccggggtaccccggggtaacccccgggttcgggggaccccgtttccgggtaccccggtttacggggtttaacccggtaaaacgggttaaccccgtttaaccccgtttaaccccgtaaaccgggttaggttaaacccgtaacccgggtaaccgttaccggggtacggggtacccgggggtaccccgttcgggggaaaccctaaacggggggtccctaacggtaaacgttaacggngttcgacgg

SEQ ID NO: 221942 - DNA, 779 bp, Homo sapiens
  misc_feature: GYAE6OF01CNGVB.38.4.A04.1.454.CMB.1.raw
  modified_base (114)..(114): a, c, t, g, unknown or other
  misc_feature (114)..(114): n is a, c, g, or t
  modified_base (129)..(129): a, c, t, g, unknown or other
  misc_feature (129)..(129): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (774)..(774): a, c, t, g, unknown or other
  misc_feature (774)..(774): n is a, c, g, or t
  modified_base (779)..(779): a, c, t, g, unknown or other
  misc_feature (779)..(779): n is a, c, g, or t
tcagtcgatcacgtcacgaccggtgctcgatttagagtagtgatcgagggggggtccctgagactctcctgtgcagcctctgcattcctaccttttaagtaaacttaatttaanggagcgtcgggtccnccagccctcggaggggaggggcgtgggaggtgggcggccagactaacttaaaccaaggagtaggaacgtaaagaaaaaattactagttggaggtacttgtggaggaaacggggccgtattccgaccattccaccgaagacgaaccaacgacaaagaactcacgttgagctgacacgtanacgaaccgcaggaggacggcgaacgacgcgcttagtctaccgttgngtacgaccggaacgaccccgaccccgtaagtcgggaacggtactaaccggagggtacggacgtaccgttaacgtacgtttaggaaccgtacggtaccgggggaaccgtaacgggtaacccgtggtacccctacgttacccgcctacgacccgtacccgtaaaccccgaaccggttaacccgggcccttacccgttaccggtttcccccttaccccgaccgtaccctaccccgtacccgtaacgaacggtacgacccgtaccggttcgggacggaaccgccggaccggcccgtcgggtacggtccgtaccggtaccgttacgggtaaccctaacggtacccttaccggtaccgaacgtacgtaccgtacggaccgtacggggacgcgggaaccgtgggaaccgaacgggactaacgagagngcgtn

SEQ ID NO: 221943 - DNA, 686 bp, Homo sapiens
  misc_feature: GYAE6OF01DDSE7.38.4.A04.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (328)..(328): a, c, t, g, unknown or other
  misc_feature (328)..(328): n is a, c, g, or t
  modified_base (633)..(633): a, c, t, g, unknown or other
  misc_feature (633)..(633): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
tcagtcgatcacgtcacgaccggtgctcgatttagagtagtgatcgaggggggggtccctgagactcctcctgtgcacgcctctgcctattccacctttagtaacttactttaactgagcgtcgggtccgccagcctccgaggggaaggggctgggaggtgggtggaccagctaattaaccaagntggacgtagaaaaaatctagtgnggactctggtaggaagggcctagttccgactatccnccagaagaccaacgccaaagactcacgtggcggctgacacagtacggaaccggccaggaaggacggacggaccgacgtaccggnttcggtcgttaacttccgttggtcggaccgaagacccgcccccagtggacgggcctaacgaggtgggacgctaacgtactttcgaactcggtcggggaccgaacggtacctcggtccaccgtctcctaccacgttcccaccaacccgaagggacccctcgtacccggttcccccgtccccgaccggacccctaaccccgtccctaaccgaacgaccgtccgacccttcgggaccgggccaacggcggacccgggccggtcgtccgcggcccgttaggaaccgaacgtacctaccgttcgtacggnctaccggacgttcggcggacgggtcgtacggacgacggaccgtgaatggcngn

SEQ ID NO: 221944 - DNA, 648 bp, Homo sapiens
  misc_feature: GYAE6OF01EK040.38.4.A04.1.454.CMB.1.raw
  modified_base (643)..(644): a, c, t, g, unknown or other
  misc_feature (643)..(644): n is a, c, g, or t
  modified_base (646)..(647): a, c, t, g, unknown or other
  misc_feature (646)..(647): n is a, c, g, or t
tcagtcgatcacgtcacgaccggtgctcgatttagagtagtgatcagggggggtccctgagactctcctgtgcagcctctgcattaacctttagtaactatttaatgagctgggtccgccagcctccaggggaaggggctggagtgggtggccagcattaaccaagatggacgtagaaaaatactatgtggactctgtgaagggccattcgccatctaccagagacaaccgcaagactcactgtgctgcacatggaacggctgagaggcgacgacgacggctgtcgtacttcgtgtcggcgacggaccgcccccagtggacggcctacgagtgggactcgtaacgtacttgactacggtcggggacgacgggaaccctggacctaccgtcctcctcgacgcccctaccgaaccgaccgggccctacgtcccggttacccttcccccgtacggcccctaccccctacccgtaccgaacggaccgacctaacccggttccggtacgggggacctaccgaccgggtcccggtcccggtacggggccgtccggtcccgtaggtaccgtaacggtaacctaccgttaccgacgtacgaccgtacggacgtggacggcgggtacggtcggacgtaccggcgacagtagnngnng

SEQ ID NO: 221945 - DNA, 798 bp, Homo sapiens
  misc_feature: GYAE6OF01ANHVL.38.4.A04.1.454.CMB.1.raw
  modified_base (320)..(320): a, c, t, g, unknown or other
  misc_feature (320)..(320): n is a, c, g, or t
  modified_base (786)..(786): a, c, t, g, unknown or other
  misc_feature (786)..(786): n is a, c, g, or t
  modified_base (792)..(792): a, c, t, g, unknown or other
  misc_feature (792)..(792): n is a, c, g, or t
tcagtcgatcacgtcacgaccggtgctcgatttagagtagtgatcagggggggtccctgagactctcctgtgcagcctctgcattcacctttaagtaacttatttaatgagcgtcgggtcccgccagcctccgaggggaaggggctgggaggtgggtggccagcaattaaccaagatggacgtagaaaaatctagtgtaggactcgtgtaggaacgggctattcgccatccaccagacgacaaccgaccaagaacctcacgtggtagctgacacgtagcggaaccggcctaggacggacggaccgacggtacgaccggtntcggttcgtacttgtggcggtacgaccgacccgcccccgtaagtcgggacggtaccgtacggacgggtagggtaccgtaccgttaaccggttacgttaccggaccgttacggggacgggtacccgaaccgggtaacccggtcgtaccctacccggtcccttaccgccgaaccgtccctaaccgaacccgggtaaccgtcccgtaccgttccccggtttccccctaccccggtccccggtacccccttacccccgtaccggtaaccccgtaacgtaccccgtacccgtacccggtccgggaccggggtacccgtaacggacccggacccgggtcccgggtaccgggtccgtccggtaccggtaccggtaacggtaaccgttacctacccgtaccgtacggtacgaccggttaccgtccggtcggtaccgggcgggtcggaccgggaccgaacgggtacccgagtaanccggancgtacg

SEQ ID NO: 221946 - DNA, 710 bp, Homo sapiens
  misc_feature: GYAE6OF01BFUYA.38.4.A04.1.454.CMB.1.raw
  modified_base (290)..(290): a, c, t, g, unknown or other
  misc_feature (290)..(290): n is a, c, g, or t
  modified_base (707)..(708): a, c, t, g, unknown or other
  misc_feature (707)..(708): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggagtgggtggccagcattaaccaagatggacgtagaaaaatctatgtggactctgtgaagggccattcgccatctcagagacaacgccaagaactcactgtgctgcacatgaacggctgagaggcgacgacacggctgtgtacttcngtgcgagaccgcccccagtggagggtctacgaggtgggagtaccgtaacgtactttggaaccgttacggtacgggggacccaacggggtaacccttgggtacccgtacccgttcctcccgtacgaaccgtccccgtaacccgaaccggaaccgggcccctaacggttccccggttaccccgttacccccccgtcgggaccccctaacccccttccctaacccgaaacggtaccgacccgtacccgttcgggtacgggggaccctaaccggaccggtccccgggtacccggtcggggtcccgtccgggtcccggttacgggtaaccgtaaacgggtacccttaccgttacccgacggtagtaccgtaccggtacgtcggacgggccggggtcgtacgggacgacgggcacgagtacgnngc

SEQ ID NO: 221947 - DNA, 664 bp, Homo sapiens
  misc_feature: GYAE6OF01BVB2F.38.4.A04.1.454.CMB.1.raw
  modified_base (650)..(650): a, c, t, g, unknown or other
  misc_feature (650)..(650): n is a, c, g, or t
tcagtcgatcacgtcacgaccggtgctcgatttagagtagtgatcagggggaagaccgatgggcccttggtggaggcttggtccaggccgggggggtccctgagactctcctgtgcagcctctgcattcacctttagtaactatttaatgagctgggtccgccagcctccgaggggaaggggctggagtgggtgccagcaattaaccaagataggacgtagaaaaatctatgtggactcgtgtggaacgggccgtattccgccatctccaggacaacaacgccaagaactcacgtggtgctcgacactagtacgaacggcctaggagagggaccgacgacgacggtctgttgtacttcgtgtcggcgagaccgcccccagtggacggctacgagggtggagtctacgtactttacggacttacggcgggaccgacgggtacccgtcggtccaccgtccgttccctcacggtaccctacccgaaccgaccggcccgtaccgttccggttccccttcccccgtcggaccctacccccgtccctacccgaacggaccgaccgttacccgttacgggtcggggacccacgaccgggccgccggtcgggcgtccggtccggtacgggttacgaaccggtacctacgtcctacgtnacgtcgacggtcgg

SEQ ID NO: 221948 - DNA, 581 bp, Homo sapiens
  misc_feature: GYAE6OF01DY2DW.38.4.A04.1.454.CMB.1.raw
  modified_base (330)..(330): a, c, t, g, unknown or other
  misc_feature (330)..(330): n is a, c, g, or t
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggggctggagtgggtggccagcattaaccaagatggacgtagaaaaaatactatgtggactctgtgaagggccgattcgccatctccagagacaacgccaagaactcactgtggctgcacatgaacggcctgagaggcgacgacacggctgtgtacttctgtgcgagacgcccccagtggaggctacgaggtgganctacgactttgactacgtggggccaggaccctggtcaccgtctcctcacgcctccgaccgaacgggcccacgtccgtcccttcccccgtcggccctaccctccctaccaacgacgcctaccgtcggtcggggccacgacggccggcccgtgggtcctcggcctcggtacgaacggtaccttacctcccgtacgtcgacgtccgacgtcggacggccgggtcgtcgggacgaacgggtccgacaagtgnngn

SEQ ID NO: 221949 - DNA, 586 bp, Homo sapiens
  misc_feature: GYAE6OF01B1AOO.38.4.A04.1.454.CMB.1.raw
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacagtggtagctacgtactttgactacgtggggccagggaccctggtcaccgtctcctcacgccctccaccgaacgggcccagtccggtccttcccccgtggcccacccctccctccaacgacgccaccctcgtcgggggccacgacggcccggcccgtcgggcctcggcccgttgggtaccgaacggtaccttaccttcccgtaccggttgacgtccggacgtgggacggccggggtctcggggaccgaacgggccgacagtaggnngn

SEQ ID NO: 221950 - DNA, 687 bp, Homo sapiens
  misc_feature: GYAE6OF01D6JW1.38.4.A04.1.454.CMB.1.raw
  modified_base (324)..(324): a, c, t, g, unknown or other
  misc_feature (324)..(324): n is a, c, g, or t
  modified_base (684)..(685): a, c, t, g, unknown or other
  misc_feature (684)..(685): n is a, c, g, or t
  modified_base (687)..(687): a, c, t, g, unknown or other
  misc_feature (687)..(687): n is a, c, g, or t
tcagtcgatcacgtcacgaccggtgctcgatttagagtagtgatcagggggggtccctgagactctcctgtgcagcctctgcattccacctttagtaactatttaatgagctggtccgccagcctccagggaaggggctggagtgggtggccagcattaaccaagatggacgtagaaaaatactatgtggactctgtgaaggccgattcgccatctcagagacaacgccaagaactcactgtgctgcacatgaacggcctgagaggcgacgacacggctgtgtacttctgtgcgagccgccccatggaggctacgaggtggganctacgactttgactacggtcggggccacgggtaaccctggtaccacccgtctccctcgacgtccctacccaacccggacgggtcccctacgttcccggttacccttccccccgtcgggtcccctaccccttccccgtaacccgaacggaccgaccctaacccggtcgggtccgggggtacccgaccgaccgggccccgggtaccccggtcggggtcccgtcggtcccggttacgggtaaccggtaaccgggtacctttacccgttaccgtaacggtccgtacggttacccgtaccggtacgggaccgggtccggggtccggtacggggaccgaaacggggtcccaaccgaggttaccggnngn

SEQ ID NO: 221951 - DNA, 639 bp, Homo sapiens
  misc_feature: GYAE6OF01BWE1V.38.4.A04.1.454.CMB.1.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctcgagggaaggggctggagtgggtggccagcattaaaccaagatgggaacgtagaaaaatactagtggtggactctggtggaacgggcctattcgcatctcagagacaacgacaagactcactgtgctcgcacatacgacggcctggagaggcgacgacgacgctgtcgtactgtgtgcgagccgaccccagtcggacggctagnggtaggacgtctacggtntttacgacgtacggtacgggaccgtaacgggaccgtcggtcctaccgtctcccgtacgacgtcccctaccgaccggaacgggccctaggttcccggtccttcccccgcgtaccccgacccctaccgtaaccgtaacgcctcccgaccgttcgggcgggccaccggacggcccggccgtgggtccgtcggcccgttaggacgtaaacggtccttacccgtaaccgtacggtagtaccgtccgtaggccgggtacgggcgggtcggtaggaccggacggtccgagatcgngngn

SEQ ID NO: 221952 - DNA, 887 bp, Homo sapiens
  misc_feature: GYAE6OF01EKL1N.38.4.A04.1.454.CMB.1.raw
  modified_base (122)..(122): a, c, t, g, unknown or other
  misc_feature (122)..(122): n is a, c, g, or t
  modified_base (880)..(880): a, c, t, g, unknown or other
  misc_feature (880)..(880): n is a, c, g, or t
tcagtcgatcacgtcacgaccggtgctcgatttagagtagtgatcgagggggggtccctgagactctcctgtgcagcctctgcattctacctttagtaacttatttaatgagctgggtcccnccacgccctcgaaggggagggctgggaggtgggtcgccagctaattaaaccgaagagtagggaacgtaagaaaaaattactagtggtacggtaaccttgtaggtaggaaacggggccctatttccgaccctattcccgacccgaaggaacgaacccaaacccggaacctaaaagtaacctctaaccgtggtacgggccttaggaccaacgttagacggaaaccggtccgtaggaaggacgggaccgaaccggtaaccgacggtacctgttacgttactttccgtggtcggacgacggaccgaccccctaggtaggacggtaccaggacggtagggtacacgtaacgtacgtttaggaccttacgggcggggaccgaacgggtaaccctcggtacctacccgtccttacccgcaccgaccccgtaaccgaaccgggaacccggtaccctaaccggttcccggttacccccgttacccccgtaccggtaccccctacccctacccgttaaccgaaacgaccgtacccgtacccgttacgggtacggggacccaacggaccgggacccggtccgggtcggtccgtaccggttacccggtaaccgggttaaccggaaccggttaacccgttaacccgtttaccggtaaccggttaaccggttaccggtaaccggtaccggtaccggggtaccggggtcccgggtaacgggttaccggggaaccggttaaaccggggacccgttaaacggtaacggtaacggngcggacg

SEQ ID NO: 221953 - DNA, 802 bp, Homo sapiens
  misc_feature: GYAE6OF01DTOA4.38.4.A04.1.454.CMB.1.raw
  modified_base (798)..(798): a, c, t, g, unknown or other
  misc_feature (798)..(798): n is a, c, g, or t
tcagtcgatcacgtcacgaccggtgctcgatttagagtagtgatcagggggggtccctgagactctcctgtgcagcctctgcattcacctttagtaacttatttaatgagcgttcggggtcccgccagccctccggaagggggaagggggctgggaggtgggtcggccagcaattaaaccaagagtgggaacgtaagaaaaatctatggtggactcgtggtggaacgggcccgtattcgcctatcctaccgagacgaacaacgacaagaactcacgtgtcggctcgcacgagtacggaaccggtcctaggaacggacggaccggtaacgaccgtacgggtcttaggtacgttccgtttcgtcggtcgaccggacgtccccgacccccgtaagtcgggacggtactacggacgggtcgggactaccgtaaccgttagtttacggaacccgtcggggtaccggggaacccggtaacgggtacccgtccgggtaccctaccgtccctacccgtacgcccgtacccgtacccgaacccgggaaccgggtcccctacggtttccccggttacccccgtcccccgtccggtacccctaccccgttacccgaaccgtaacgggacctccgtacccggttacgggacggggccctaaccgccggggtaccccgtcccgggtcgggtaccgtcccgggtaccggtaccgttaaccgggaaccgttcccgttacgtcccgaagttaccggtacccgccgtcgggccggacgggtccggtcggaaccgggacgtacgggtcagtaggcngtgc

SEQ ID NO: 221954 - DNA, 864 bp, Homo sapiens
  misc_feature: GYAE6OF01DMIEG.38.4.A04.1.454.CMB.1.raw
  modified_base (197)..(197): a, c, t, g, unknown or other
  misc_feature (197)..(197): n is a, c, g, or t
  modified_base (863)..(863): a, c, t, g, unknown or other
  misc_feature (863)..(863): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggagtgggtggccagcattaaccaagatggacgtagaaaaatactatgtggactntgtgaagggccattcgccatctcagacgacaacgcaagactcactgtggctgcacagtcgaacggctgagaggcgacgacgacggctgtcgttacttcgtgtcggcgacgacccgcccccgtagtcgggacgggtacctaacgagggtcgggacgtaccgttaacggtacgtttacggaaccgttacgggtacggggaccccgtaaaccggggtaaccccgtttcgggttaccctaacccggtttcccttacccgttaccgaccggtacccccgttaccccggaaaccccggtaacccgggggtcccccttaaccgggtttcccccgggttttaccccccgttttcccccccgggtacccgggtaccccccgttaaccccccgttaccccgttaaaccccggaaaaccgggtaccccggtaacccccgtaaacccccggttacccgggaaccggaacccggtcccggaaaccggtccccggggaccccgggtccccggttcgggggtacccttccgggtcccgggtttaacgggtacccgtaaaccgggttaccctttaacccggttacccggaacggttaccgaacgttcccggtaacggtacggggtacggggtccgggtaccggtacgggaaaccggtacgggacccgtaccgtaaggtgcgng

SEQ ID NO: 221955 - DNA, 558 bp, Homo sapiens
  misc_feature: GYAE6OF01BQ092.38.4.A04.1.454.CMB.1.raw
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaaggccgattcgcatctccagagacacgccaagactcactgtggctgcacatgaacggcctgagaggcgacgacacggctgtgtacttctgtgcgagacgcccccatggagggctacgaggtgggagcgtacgtacgtttgacgtacgtcggggaccgacgggaccctggtccaccggtcctcctcgacgccctacccgacgaaccgggcccagttcccgggtcccttcccccgtcggtcccacccctccaccgaacgcgcctccgtcggcgggcacgcggccgccgtcggctcgccgtgactaaggtcctacctccgacgtgacncgtacgnggcggcggcgnggacacggcgacatgnngn

SEQ ID NO: 221956 - DNA, 654 bp, Homo sapiens
  misc_feature: GYAE6OF01A3F9D.38.4.A04.1.454.CMB.1.raw
  modified_base (264)..(264): a, c, t, g, unknown or other
  misc_feature (264)..(264): n is a, c, g, or t
  modified_base (381)..(381): a, c, t, g, unknown or other
  misc_feature (381)..(381): n is a, c, g, or t
tcagtcgatcacgtcacgaccggtgctcgatttagagtagtgatcagggggaagaccgatgggcccttggtggaggcttggtccagccggggggtccctgagactctcctgtgcagcctctgcattcacctttagtaactatttaatgagctgggtccgccagcctccgaggggaaggggctggagtgggtgccagcattaaccaagatggacgtagaaaaatctatgtaggactctgtgaagggccattcgccatctccaganacaacgccaagaactcactgtcggctgacacatcggaacggcctggagaggcgacgacgacggctgtcgtacttcgtgtgcgagaccggccccagtggaggtctacgaggtgggacncgtacgtactttcgaacgtacggtcggggacccgacgggtaacccgtcggtaccgtaccggttctccctcgacgtccctacccgaccgaaccgggtcccacgtacccgtcccttccccgtacggccctaccctccctaccgaacgaccgtacctacccgtcgccggggtacaccggacggcccggtcccggtacgggtccgtccggtaccgtacgggttacgaaccggtaccttaccgttacccgacgttcggtaaccgtcgtacggtacggg

SEQ ID NO: 221957 - DNA, 836 bp, Homo sapiens
  misc_feature: GYAE6OF01DX6II.38.4.A04.1.454.CMB.1.raw
  modified_base (119)..(119): a, c, t, g, unknown or other
  misc_feature (119)..(119): n is a, c, g, or t
  modified_base (831)..(831): a, c, t, g, unknown or other
  misc_feature (831)..(831): n is a, c, g, or t
  modified_base (835)..(835): a, c, t, g, unknown or other
  misc_feature (835)..(835): n is a, c, g, or t
tcagtcgatcacgtcacgaccggtgctcgatttagagtagtgatcaggggggggtccctgagactctcctgtgcagcctctgcattcacctttagtaactatttaatgagctgggtccnccagcctcgagggaaggggctgggagtgggtgccagcattaaccaagatggacgtagaaaaatactatgtgactctgtagaagggccattcgccatcctaccagagacaaccgccaagactcactgtggctgacactagtcgaacggcctagaggacggcgacgacacggtctgtacgttcttcgtgtcggacgtacgacccgccccccgagtacgggacgggtacctaacggtagggtcgggacgtccgtaacgttacgtttaggaaccgttacgggtcgggggacccgtaaacggggtacccgttcggtaccgtacccggttcctacccgttaccgaccgtccccgtaacccgaacccgggtaaccgggtccccttaaccggttccccgggttacccccgttttaccccccgtccgggtaaccccctacccccgtttacccgtaccctaaaaccggaccggtaccccacccggggtttccgggacgggggtacccgaccggtacccgggtaccccgggtcccggtacgggggtacccgttcgggtacccggtttaccggggtaaacccgtaaacccggggttccctttaaccccggtttacccggaccgggtttaccgtaacccggttaccggtaccgggtccgggtaccggggtccggggtacccggttaccgggaaccggtaccgggtaccgaccgtaaagtccgggnacgng

SEQ ID NO: 221958 - DNA, 584 bp, Homo sapiens
  misc_feature: GYAE6OF01CGQNQ.38.4.A04.1.454.CMB.1.raw
  modified_base (580)..(580): a, c, t, g, unknown or other
  misc_feature (580)..(580): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccagggaagggctggagtgggtggccagcattaaccaagatggacgtagaaaaatctatgtggactctgtgaagggccattcgccatctccagagacaacgccaagaactcactgtggctgcacatgaacggcctgagaggcgacgacacggctgtgtactctgtgcgagacgccccagtggagggctacgaggtgggagtctacgacttttgactacgtcggggccacgggaaccctggtccaccgtctcctcgacgccctccaaccgaacgggccctagttccggtcccttcccccgtcggcccctaccctcctaccaagacgcctaccgtcgtcggggcctacgacggccgcccgtcgggacctcggccgtggtaccgaacgaccttacctccggacgtgactccggacgtcggacggcgggtcgcgggacgaacgggtccgacgtagtacgntgcg

SEQ ID NO: 221959 - DNA, 659 bp, Homo sapiens
  misc_feature: GYAE6OF01C3DTO.38.4.A04.1.454.CMB.1.raw
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
tcagtcgatcacgtcacgaccggtgctcgatttagagtagtgatcagggggggtccctgagactctcctgtgcagcctctgcattcacctttagtaacttatttaatgagctgggtccgccagcctccgagggaaggggctggagtgggtggccagcattaaccaagatggaacgtagaaaaatactatgtggactctggtgaagggccgattcgccatctccagagacaacgccaaagacctcactgtggctgcacatgaacggcctgagaggcgacgacacggctgtgtacttcgtggtcgacgacgaccgcccccgagtcggacgggtcctaacgaggtggggactaccgttaacgtactttacgacgttacggtcgggggaccaacggggtaaccctggtccacccgtctcccgtcgacgccctaccgaaccgacgggccctacgtccggttcccttcccccgtcggccctaccccgtcctaccaacgcgtccctacccgtcggtacggggaccaccgacggcccggtcccgtcgggccgttccggccgttcgggaccgaaacggtaccttaccgttacccgacgttcgacgttccggtacgtcgggacgggccggggtcgacgggacggaacggccggaactaggtacgngngn

SEQ ID NO: 221960 - DNA, 763 bp, Homo sapiens
  misc_feature: GYAE6OF01DZGW1.38.4.A04.1.454.CMB.1.raw
  modified_base (759)..(759): a, c, t, g, unknown or other
  misc_feature (759)..(759): n is a, c, g, or t
  modified_base (761)..(762): a, c, t, g, unknown or other
  misc_feature (761)..(762): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccgagggaaggggctgggagtgggtcggccagcaattaaccaagagtggacgtagaaaaatctatggtggactcgtggtaggaacgggcctattccgccatcctaccgagacgaaccaaccgaccaaagaaccttcacgttcggtcggcctggaccaacgtagtacggaaaccgggtcctagggaacgggacgggaccggaaccggaaccgaacggggtccgtttaggttacggttacgtttccgttagggtcgacggaaccggtacccgccccccgtagtacgggacgggtaccttaacggagggtacgggaacgtccgtacgtacgtttacgtacgtaccggtacggggacgaaccgggtaacctcgtaccgtaccgtctcccgtacgaccgtaccgtcccgaaccggaaccggtccccgtaaccggttcccggttccccgtttccccccggtacgtacccctaaccccctacgttacccgaagtccgaccgtcccgtaccgggtcgggaccacggacccgggtccggtacccggtcgggaccttccggccgtacggtacgaacgtccttaccgtccgacgtgtacgccgtacgtcggacggcggtcacgggacaacggctacggatacgngnng

SEQ ID NO: 221961 - DNA, 707 bp, Homo sapiens
  misc_feature: GYAE6OF01BB8F7.38.4.A04.1.454.CMB.1.raw
  modified_base (272)..(272): a, c, t, g, unknown or other
  misc_feature (272)..(272): n is a, c, g, or t
  modified_base (704)..(704): a, c, t, g, unknown or other
  misc_feature (704)..(704): n is a, c, g, or t
tcagtcgatcacgtcacgaccggtgctcgatttagagtagtgatcagggggggtccctgagactctcctgtgcagcctctgcattcacctttagtaactatttaatgagcgtgggtcccgccagcctccgaaggggaaggggctggaggtgggtggccagcattaaccaagatggacgtagaaaaatactatgtggactctggtagagggccgattcgccatctccagacgacaacgaccaagaactcacgtgtggctgcacatagaaggcngagaggcgacgacacgctgtcgtacttcgtgtgcgacgaccgccccagtggacggactacgagggtgggacgtaccgtacgtactttacgacgttacggtcggggaccgtaacgggtacccgtcggtacctacccgttcctccgtcgaccgtccctacccgaaccgaccggtccctacgttcccggttcccttcccccgcggtacccctacccctcccgtaaccgaacgtccgcccgtacccggtcggtccggggaccaccggaccgggccccggtccggtcggggtccgttcccgggtacccgggttaccgggtaaccgtaaaccgggtacccgttacccgttaccggtaccggtacgtaccggtaccggtacggtcgggtaaccgggccggggtacgtacgggaacggaaccggtcccgacgtagaagcntcg

SEQ ID NO: 221962 - DNA, 710 bp, Homo sapiens
  misc_feature: GYAE6OF01DE3Z1.38.4.A04.1.454.CMB.1.raw
tcagtcgatcacgtcacgaccggtgctcgatttagagtagtgatcagggggaagaccgatgggcccttggtggaggcttggtccaggccggggggtccctgagactctcctgtgcagcctctgcattcactttagtaacttattaatgagcgtggtcccgcctagcctcgagggagggcgtaggaggtgggtcgccagctaacttaaaccgaagtacgtagggaacgttaagaaaaaattctaagtggtacggtaccttgtggtaggaacgggccgtattccgacctatcctaccgaagaacacgaaccgaccgaaagactctacgtgtcggctcggacacgagtacgaaccggccgtaggaggacggccgaacgacgcggtctgttgttaccttgtagtgacgaccgacccgacccgaggtggaacggacgtaacggtagggtcggacggttactacgtactttagaacccggtaggtccgggaccgtacgggtaccgtcggtaccgtaccgtcctcctcgacgtaccctaccgacccggtaccgccctcgtacccgtcccgtccccgcgaccctcccgtcaccgtaacgccgtaccgccgtacggtcgggacctacgccggccgacccggtggccgtcggttcccggaggttccgaaccggtacccgttaccgtaccggtagtaccgtcgtaacggtgggtaaccggg

SEQ ID NO: 221963 - DNA, 754 bp, Homo sapiens
  misc_feature: GYAE6OF01D7HPU.38.4.A04.1.454.CMB.1.raw
  modified_base (749)..(749): a, c, t, g, unknown or other
  misc_feature (749)..(749): n is a, c, g, or t
  modified_base (751)..(751): a, c, t, g, unknown or other
  misc_feature (751)..(751): n is a, c, g, or t
tcagtcgatcacgtcacgaccggtgctcgatttagagtagtgatcagggggggtccctgagactctcctgtgcagcctctgcattcacctttagtaacttatttaatgagctgggtcccgccagccctccgaggggaaggggctgggaggtggggtggccagcaattaaccaagatggacgtagaaaaatactatgtggactcgtggtgaagggccgattcgccatcctccagacgacaacgaccaagaactcacgtgtggctgcacatgaacggcctaggagaggcgaccgacgacggctgtacgttactttcgtggtcggccggacgacccgcccccgacgtggacgggtacctaacggagggtggggacgtaccgtacgtaccgtttacggaaccgtaccggggtcgggggacccgaaccggggtaaccccgttcgggtacccgtacccggttcctccccgtaccaccggtacccctacccggaacccggaaccggggtcccctacggtttccccggttccccctttccccccgtaccggtaccccctacccccttcccgtaaccgaaccggtaccgcccgtacccggtccgggtaccggggaccaccggacggcccggcccggttcgggccgttccggaccgtacggtaaccgtaacgtacccttaccgtacccgtacggtacggtaccgtccggtacggtccgggacggacgggtccgtacgggacgacgggtccgacaggagngngcg

SEQ ID NO: 221964 - DNA, 718 bp, Homo sapiens
  misc_feature: GYAE6OF01AZXSF.38.4.A04.1.454.CMB.1.raw
  modified_base (294)..(294): a, c, t, g, unknown or other
  misc_feature (294)..(294): n is a, c, g, or t
  modified_base (713)..(713): a, c, t, g, unknown or other
  misc_feature (713)..(713): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcaattaaaccaagatggacgtagaaaaatactatgtggactctgtgaaggccgattcgccatctccagacgacaacgccaagaactcactgtggctgcacatgaacggctgagaggcgacgacgacgctgtgtacttntgtcgcgagaccgcccccagtcggagggtacctaacgaggtgggacgtacttaaccggtactttggacgtacggtcgggggacccgaacggggtaaccccgtgggtcctaccggttaccctccctacgacgtccccgtacccgtaacccggaaaccgggcccctacggttcccggttaccccgtttacccccgtccggacccctaccccttacccctacccgaaaccgaccgaccccgttacccgtcccggtacgggggacccacggtacccgccgggtccccggtaggtcccgtccggtcccgtacgggtaaccgtaacggtacccgttacgttccgacggttacgtaccgttacgtaccggtcgggaccggtccggggtacgacgggtaccggaacgggtcccgaacgaacgtaggntgacg

SEQ ID NO: 221965 - DNA, 566 bp, Homo sapiens
  misc_feature: GYAE6OF01AVU4N.38.4.A04.1.454.CMB.1.raw
  modified_base (306)..(306): a, c, t, g, unknown or other
  misc_feature (306)..(306): n is a, c, g, or t
  modified_base (381)..(381): a, c, t, g, unknown or other
  misc_feature (381)..(381): n is a, c, g, or t
  modified_base (523)..(523): a, c, t, g, unknown or other
  misc_feature (523)..(523): n is a, c, g, or t
  modified_base (538)..(538): a, c, t, g, unknown or other
  misc_feature (538)..(538): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcaccgtctccagagacaacgccaagaattcactgtatttgacaaatgaaacagcctgagagtcgaagacacggccatatattattgtagtaaaaagntcattcgataagtgggtgcggacgtacgggtggcagtgttcttgacttccgtggggtcctgggactcccccggtntcccgtctccctcaccgtccctccacccgaacgggccctacgtccggtccttcccccgtcggccctacccctcctaccaacgacgctacctcgtcggggcacgcgcgcccgtggctcgcctcggtcgaagtacctacgtccncgtgatcggctcggngcgggctgggacgacggcgcagangnng

SEQ ID NO: 221966 - DNA, 800 bp, Homo sapiens
  misc_feature: GYAE6OF01AENUT.38.4.A04.1.454.CMB.1.raw
  modified_base (119)..(119): a, c, t, g, unknown or other
  misc_feature (119)..(119): n is a, c, g, or t
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
  modified_base (794)..(794): a, c, t, g, unknown or other
  misc_feature (794)..(794): n is a, c, g, or t
  modified_base (796)..(796): a, c, t, g, unknown or other
  misc_feature (796)..(796): n is a, c, g, or t
  modified_base (798)..(798): a, c, t, g, unknown or other
  misc_feature (798)..(798): n is a, c, g, or t
tcagtcgatcacgtcacgaccggtgctcgatttagagtagtgatcgagggggggtccctgagactctcctgtgcagcctctgcattcacctttagtaactatttaatgagctgggtccnccagcctcgagggaagggctggagtgggtgccagctaacttaaacaagtagtacggaacgtaaagtaaaaactcttagtggtacggtacttcgtggtacgggaacgggtcctacgttccgacctacttcctaaccgaggaacaaccaaccgtaccaaagtacctcacgtggtcgctacgaccacgtacgtacggaaccggcgtaggaaggcggacgtaaccgaccggcggtctcggttcttacgttcgnggcgaccgtacgacccgacccgtaggtacggacggtactaacggngggtacgacgtaccgtaacgtacgttacggaccgtacgggtaccgggtaccgaaaccgggtaccgtcggtacccttaccgttccgtaccctacggacccgtaccccgtacccggaaccggtaacccgggttcccctaccggtttcccggttcccccctttaccccgggacccgtacccccgttaaccccttacccggtaaaccaaccgggtacccgtccccggttaacggtccgggggtacggaacccctagggcccggttaacccgggccggttacggcccgttaccggtaccggttacggaaacttacccggttaccttaccgtacgcgtacggtactcggggacgtcgggcggttcggaccgtggaacgtccgcagancngncg

SEQ ID NO: 221967 - DNA, 707 bp, Homo sapiens
  misc_feature: GYAE6OF01CAB4Q.38.4.A04.1.454.CMB.1.raw
  modified_base (272)..(272): a, c, t, g, unknown or other
  misc_feature (272)..(272): n is a, c, g, or t
  modified_base (702)..(702): a, c, t, g, unknown or other
  misc_feature (702)..(702): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcaattaaccaagatggacgtaagaaaaatactatggtggacttcgtggtaggaagggccgattccggaccatcctaccgagagaccaacgccaaagtaactcactgtggctgcaanatacggaaccggcctggaggaggccgacgacgaccggtctggtcgttacttcgtggtggacgacgaccgcccccgagtggacgggactacgaggtgggaacgtcgtacgtactttcggaacgtacggtcggggaccgaacgggtaacccgtcggtccgacccgttctccgccgtaccgccctaccgaccgacgggccctacgttcccgttcccgttccccgcggacccctccctacctacccgaacgacccgcctacccgtccgggtcgggcctaaccggccggtcccgggcccgggttgggaccgtcggtacccggtcggtaaccgtaacggtaccctttaccgtacccgtacggtacgtaccggtaccggaaggttcgggaccgggcgggttacggccgggtaacgacgggtaccgacgtaaggtcgngcgtg

SEQ ID NO: 221968 - DNA, 633 bp, Homo sapiens
  misc_feature: GYAE6OF01BJVOK.38.4.A04.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaggggctggagtgggtggccagcattaaccaagatggacgtagaaaaatactatgtggactntgtgaagggccgattcgccatctccaganacaacgccaagaactcactgtggctgacacagtaggaaccggcctagagaggcgacgacgacggctgttgtacttcgtggtgcgagaccgcccccagtggacggctacgnggtggganctacgtacgttgacgttacgtggggaccaacgggaccctcggtaccaccgtcctccgtcgacgccctaccgaaccgaacggtcccacgttccggttcccttcccccgtcggcccctaccccgtcctaccgaagaccgacctacccgtcggtacggggacctacgacgggcccggccgtcgggtcctacggtcccgttggtaccgaacggttaccttaccgttacccgtaacgtacgtacgtccggtacgtcggaccggcgggtcgtacgggccgaaagggccgagatgngnng

SEQ ID NO: 221969 - DNA, 737 bp, Homo sapiens
  misc_feature: GYAE6OF01BKE1F.38.4.A04.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcaattaaccaagatggactagaaaaatctatgtgactctgtgaggccattcgccatcncaganacaacgcaagactnactgtgctgcacagtgaacgcctgagaggcgacgacgacggctgtcgttacttcgtggtggaccgacgccgcccccgtagtcggacgggctacgaggtgggactaccgtaacgttactttacgaccgtacggtcggggaccgaacgggacccgtacggtccctaccgttcctccctacgccgccctacccgaaccggaaccgggaccctacggttccccggttccccttaccccccggtcggaccccctacccccgttccctaaacccgaacggacccgtacccgtaaccccggtttccgggtaccggggggacccctaaccggtacccgggtccccgggtccccgggtgggtcccgttcccgggtacccggtttcgggtaaccgtaaccggttacccttacccgttacccgtaacgggtacgtaccgttccggaccgttcgggaccgggtccggggtccgttacggggaacccgtaacggggacccctagtaggtagaccgngng

SEQ ID NO: 221970 - DNA, 664 bp, Homo sapiens
  misc_feature: GYAE6OF01B9BE6.38.4.A04.1.454.CMB.1.raw
  modified_base (406)..(406): a, c, t, g, unknown or other
  misc_feature (406)..(406): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (551)..(551): a, c, t, g, unknown or other
  misc_feature (551)..(551): n is a, c, g, or t
  modified_base (560)..(560): a, c, t, g, unknown or other
  misc_feature (560)..(560): n is a, c, g, or t
  modified_base (583)..(583): a, c, t, g, unknown or other
  misc_feature (583)..(583): n is a, c, g, or t
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
tcagtcgatcacgtcacgaccggtgctcgatttagagtagtgatcagggggaagaccgagtgggcccttgggtggaggcttggtccaggccgggggtcgtccctgagactctcctgtgcagcctctgcattcctactttaagtaacttatttaatgagtcgtcgggtcccaccacgcccgtaccggaagggggagggctgggaggtgggcgccagcaacttaacgaggatacggaactaagaaaaatcgtatggtacgacttgaggtggaacgggtcctattccgacctattccaccgaaggaaccgaaccaaccgacctaaagaacctcacgtcggtacggcctcggacactaggcggaacgcgaaggacggcggacgacgtacggacgtctcgttagtcttcgnggcggaccgtaccgacccgtacccgagtgggaccggtactacgggagggttcgactctacgtacgttacgacggtacgggcgggacacgggtacctgacctactcnccngaccnccgacaccgacgcctacgtccgtcctccgcncccgtcccncacgagctccagtcggcggaccncggtccggcccgtagtccggtcncggtccccgnggtaaccaacggttacccgtaccgcttaacgggctcgtaacggtacgg

SEQ ID NO: 221971 - DNA, 815 bp, Homo sapiens
  misc_feature: GYAE6OF01AQ21Q.38.4.A04.1.454.CMB.1.raw
  modified_base (810)..(810): a, c, t, g, unknown or other
  misc_feature (810)..(810): n is a, c, g, or t
tcagtcgatcacgtcacgaccggtgctcgatttagagtagtgatcagggggggtccctgagactctcctgtgcagcctctgcattcacctttagtaactatttaatgagcgtcgggtccgccagccctccgagggaaggggctgggagtgggtcggccagcaattaaccaagagtggacgtagaaaaatctatgtggactcgtggtaggaacgggccgtacttccgcctatcctaccgagacgaaccaaccgccaaagaacctcacgtgtggcctgccaacgtagtacggaaccggtccgtaggacggacgggaccgaaccggaaccgtaccggtcgttcggttacgttaccttcgtggtacggaccggaacgtacccgaccccctaggtacgggacggtaccgtacgagggtacgggtacgtacgttacgttacggtttacgaaccgttacgggacggggtacccgtaaccgggtaacccgtcggtaccctacccggttcctacccgcgtacccgtaccccgtacccgtaacccggacccgggtccctaccggtttccccggttaccccttcccccgtcggtaccccccgtaaccccttcccgtaaccgtaacggaccgtacccgtaccggtaccggggtaccgggacctaaccggccgggtaccccgggtcccggtcgggtacctccggtacccggtcgtaaaccggtaaccgttacccttaccgtaccggtgtacggtacgtccgacggtgggacccgggtaccggggtcgtaacgggaccggtaaccggcgtaacggttagacggntcgag

SEQ ID NO: 221972 - DNA, 818 bp, Homo sapiens
  misc_feature: GYAE6OF01CFDT4.38.4.A04.1.454.CMB.1.raw
  modified_base (311)..(311): a, c, t, g, unknown or other
  misc_feature (311)..(311): n is a, c, g, or t
  modified_base (815)..(815): a, c, t, g, unknown or other
  misc_feature (815)..(815): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcattaaccaagatggacgtagaaaaatactatggtcggactcgtgtaggaagggccgtattccgccatcctaccagacgacaacgaccaagaactcactggtggctgcacatcggaacgcctagagaggcgacgacgacggcgtgtctacttcgngtcgcgagccgccccagtggacggccaagtaggtagggactaccgtaacgtacgtttacgacgttacggacggggaccgtaacgggaaccccgtttgggtaccctaccggttcctacccgtaccgaccgtccccgttaacccgaacccggtaaccgggacccccgtaaccggttcccgggttaccccccgtttacccccccggttccgggaccccccttaaccccccgttacccccgttaaccccgaaaccggtaacccgtaaccccgttaccccggttacccggggtccgggggacccaacccgggaaccgggtccccggggtaccccggtccggggtccccgttccgggtaccccggtttaaccggggtacccggtaaaccggttaacccgttacccgttacccgaaccgggttacgtaccgttaccggtaccggttacgggacggggtacccgggtccggtacgggtaacccggacgggtaccgacgtaacggtacgcggntag

SEQ ID NO: 221973 - DNA, 864 bp, Homo sapiens
  misc_feature: GYAE6OF01EMTZO.38.4.A04.1.454.CMB.1.raw
  modified_base (377)..(377): a, c, t, g, unknown or other
  misc_feature (377)..(377): n is a, c, g, or t
  modified_base (859)..(859): a, c, t, g, unknown or other
  misc_feature (859)..(859): n is a, c, g, or t
tcagtcgatcacgtcacgaccggtgctcgattttagagtagtgatcgagggggggtccctgagactctcctgtgcagcctctgcattcaccttttagtaacttatttaatgagcgtgggtccgccagcctccgaaggggaagggggctgggaggtgggtggccagctaattaaccaagatggacgtaagaaaaatctagtgtggactcgtggtaggaacgggtccattccgcctatcctaccagacgacaaccgaccaaagaactcacgtggtggctgaccacagtacggaaccgcgtaggacggacggacgacgacgacggtctgtcgttacgttcgtgtcgcgacgacccgccccgtagtcggacggtcgtacgngggtacggacgtacgtacgtacgtttacggacgtaccgggtacggggaccgtaacgggtacccgttcggtacccgtaccgttccgttacccgaccgaccgtacccctaacccggaaccggtaccgggtaccctaccgttacccggtttccccttccccccggtcggtaccccctacccgttaccccgtaaccggaaccggtacccgtaccccggtaaccggtcccggggttaaccgggggaccctaaacccgggtcccgggtaccccggggtcccgggttacccggggtacccggtttacccggggaccccgtttacggggttaacccgggttaaacccggtttaccccggttttaacccggttacccgggttaaccggttacggtaaccccgttaaccccggggtacggttaccggggaaccggggttcggggtcccggtacggggaacccggaaccgggtcgtaacgttaagtacggcgngtacg

SEQ ID NO: 221974 - DNA, 642 bp, Homo sapiens
  misc_feature: GYAE6OF01EKFJM.38.4.A04.1.454.CMB.1.raw
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttcgtgtgcgagacgcccccatgagggctacgagtgggagctacgtactttgactacgtcggggccacgggaaccctggtccaccgtctcctcacgccctccgaacccgaacgggccctagttcccgtcccttccccccgtacggtcccctaccccgtccctacccgaaacgacgtcccgacccgtccggtcgggggacctaccgacggcccgggtccccgtggggcctcggccccgttagggtaccaacgggtacccttacccgttacccgacggttacacgttccgggtaccgtggggaacggccggggtccgttacggggacctaacggggccgtacgaattacggngng

SEQ ID NO: 221975 - DNA, 685 bp, Homo sapiens
  misc_feature: GYAE6OF01CD12I.38.4.A04.1.454.CMB.1.raw
  modified_base (121)..(121): a, c, t, g, unknown or other
  misc_feature (121)..(121): n is a, c, g, or t
  modified_base (360)..(360): a, c, t, g, unknown or other
  misc_feature (360)..(360): n is a, c, g, or t
  modified_base (680)..(680): a, c, t, g, unknown or other
  misc_feature (680)..(680): n is a, c, g, or t
  modified_base (685)..(685): a, c, t, g, unknown or other
  misc_feature (685)..(685): n is a, c, g, or t
tcagtcgatcacgtcacgaccggtgctcgatttagagtagtgatcgagggggggtccctgagactctcctgtgcagcctctgcattcacctttagtaacttatttaatgagcgtgggtccnccagcctcgaggggaaggggctgggagtgggtcggccagcaattaaccaagatggaacgtagaaaaatctagtgtggactcgtgtaggaacgggctatccgactatccacagacgacaacgaccaaagactcacgtgtggctcgacacgagtacggaacggcctaggacgagggacgacgacgacggtctggtatacttcgtgtcgacgagacccgccccaggtcggacggtctaacgngggtcggactacgtacgtatttcggacgtacggtacgggaccaacgggtacctggtacccaccgttcctccacgacgtccctacccgaacggacggccctacgttcccggttacccctcccccgagtacccctaccccgtccgtaaccgaacgaccgcccgtaccgttcggggacgggacctacggccggtaccccggtccggtagggcctacggtaccgtaccggtaacgtaaccggtacccgttactaccggaagtcgaaccgttcgacggtcgggacgggtccgggtactacgggacgtaacgggcacgtaagcggntacgn

SEQ ID NO: 221976 - DNA, 1061 bp, Homo sapiens
  misc_feature: GYAE6OF01C9BPO.38.4.A04.1.454.CMB.1.raw
  modified_base (767)..(767): a, c, t, g, unknown or other
  misc_feature (767)..(767): n is a, c, g, or t
  modified_base (1050)..(1050): a, c, t, g, unknown or other
  misc_feature (1050)..(1050): n is a, c, g, or t
  modified_base (1058)..(1058): a, c, t, g, unknown or other
  misc_feature (1058)..(1058): n is a, c, g, or t
  modified_base (1061)..(1061): a, c, t, g, unknown or other
  misc_feature (1061)..(1061): n is a, c, g, or t
tcagtcgatcacgtcacgaccggtgctcgatttagagtagtgatcgagggggggtccctgagactctcctgtgcagcctctgcattctacctttagtaacttatttaatgagcgtcgggtccgccacgccctccggaaggggaaggggctgggaggtgggtgccagactaattaaccgaagagtggaacgtaagaaaaatactagtgtacggtactcgtggtaggaacgggcctaagttccgaccatcctaccgaagacgaacgaacaccgtaaagaacctccacgttggtcggctacgaccaacgagtacggaacccggcgtagggacggacggggaaccgaaccggtaaccgtaccgggtacgtttacggttacgtttaaccgtttcgtacgggtacggaacccggtaaccgggaacccccgtaacccccccggtaaggtacggggtaaccggggtaacccgtttaaaaccgggtaagggggtaaccggggtaacgttaaccccgttaaacccgggttttaaaccggtttttacccggtaaaacccggtttacccggggggtaaccccggggggaaaaccccgggtaaacccgggggttaaacccccgggtttcgggttaaccccccgtaaccccggtttccccgtttacccccgtacgggtaaccccccggtacccccgtaaaaccccgggaacccccggtaaaccgggggtaacccccctttaccgggtttccccggtttaaccccccggtttcccccccggnggtaacccccccctacccccgttaacccgaacccgtaaacccggtaccgtaaccccggtacccgggttccggggtaccgggaaccgtaaccccggacgggtccccccgggtcgggttccggcccttacgggtacccccggttaacggggaaccccgtaaagggttaccccctttaaacccggtcccgtaaaggttccgggaaaccgttccccggtaacgggttaaccgggtaccggtacccgggtcggggtaaaccggaaccggttaaccggaccgggtaacncgggtaantgn

SEQ ID NO: 221977 - DNA, 699 bp, Homo sapiens
  misc_feature: GYAE6OF01BYXRO.38.4.A04.1.454.CMB.1.raw
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (523)..(523): a, c, t, g, unknown or other
  misc_feature (523)..(523): n is a, c, g, or t
  modified_base (695)..(695): a, c, t, g, unknown or other
  misc_feature (695)..(695): n is a, c, g, or t
  modified_base (697)..(698): a, c, t, g, unknown or other
  misc_feature (697)..(698): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctggagtggggtggccagcaattaaccaagatggacgtagaaaaatactatgtggactctgtgaacgggccgattcgccatcctccagaacgaacaaccgaccaaagaacctcacgttgtcggctgcacatagaaccggcgtggagaggccgacgacgacggtntgtgtacttnttggngcgacgaccgccccagtaggcgggctacgaggtgggagtccgtacgtacgttcgaacgttacgggtcggggaccggaccgggtaacccgtcggtccctacccggttcctcccgtcgaccgcccctacccgaacccggaacgggcccctacggttcccggttcccccttcccccggtccgcccctaccccgtaccctacccggaanacccggccctacccggtccgggtcgggacccaccggtaccggtcccgggcccggttcgggccctcggcccgtttaggtaacgaaccggttaccttaccgttcccgtaggtaccgtcgtacccggtagcggacggggcccggtcgtcgggaacccgtagggcctacgaatcgngnng

SEQ ID NO: 221978 - DNA, 825 bp, Homo sapiens
  misc_feature: GYAE6OF01B07NW.38.4.A04.1.454.CMB.1.raw
tcagtcgatcacgtcacgaccggtgctcgatttagagtagtgatcaggggagctctgagagaggagccttagccctggattccaaggcctatccacttggtgatcagcactgagcaccgaggattcaccatggaactggggctccgctggttttccttgttgcttattttagaaggtcgtccagtgtgaggtgcagcgtggtggagtcggtgggggaggccgtggtcaagccggtcgggggtccctggacgctcgtccgtgtcgcacgtcctcgtggtacttacctaccctttgaggttggtcgttttagcctagtacggtaacgttcggggtacccgtccgacggtccgtaccggaagggggacggggtcgtagggtaggttcgggttacctcgtacgttacctaaggtttaggtaacgttaggtaagttacgtactaacgtaacttactaacgtacgtacaacgtaccgtacgtaagggtacgggtaaccggggccttaacgttaccccaaccgttacctttacccgaacccgaacggaaacgaaccccgaaaccgtaacccgaaaacggtaaccctacctaaccgtttagtttaaccgttacctaagggaaccctaaaaggtaccggaaaccgttaccggtaccggtaacggaacgggacccgggtacccgggaaacgggtaacccggtacccgggttaacgtttacgggttaaccctttaggtttaacccggtcgggttaccggggaaacgggttaaaaccggggtaaacctttaaaccccggttaaaggttttagtttaaccgttccggtttttaaacgg

SEQ ID NO: 221979 - DNA, 719 bp, Homo sapiens
  misc_feature: GYAE6OF01AOCBX.38.4.A04.1.454.CMB.1.raw
  modified_base (117)..(117): a, c, t, g, unknown or other
  misc_feature (117)..(117): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (714)..(714): a, c, t, g, unknown or other
  misc_feature (714)..(714): n is a, c, g, or t
tcagtcgatcacgtcacgaccggtgctcgatttagagtagtgatcaggggggtccctgagactctcctgtgcagcctctgcattcacctttagtaacttattaatgagctgggtccnccagcctccgagggaaggggctggaggtgggtcggccaggcaatttaaccaaggataggacgtagaaaaatactagtgtggactctgtgaagggccattcgccatctaccaganaacacgccaagactcacttgcggctagcgtanacttcgaacgccgtagacggagaccgacgacacggtctcgtgtaccttgtcgtgcgacggaaccnccccgagtcggagggtcttagacggtggaagtccgtaagtctttacggactacgtggggacccgtaacgggaaccttcggaacgtaccgtccttacgccacgtccccgtacaacccggtacggtcccgtacgttcccggttcccgtacccccggttcgtaccccgtacccgtccttaacccgaacgtaccggtaccctaacccgttccgggtaccgggtaccgaccgtaacgggtccccgggtaccgtccggggtaccgttaccgtcccgggttaacggtaccggttaaccggtaccgttaccccgttaccgtacccggtcgtaaccgtcccggtaacgtcggtaccggcggtcgtaccggcggtaaacgccggaaccgttagcgngtgcg

SEQ ID NO: 221980 - DNA, 1025 bp, Homo sapiens
  misc_feature: GYAE6OF01DPZO2.38.4.A04.1.454.CMB.1.raw
  modified_base (141)..(141): a, c, t, g, unknown or other
  misc_feature (141)..(141): n is a, c, g, or t
  modified_base (151)..(151): a, c, t, g, unknown or other
  misc_feature (151)..(151): n is a, c, g, or t
  modified_base (265)..(265): a, c, t, g, unknown or other
  misc_feature (265)..(265): n is a, c, g, or t
tcagtcgatcacgtcacgaccggtgctcgatttagagtagtgatcgagggggggtccctgagactctcctgtgcagcctctgcattcacctttagtaacttatttaatgagcgtgggtccgccagcctcgagggaaggggntggagtgggngccagcaattaacaagatggactagaaaaatctagtgtggactgtggtaggaagggccattcgccatctaccagacgaacaacgaccaaagtactcacgtgtcggctagccaanagtaggaaccggtctaggaaggacggacgaaccgacgaacggcttaggtacgttaaccgtttcgtggacgaccggaacggaccccgaccccccgtaagtaggggaacggggtaaccttaacggtaacgggtgggggtaaacgttacccgttaaaccgggttaacccgttttttaggaaaccccgtttaaccgggggtacggggggaacccggtaaaccgggggtaaacccccgttttcgggtaaccccgtaacccggtttccccgttaccccgtaacccgtaacggttacccccccgttaaacccggtaaaccccgggaaacccgggggtacccccgtaaccgggtttcccccggggttttaccccccggtttttaacccccccccgggaccggggttaaacccccccttacccccccggttaaccccggtttaaacccccggtaaaaacccggggaaccccggttaaccccccggttaaaccccgggtttaccccgggggtaacgggggggtaacccctaaccggggaaccggggtttccccggggaacccccgggtttaccgggggtcccgtttacccggggtacccggtttaaccggggttaaaccggtaaaccggggttaaccctttaaccccggtttacccgtaaaccgggtttaccgacggttaacccgggttaacccgtacggggttaaacggggccggggttcccgtaaccggggaacgaaccggggtaccgaacgtaagtacggtcaggac

SEQ ID NO: 221981 - DNA, 670 bp, Homo sapiens
  misc_feature: GYAE6OF01AJ0K7.38.4.A04.1.454.CMB.1.raw
  modified_base (282)..(282): a, c, t, g, unknown or other
  misc_feature (282)..(282): n is a, c, g, or t
  modified_base (666)..(666): a, c, t, g, unknown or other
  misc_feature (666)..(666): n is a, c, g, or t
  modified_base (668)..(670): a, c, t, g, unknown or other
  misc_feature (668)..(670): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtggggtggccagcaattaaccaagatggacgtagaaaaaatactatgtggactctgtgaaggccgattcgccatctccagagacaacgcaagactcactgtgctgcacatgaacggcctggagaggcgacgacacggntggtgtacttcgtgtgcgacgaccgcccccgagtggacgggtctacgagggtgggacgcgttaacgtacgttttgaaccgttacggtcgggggacccgaacggggtaaccccgttcgggtcccgtacccgttccttacccgtaccgaccgtcccctaccccgaaacccggaacggggacccctaccggttcccggttcccccgtttcccccccgtcgggccccctaacccccgttcccctacccgaaacgaccgaccctacccgtcggtcggggccacgcggcccggcccgtcggcctcgccgtcggacgaacgtaccttaccgtcccgagtcgtactaccggacgtcgggaggcccgggcgtcgggacgacgggtcgacaagngnnn

SEQ ID NO: 221982 - DNA, 695 bp, Homo sapiens
  misc_feature: GYAE6OF01APMR9.38.4.A04.1.454.CMB.1.raw
  modified_base (194)..(194): a, c, t, g, unknown or other
  misc_feature (194)..(194): n is a, c, g, or t
  modified_base (256)..(256): a, c, t, g, unknown or other
  misc_feature (256)..(256): n is a, c, g, or t
  modified_base (333)..(333): a, c, t, g, unknown or other
  misc_feature (333)..(333): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccagggaagggctggagtgggtggccagcaattaaccaagatggactagaaaaatctatgtggactcngtgaagggccattcgccagtcctccagagacaacgtccaagtactcacgtgtggctgactanatcgaacgcctgagaggcgacgacacggctgtagtacttctgtcgcgacaccgcccccagtaggacgggtactacgnggtagggactccgttacgtactttgaaccgtacgcggggaccacggtacccctaggtcccaccggtacctcccgtaccgtaccggtaccctacccgaacccggtaaccgggccccgtaacgtccccgggttaccctttccccccggtcgtcccccttaaccccgtcccgtaacccgaacggacgtcccgtaacccgttccggtgggggacccaccggtcggacccggtacccggtcggccgtacggtcccggtaggtaccgaacggtacccttacggtacccgtacgtctaaccggttacgaccggttcgacgggttccgggccgttacggggaccaacgggtcaccggtaatccgatcgac

SEQ ID NO: 221983 - DNA, 665 bp, Homo sapiens
  misc_feature: GYAE6OF01E4OJO.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagtcgttggtccgagggcccgggggggtccctggacgacctctcctgtgcacgcctctgctattcctacctttagtaacttatttaatgagcgtcggtcccgccacgccctacggaggggagggcgtgggaggtgggtcgtccaggtacctaagtaaccgaagtacgtaggaacgtaaagaaaaactctaagtggtacgactcgtagtaggaacggtcctacgttccgacctatccgtacaggaacaaccaacgaccaacgactaccgactggacgtctacgaccaagtacgtacggaacggtcctagggaacggacgggtaccgaccggacgtaccggtcgtaggttcgtacgttcggtggaccggtcggaaccggtccccgtacccccgtaggtcggggtaaccgggtacctaacgggaaggggttcggaaccgttcggtttaaacccgg

SEQ ID NO: 221984 - DNA, 737 bp, Homo sapiens
  misc_feature: GYAE6OF01EK4RH.38.4.A04.1.454.CMB.1.raw
  modified_base (107)..(107): a, c, t, g, unknown or other
  misc_feature (107)..(107): n is a, c, g, or t
  modified_base (267)..(267): a, c, t, g, unknown or other
  misc_feature (267)..(267): n is a, c, g, or t
  modified_base (735)..(736): a, c, t, g, unknown or other
  misc_feature (735)..(736): n is a, c, g, or t
tcagtcgatcacgtcacgaccggtgctcgatttagagtagtgatcgagggggggtccctgagactctcctgtgcagcctctgcattcacctttagtaactatttaangagcgtgggtccgccagcctccgagggaaggggctgggagtgggtggccagcaattaaccaagatggacgtagaaaatctagtgtggactcgtgtaggaacgggccgtattccgcatcctccgaagacgaacaacgccaagaactcacgtgtggctgcanagtacgacgcgtgagacggacgacgacgacggtctgtcgttacttcgtggtcgccggacggacccgcccccgagtagggacggtctaaggagggtagggactacgttaccggtacgtttacggaacgtacgggtccggggaccgtaccgggtaacccgtcggtacccgtaccgttccttacccgtcgaccgtcccgtacccgaaccgtaccgggcccgtaccgttaccccggttcccctttcccccggtcggtacccccttaccccgttaccgtaaccgtaaccggcccgtacccgtacccggttcggggaccggggtacccaccgggtaccggccccgggtacccggttcgggaccgttccggtacccgggttacggtaaccgtaacggttaccttacccgttaccgacgtcggtactcggtacgtcgggacgcgggtcgacgggaccgaacggtcgactagacggnng

SEQ ID NO: 221985 - DNA, 844 bp, Homo sapiens
  misc_feature: GYAE6OF01AX3JT.38.4.A04.1.454.CMB.1.raw
  modified_base (838)..(838): a, c, t, g, unknown or other
  misc_feature (838)..(838): n is a, c, g, or t
tcagtcgatcacgtcacgaccggtgctcgatttagagtagtgatcgagggggggtccctgagactctcctgtgcagcctctgcattcacctttagtaacttatttaatgagctgggtccgccagcctcgagggaaggggctgggagtgggtggccagctaattaaccaagagtggacgtagaaaaatctatgtggactcgtgtgaacgggccgtattcgccatcctaccgagacgaacaacgaccaaagactcacgtgtggctgacacagtcggaacgctaggacggacggcgacgacgacggtcttcggttagttacttcgtggtcggacggacgaccccgccccgtaggtcggacgggtcctacggagggtacgggacgtacgtttaacgttaccgtttcggaaccgttacgggtcgggggaacccgtaaccggggtaacccgttggtacccgtacccgttcccgtacccgtacgtacccgtccccgttaacccgaacccggtaaccgggtccctaccgggtttccccggtttaccccgtttcccccggtccgggtacccccttacccccggtttacccaaccgtaaccggtaccgtaccccgtacccgggtttccgggaccgggggaaccctaacccgggaccgggtccccgggtacccgggtcgggtacccgtttcccgggtacccgggtttaaccgggtaacccggtaaaccgggttaccctttaccggttacccggaaccgggtttcggtaaccggttacccggtaacggttacggggaccggggttcgggaccgtacggggaccggtaaacgggccgtaagaacgggtcgngtcgag

SEQ ID NO: 221986 - DNA, 817 bp, Homo sapiens
  misc_feature: GYAE6OF01DIK66.38.4.A04.1.454.CMB.1.raw
  modified_base (811)..(811): a, c, t, g, unknown or other
  misc_feature (811)..(811): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccgagggaggggctggagtggtgccagcattaaccaagatggacgtagaaaaatactatgtggactctgtggaacggccgattcgccatcctccagacgaacaacgaccaaagtaacctcacttggtggctgacacagtacggaacggcctggacggaggccgaacgacacggcttggtcgtaccttcgtggtcgacggacgaccgccccccgaagtggacgggtcctaacggtagggtcggggacgtaccgttaacggttaccgtttacggaccgttaaccgggttcgggggaaccccggaacggggttaaaccccgttcgggttaccgtaccccgttccgttccccgttaacaccgtcccctacccgaaccggtaaccgggcccctaccggtcccggtttccccgtttccccccgacgggtacccccctaccccgttcccgtaaccgtaacccggaccgtacccgtaccccgggtttccgggacccgggggtacccaacgggtaccgggtccccgggtcccggtcgggtacccggttccggtacccggttacgggtaccgtaaccgttaccgtttacccgtcccggtaacggttccgtaaaccggttccggtaacgggtaacccgggtaagggccccgggggttacgaccgggaccgggttacggacccgacgttaaggtacnggtcag

SEQ ID NO: 221987 - DNA, 646 bp, Homo sapiens
  misc_feature: GYAE6OF01DHRFB.38.4.A04.1.454.CMB.1.raw
  modified_base (107)..(107): a, c, t, g, unknown or other
  misc_feature (107)..(107): n is a, c, g, or t
  modified_base (121)..(121): a, c, t, g, unknown or other
  misc_feature (121)..(121): n is a, c, g, or t
  modified_base (141)..(141): a, c, t, g, unknown or other
  misc_feature (141)..(141): n is a, c, g, or t
  modified_base (144)..(144): a, c, t, g, unknown or other
  misc_feature (144)..(144): n is a, c, g, or t
  modified_base (154)..(154): a, c, t, g, unknown or other
  misc_feature (154)..(154): n is a, c, g, or t
  modified_base (230)..(230): a, c, t, g, unknown or other
  misc_feature (230)..(230): n is a, c, g, or t
  modified_base (382)..(382): a, c, t, g, unknown or other
  misc_feature (382)..(382): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (597)..(597): a, c, t, g, unknown or other
  misc_feature (597)..(597): n is a, c, g, or t
  modified_base (605)..(605): a, c, t, g, unknown or other
  misc_feature (605)..(605): n is a, c, g, or t
  modified_base (612)..(612): a, c, t, g, unknown or other
  misc_feature (612)..(612): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
tcagtcgatcacgtcacgaccggtgctcgatttagagtagtgatcgagggggggtccctgagactctcctgtgcagcctctgcattcacctttagtaactatttaangagcgtcgggtccnccagcctcgagggagggcgnggnggtggcgccngactaactaacgagtagtggaacgtaaagtaaaatatagtggtacgtcttcgtaggacggacgggtcctacgtccncctactccacgagacaaccaccgacaagactcagtgcgctagacacgagtacggaccggtgaggaacggcggaccgtaacgaccgtcggtgttgtcgtttaccgtggtaggcgaccggaccgcccccaccgtggacgggtacggtactaggngggtacgacgtaccgttacgttcgttacgacggtcgggaccgggtaccgaaccgtcgtccgacctccgttcnccncgacgcccgtacgaccggtaccgcctccgttcccgtccccttcggccctaccccgtcccacggacgacgtcccgtccgtccgggtacggcggacctacgggctccgggcgtagctcggtcgtagcgaccgttactcccgngtccacgngtaccgnggtggtccggngtcgnggacgcgtccangctngn

SEQ ID NO: 221988 - DNA, 666 bp, Homo sapiens
  misc_feature: GYAE6OF01DLP7T.38.4.A04.1.454.CMB.1.raw
  modified_base (660)..(660): a, c, t, g, unknown or other
  misc_feature (660)..(660): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagtcgatcacgtcacgaccggtgctcgatttagagtagtgatcagggggggtccctgagactctcctgtgcagcctctgcattcacctttagtaactatttaatgagcgtggtccgccagcctccgagggaggggctgggaggtgggtggccagcaattaaaccaagatggaacgtaagaaaaatactatgtggactcgtgtgaacgggccattcgccatcctaccaagacgaaccaaccgccaaagtaacctcacgtgtggcctgcacagtcgaacggctgaggaggcgacgacgacggtctgtctacttcgtggtcgcgacgaccgcccccagtcggacggtctacgaggtgggcacgtacgtacttagactaggtcgggaccgacggacctaggtcctaccgtctccgacgacgtccctaccgaaccgaacgggccctaccggttccggttacccccttcccccgtacggtacccctacccccttaccgtaacccgaaacgacccgtacccgtacccgttcggggccggggaccctaccggacggtccccgggtccggtcggccgttcggtccgtacggacgtaaccgtaccttcccgttacgaccgtagacctcggacgtacggcggtcgggtcgacggacgacggtcacgtancggngn

SEQ ID NO: 221989 - DNA, 666 bp, Homo sapiens
  misc_feature: GYAE6OF01BLRCN.38.4.A04.1.454.CMB.1.raw
  modified_base (246)..(246): a, c, t, g, unknown or other
  misc_feature (246)..(246): n is a, c, g, or t
  modified_base (328)..(328): a, c, t, g, unknown or other
  misc_feature (328)..(328): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaaggccgattcgccatctccagagacaacgcaagactcactgtgctgcanatgaacggcctgagacggcgacgacgacgctgtgtacttcgtgtgacgacgaccgcccccagtggaggctagaggtgggacncgttacgtactttgacgttacggtcggggaccgaacgggtaaccccgttggtcccgtacccgttcctcccgtaccgacggtcccccttacccgaacccgtaaccggggcccctaacgttcccggttcccctttccccccgtcgggtccccctacccgttcccgtaccgaacggacgcccgtaacccgttcgggtcggggaccaccgaccggcccgggcccgtgggtcctcggtcccgtggtacgaacgggtaccttaccgttcccgtacgtgtacgtccgtacgtcggacgggccgggtcggtccggaacgtaacgggccgtacgaagtaccggtngn

SEQ ID NO: 221990 - DNA, 653 bp, Homo sapiens
  misc_feature: GYAE6OF01E39F5.38.4.A04.1.454.CMB.1.raw
  modified_base (337)..(337): a, c, t, g, unknown or other
  misc_feature (337)..(337): n is a, c, g, or t
  modified_base (650)..(652): a, c, t, g, unknown or other
  misc_feature (650)..(652): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagacggcgacgacacggctgtgtacttcgtgtcgcgacgaccgcccccagtggacgggctacgaggtgggacncgtaacgtactttcgaacgttacggtcgggggacccgacggggtaacccttgggtacctacccgtctccctcgacgcccctacccgaaccgaaccgggcccacgttcccgggttccccttcccccgtccggtcccctacccctaccctacccaacgaccgacctacccgtcggtcgggggaccctaccgacggcccgggcccggtcgggtcctccggtcccgtacggtaccgaacggtacccttaccgttccgtacggtcgacgtcggacgtcggacgggccgggcgtacgggacgaacgggcgacgatacgnnng

SEQ ID NO: 221991 - DNA, 709 bp, Homo sapiens
  misc_feature: GYAE6OF01D41BT.38.4.A04.1.454.CMB.1.raw
  modified_base (266)..(266): a, c, t, g, unknown or other
  misc_feature (266)..(266): n is a, c, g, or t
  modified_base (705)..(705): a, c, t, g, unknown or other
  misc_feature (705)..(705): n is a, c, g, or t
  modified_base (709)..(709): a, c, t, g, unknown or other
  misc_feature (709)..(709): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagcctccgaggggaaggggctggaggtgggtggccagcattaaccaagagtggacgtagaaaatactatgtggacttcgtgtagaacgggccattccgccatcctaccagacgacaaccgaccaaagacctcactgtggctgcanagtcgaacgctgagacggcgaccgacacggtcttggtacgttaccgtttcgtggtcggaccggtacggacccgacccccgagtacgggacgggtacctaacgagggtcggggactaccgttaaccggtactttacggaccgttacgggtcgggggacccgaaccggggtaaccttcggtacctacccgtctcccgtcgacgtccccgtccgaaccggaccggcccgtacgttccggtaccccttccccgtcggtacccctacccgtacccgtaccgaacggacctacccgtaccgtccgggtcggggaccacggtacgcccgggtccgtcggctccggtccgtacggaccgtaacggtaccgttccgtaccgtacgtacgactacggtaccgtacgggcggtcgggtacgtcgggaccgtaacgggctacgtaagtcgntcgn

SEQ ID NO: 221992 - DNA, 766 bp, Homo sapiens
  misc_feature: GYAE6OF01CLLO5.38.4.A04.1.454.CMB.1.raw
  modified_base (754)..(754): a, c, t, g, unknown or other
  misc_feature (754)..(754): n is a, c, g, or t
  modified_base (761)..(761): a, c, t, g, unknown or other
  misc_feature (761)..(761): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccgaggggaaggggctgggagtgggtggccagcattaaccaagatggacgtagaaaaaatctatggtggactcgtaggtaggaagggcccgtattccgaccaattcctaccagaagaaccaaaccggaccaaaagaacttcaacgtggtaggcctgactaacaagtcggaaccggcctaggagaacggacgaacgacgacggcttggtacgttacttcgtggtggcgacgaccgcccccagtagggacggtactacgaggtcggggactacgtaacgtacgtttgaaccgtacggcgggggtaccaaacgggtaacccgtcgggtacccaaccggttccctaccgttaccaaccggtccccacccgaaccggacccgggcccctacgttccccgggttcccctttccccccggtacgggtacccctacccccttaccgtaacccgaagaccgtcccgtaaccgtcgggtacggggaccacgtacgggcccgcccggtcgggtctccggtacgttcggaacgtaaccgggtaccttaaccgtacccggtaagttccgaacgttaccgggtaaccgtcggggaaccgggtcgggtcccgtacggggaaccgtagggggacccctaggtanaccgggngcgag

SEQ ID NO: 221993 - DNA, 579 bp, Homo sapiens
  misc_feature: GYAE6OF01ADH4Y.38.4.A04.1.454.CMB.1.raw
  modified_base (576)..(577): a, c, t, g, unknown or other
  misc_feature (576)..(577): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgcatctccagagacaacgccaagactcactgtggctgcacatgaacgcctgagaggcgacgacacgctgtgtacttctgtgcgagaccgcccccagtggacggctacgaggtgggagctacgtctttcgactacgtcggggccacgggaccctggtccaccgtctcctcacgccctaccgaaccgaacgggccctacgtccggttcccttcccccgtcgcccaccctccctaccaagacgcctaccgtcgtcggggccaccgcggcccggcccgtgggcctgtcccgtcggtaccgacggtacctaccgtacctcgtgacgtccgacgttcggacggcgggcgtcggacgaacgggccgacgtatcgnncg

SEQ ID NO: 221994 - DNA, 862 bp, Homo sapiens
  misc_feature: GYAE6OF01DLGZQ.38.4.A04.1.454.CMB.1.raw
  modified_base (120)..(120): a, c, t, g, unknown or other
  misc_feature (120)..(120): n is a, c, g, or t
  modified_base (856)..(856): a, c, t, g, unknown or other
  misc_feature (856)..(856): n is a, c, g, or t
  modified_base (858)..(858): a, c, t, g, unknown or other
  misc_feature (858)..(858): n is a, c, g, or t
tcagtcgatcacgtcacgaccggtgctcgatttagagtagtgatcagggggggtccctgagactctcctgtgcagcctctgcattcacctttagtaacttatttaatgagcgtgggtccnccagcctccgagggaggggctggagtgggtgccagcattaaccaagatggaacgtagaaaatactatgtggactcgtgtagaacgggccgtattcgcctatcctaccgaagagaaccaaccgaccaaagaacctccacgttggtggctcgactacgagtacggaaccggccgtggaggacggccgacgacgacggctgtacgttacttcgtggtcgacgacgaccgacccccgtagtgggacgggtacctaacggtagggtaggggtacgtaccgtaacggttactttacggacgttaccgggtcgggggaacccgtaaaccggggtaaccccgttcggttacccgacccggttcctccccgtacacccggtacccctacccgaacccgggtaccgggaccccgtacggtttccccggttcccccttccccccggtaccggtaccccctacccccgttacccgtaaacccgtaaccggacccgtacccgtacccggttacccggggtccgggggaccctaacccgggaaccgggtccccggggtaccccggttccgggggtcccgttaccgggttccccgggttacgggtaaccggttaaccggttaacccgtttaccccggttaaccgtaaccgggttacggtaaccgttaccgggttacggtcgggacccggggttccggggttaccgggtaccgggaaccggtaaccgggtaccggtaacctaggtaaccggngngtag

SEQ ID NO: 221995 - DNA, 797 bp, Homo sapiens
  misc_feature: GYAE6OF01EHOBO.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccagtggaagttggggctgagcgttgggttttccttgttgcttatttagaaggtgtcctagtgtgaggtgcaacgtggtggtaggtcggtgggggaggtcgtttcgggtaccgacggggtccccgggggggtccctaggtacgtacctccgtccgtggtcgacacgtccctctgactactttacctaaccttttaagttaacttaagttttaagtgtacggtcggtccgggtcccgtaccgacggtcccgtaccggagggggaacggggtcggtaggggaggtgggtacggaccgaacgacttaaaacgttaaaacccgaagtaacggttacggaaacggttaaagtaaaaactaccgttaagttaggtacgggtacttaccgtagggtaacgggacggggtacgtacgttaccgacctacgttcccgtaaccgtaacggaacgaaaccgtaacccgaaaccgaaacgtaacctaccgtagttcggtacggtcgtacgacacgtacgtacgggaaccgtcgtaggaacggacggtaccggaaccggaaccggaccgtacggttaccgttacggttaccttacggtcggtacggtacggaacccgaccccggtaccccgtaggtaccgggacggtacggtacggtagggacgggtacgtaccggttaaaccgg

SEQ ID NO: 221996 - DNA, 693 bp, Homo sapiens
  misc_feature: GYAE6OF01CTNYS.38.4.A04.1.454.CMB.1.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (463)..(463): a, c, t, g, unknown or other
  misc_feature (463)..(463): n is a, c, g, or t
  modified_base (681)..(681): a, c, t, g, unknown or other
  misc_feature (681)..(681): n is a, c, g, or t
  modified_base (688)..(688): a, c, t, g, unknown or other
  misc_feature (688)..(688): n is a, c, g, or t
tcagtcgatcacgtcacgaccggtgctcgatttagagtagtgatcagggggtccctgagactctcctgtgcagcctctgcattccacctttagtaacttatttaatgagctcgggtccgccagcctccgaggggaaggggctgggaggtgggtgccagcaattaaccaagatggacgtagaaaatactatgtggactcgtgtaggaagggccattccgccatccaccgagaacgaccaacgccaaagacctnacgtggtgcngacacagtacggaaccgtcgtaggaggacggacgacgacgacggtctggttcgttcttagtggtcgacgacgacccgtcccccgaggtcggacgggtcctaacggaggtgggtacgtacgtaaccggttacgtttacgacgttacgggtcggggaacccgtaccgggtaacccgtcggtacccgacccgttcctccctacnccggtaccctaccgaccgtaccgggccctacggttcccggttcccctccccgtcggacccctccccgtactccgaacgtccgacctccggtcgggacggggtaccacggccggccgggccggttcggccgtcggccgtacggtaccgtaacggtccttaccgtaccgtcgtacgtaccgtcggactcggggacggcggcggtcgaccgacgggtaccngaagcgncgacg

SEQ ID NO: 221997 - DNA, 671 bp, Homo sapiens
  misc_feature: GYAE6OF01A38YU.38.4.A04.1.454.CMB.1.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (670)..(670): a, c, t, g, unknown or other
  misc_feature (670)..(670): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaaccaagatggacgtagaaaaatctatgtggactntgtgaaggccgattcgcatctccagagacaacgccaagaactcactgtggctgcanatgaacggcctgagaggcgacgacacggctgtntacttcgtgtgcgagtaccgcccccgagtggagggctacgaggtgggagtctaacgtacgtttgacgtacggtcggggacccggtaacgggacccttcgggtacctacccggtccttccgtccgacgtccctaccgaaccggaaccgggtccctacggtcccggttcccttcccccgtacggtcccctaaccccgtcccttaccgaaacgtaccgaccgtaccgttaccgggtcggggaccacggtaaccgcccgggtccgtcgggtcttccggtccgtcgggtaaccgaacggttacctaccgttacccgaggttacgacgttacgggtactacggtaccgggcgggtacgtcggaccggtaacgaccgtactaaggctgaccgng

SEQ ID NO: 221998 - DNA, 724 bp, Homo sapiens
  misc_feature: GYAE6OF01AJSVF.38.4.A04.1.454.CMB.1.raw
  modified_base (254)..(254): a, c, t, g, unknown or other
  misc_feature (254)..(254): n is a, c, g, or t
  modified_base (482)..(482): a, c, t, g, unknown or other
  misc_feature (482)..(482): n is a, c, g, or t
  modified_base (719)..(719): a, c, t, g, unknown or other
  misc_feature (719)..(719): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggaggtgggtggccagcaattaaccaagatggacgtagaaaaatactatgtggactctgtagacgggccgattcgccatctcagagacaacgccaagactcactgtgctgcanatacgacggcctgaggaggcgacgacacggctgtgtacttcgtgtcgacgacgaccgcccccagtaggacgggtactacggagggtagggacgtacgttacgtacgtttacgaaccgtacggtacggggaccgaaccgggtacccgtcggtaccgtaccgttccgtaccctacgacgtcccctacccgaaccgaccgggcccctacgttcccggttcccttcccccgnggtccccctaccctcccgaaccgacgccgcccgtaccgtccgggtacggggacccaccggtacgggccccgggtccgtcgggtcccgttcgggtcccggttacgggtaaccgtaaccggttaacccgtttacccggttacccgtaccgggttactaacccgggttcggtaaccggttacggggacgggtcccggggtacgtacgggaacccggaacgggtccgacggtaagtacggncggtc

SEQ ID NO: 221999 - DNA, 590 bp, Homo sapiens
  misc_feature: GYAE6OF01BJBG3.38.4.A04.1.454.CMB.1.raw
  modified_base (396)..(396): a, c, t, g, unknown or other
  misc_feature (396)..(396): n is a, c, g, or t
  modified_base (557)..(557): a, c, t, g, unknown or other
  misc_feature (557)..(557): n is a, c, g, or t
  modified_base (569)..(569): a, c, t, g, unknown or other
  misc_feature (569)..(569): n is a, c, g, or t
  modified_base (586)..(586): a, c, t, g, unknown or other
  misc_feature (586)..(586): n is a, c, g, or t
  modified_base (588)..(590): a, c, t, g, unknown or other
  misc_feature (588)..(590): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccaggggaaggggctggagtgggtggccagcattaaccaagatggacgtagaaaaatctatgtggactctgtgaagggccgattccgccatcctccagagacaacgccaaagaacctcactgtggctgcacatggaaccggcctgaggacggcgacgacacggctgttgtactctgtgcgagccgccccagtggacgggactacgaggtgggactctacgtactttgaccgtacgtcggggccaacgggtaccctcggtccaccgtcctcncacgcctcccaaccgacggccctacgttcccggttcccttcccccgtcggacccctacccgtcccgtaccgaacgacgcctacccgtcggtcgggccacgcggccggtcccgtgggctcggccgtcggtacgaacggtactacctcgcgtcgactcgacgnggaggcgggtcncggacgacggccacagngnnn

SEQ ID NO: 222000 - DNA, 700 bp, Homo sapiens
  misc_feature: GYAE6OF01A2XBK.38.4.A04.1.454.CMB.1.raw
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtgactctgtgaaggccattcgccatctccagacgacaacgccaaagaactcacgtgnggctgcacatgaacgctgagagacgacgacacggcttgtcgtacttntgtgcgagacgcccccatggaggtctacgaggtggggactaccttaacggtaccttttggaacgtaccggtacggggaccccggaacgggtacccccgttggtacccgtaacccggttcctacctacccgaccgtcccgtacccgaaccgtaaccgggaccctacgttacccggttcccctttcccccggtacggtacccctaccccttcccgtaccgaaccgtaccgacccgtaccgtcggttaccgggaccgtaccgacgggcccggtacccggtcgggaccgttcggtacccgttacggtaccgaaccgtacccgtaccgttacccgtagttccgtacgtaccgtacgtacgggacggtcgggtccgtcgggtaccggaccgggacgaccgtaagtacgngngtacg

SEQ ID NO: 222001 - DNA, 842 bp, Homo sapiens
  misc_feature: GYAE6OF01BADJL.38.4.A04.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
  modified_base (375)..(375): a, c, t, g, unknown or other
  misc_feature (375)..(375): n is a, c, g, or t
  modified_base (801)..(801): a, c, t, g, unknown or other
  misc_feature (801)..(801): n is a, c, g, or t
  modified_base (835)..(835): a, c, t, g, unknown or other
  misc_feature (835)..(835): n is a, c, g, or t
tcagtcgatcacgtcacgaccggtgctcgatttagagtagtgatcgagggggggtccctgagactctcctgtgcagcctctgcattctacctttagtaacttatttaatgagcgtcgggtccgccacgcctccgaggggaaggggctggaggtgggtggccagacaattaaaccgaagagtggaacgtaagaaaaattactagtgtggactcgtaggtaggaacgggcctatccgccaatcctacgaagaacgaaccgaaccgaccaaagaactccgagttggcggcncgacacgagtacggacgccgtggaggacgaccgacgtacgacggtntaggtcgtacgttcgtggacgacgaacgcccgtaaccccgngtaggacgggtacaacgtgggtaggacgttaccgtaagttcgtttacgaccgtacggggtccggggaaccctacggggtaaccccttggtacccctcggttacccctaccgtacccggaacccggttacccaacccgaacccggggtaaccgtacccctacgggtttccccgttaccccgtcccccgttacggcccccctaaccctcggtaacccgaacgccgtacccgtaccggttacgggacccgggacctacggacccgggtcccgtacccgggttcgggacccgtacccggtaacccgggtaggttaacccgggtaaacctacccccgttttaacgtaccccgggtaacgttacgggtaaccccgggttacgtaaccgggcgggggaaacccggggtccgggttacgggtaaccccccgggnggttaaaagggcccccgactttaaaggggtaccncgtacgc

SEQ ID NO: 222002 - DNA, 684 bp, Homo sapiens
  misc_feature: GYAE6OF01B86CN.38.4.A04.1.454.CMB.1.raw
  modified_base (525)..(525): a, c, t, g, unknown or other
  misc_feature (525)..(525): n is a, c, g, or t
  modified_base (677)..(677): a, c, t, g, unknown or other
  misc_feature (677)..(677): n is a, c, g, or t
  modified_base (681)..(683): a, c, t, g, unknown or other
  misc_feature (681)..(683): n is a, c, g, or t
tcagtcgatcacgtcacgaccggtgctcgatttagagtagtgatcagggggggtccctgagactctcctgtgcagcctctgcattcacctttagtaacttatttaatgagctcgggtcccgccagcctccgagggaaggggctgggagtgggtgccagcaattaaccaagatggacgtagaaaaatctagtggtggacttcgtggtaggaacgggccgtattccgcctatcctaccaagaacgaacccaaaccggaccaaaagtaacctcacgttggtcggctgacactagtacggaaccggcctggaaggacggaccgaacgacgacggtctggttcgttaccgttcgtggtcgacgacgaccgccccccagtggacggctacgaggtgggactcgtacgtcttacgacgtacggtcgggaccgacggtacctggtaccaccgtctccgtcgacgccctccgaccgacgggccctacgtccgttccctccccgtggacccctaccccgtcctaacgacgtaccnccgtacccgtcgggacggggcctacggacggtcccggccgtcgggccgtcggaccggtttcggaaccgtaacggtaccttaccgtacccgacggtagtacccggtacgtaccggtgggacggccgggtacgtcgggaaccgacggcacgtanacgnnng

SEQ ID NO: 222003 - DNA, 710 bp, Homo sapiens
  misc_feature: GYAE6OF01D9O2E.38.4.A04.1.454.CMB.1.raw
  modified_base (705)..(705): a, c, t, g, unknown or other
  misc_feature (705)..(705): n is a, c, g, or t
tcagtcgatcacgtcacgaccggtgctcgattttagagtagtgatcagggggggtccctgagactctcctgtgcagcctctgcattcaccttttagtaactatttaatgagctgggtccgccagcctccgagggaagggggctgggagtgggtggccagcattaaaccaagatggacgtagaaaaatactatgtgactctgtgaacgggccgattcgccatctaccagagacaacgcaagactcacgtgtgctgcacagtgaaccggcctaggagaggcgacgacgacggtctgttgtactttctgtggcgacgaccgcccctagtaggacgggtactacgaggtgggacgtacgtacgtactttcggacttaccggtcggggacccgaacgggtaacccgttcggtacctacccggtcctcccgtcgaccgtccctaccgaaccggtaaccgggcccctacggttcccggtttcccccttcccccgtcggtccccctaccccgttacctacccgaaacggtccgaccgtacccgtcggggtcgggcccaacggacggccccgggtccggtacgggccgttacggcccggttacgggtaccgtaaaccggtaccgttaccgtacccggtacgttagtaccgtaccgtaacggtcgggaaccggggccggtcggtaccgggaaccgacgggtccacgtaagtcggncgtag

SEQ ID NO: 222004 - DNA, 837 bp, Homo sapiens
  misc_feature: GYAE6OF01AZZ70.38.4.A04.1.454.CMB.1.raw
  modified_base (834)..(834): a, c, t, g, unknown or other
  misc_feature (834)..(834): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcaattaaccaagagtggacgtagaaaaattactatggtggactcgtggtaggaacgggcccgtatttccggaccattcctaccgaaggaacgaccaaccgaccaaagaacctcgaacttggtgcctgaccactagtaggaaccggcctaggacggacgggaccggaaccgaacgtaaccgggccttggttacgttacctttccgtggttacgacggacgaaccgtccccccaacgttagggacgggtacctaacgtaggtacggggataccgttaaccggtacttttcggaaccttacgggtccgggggacccgaaccggggtaacccccgtggtcccgaaccggttcccgttccctaccgacgccccgtacccgaaccccggaacgggcccgtacgtcccggtttacccgttcccccccgtacgggtcccctaacccccgtccccgtaaccctaaacggaccgtaccccgtacccgtcggttacgggggacccaacggtaccggaccccgggtcccgttccggggtcccttacccgggtacccggtttaccgggaaccggtaaacgggtaccccttaaccgttacccgtacggttacgtaccgtacccgtaacggttcgggaccgggtaccggggtcggttaccgggaccggtaacgggcccgtaacaaaggtcggacgngcg

SEQ ID NO: 222005 - DNA, 629 bp, Homo sapiens
  misc_feature: GYAE6OF01ANISX.38.4.A04.1.454.CMB.1.raw
  modified_base (227)..(227): a, c, t, g, unknown or other
  misc_feature (227)..(227): n is a, c, g, or t
  modified_base (272)..(272): a, c, t, g, unknown or other
  misc_feature (272)..(272): n is a, c, g, or t
  modified_base (389)..(389): a, c, t, g, unknown or other
  misc_feature (389)..(389): n is a, c, g, or t
  modified_base (627)..(629): a, c, t, g, unknown or other
  misc_feature (627)..(629): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagccctccaggggaaggggctgggagtgggtggccagcaattaaaccaagatggacgtagaaaaatactatgtggactctgtgaagggccattcgcatctccaganacaacgccaagaactcactgtcggctgcacatgaacggcctgagnggcgacgacacggctgtgtacttctggtgcgacgaccgcccccgacgtggagggctacgaggtgggagcttacgtactttgactacggtcggggaccgacgggtacccgtggtaccnccgtcctcctcgacgtccctaccgacccgaacgggccctacgtccggttccccttcccccgtcggcccctacccctccctaccaacgccgacctacccgtcggtcggggaccaccggcggcccggtccgtcgggtcctcggccgtcggtacgtaacggtacctacccgttcctacggtcgtacgtaccgtacgtcggcggggcgggtcgtacggggaccgtacgggccgacgagtagnnn

SEQ ID NO: 222006 - DNA, 890 bp, Homo sapiens
  misc_feature: GYAE6OF01BSF7J.38.4.A04.1.454.CMB.1.raw
tcagtcgatcacgtcacgaccggtgctcgatttagagtagtgatcagggggggtccctggagactctcctgtgcagcctctgcattcaccctttagtaactatttaatgagctgggtcccgccagcctccaggggaaggggcctgggagtgggtggccagcattaaccaagatggacgtagaaaaatactatgtggactctggtggaagggccagttcgccatcctccagacacaacgccaagaactcactgtggctgcacagtcggaacggcctaggaacgaggccgaacgaccacgggctaggtcgttaccttctggtcggcgagacccgacccccgaggtacggacgggtacctaacgagggttcggggaactccgtaaccggttacgtttacggaaccgttacggtcggggggaaccctaaccgggggtaaccccgtggggtacccctaaccggttcccttaccccgtaccgtaccggtccccccttacccgaaacccggaaccgggggtaccccgtaccggttaccccgggttacccccgtttacccccccggttaccgggtaccccccgtaacccccgttcccccgtaaccccgtaaaccggtaaccggtaccccgttaacccccggttaccggggttacccgggggggtaacccctaaccggtacccggggtaccccggggtacccccgggttacgggggtcccggttacccgggtaccccgggttaccggggttaaccggtaaaccgggttaaccgttaacccgttacccgtaaccgggttcggtaaccgtacccgggtaccggttaccggggacggggtcccgggggtccggttaccggggaccggaaccgggtaccggaacgtagtaaccggtgacctag

SEQ ID NO: 222007 - DNA, 656 bp, Homo sapiens
  misc_feature: GYAE6OF01CLRLI.38.4.A04.1.454.CMB.1.raw
  modified_base (236)..(236): a, c, t, g, unknown or other
  misc_feature (236)..(236): n is a, c, g, or t
  modified_base (328)..(328): a, c, t, g, unknown or other
  misc_feature (328)..(328): n is a, c, g, or t
  modified_base (591)..(591): a, c, t, g, unknown or other
  misc_feature (591)..(591): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagtcgatcacgtcacgaccggtgctcgatttagagtagtgatcagggggggtccctgagactctcctgtgcagcctctgcattcacctttagtaactatttaatgagctgggtccgccacgcctccgagggaaggggctggagtgggtggccagcattaaccaagatggacgtagaaaaatctatgtggactctgtgaagggccatcgccatctccagagacaacgccaagacncactgtcgctgcacatggaacgctgagaggcgacgacacggctgtcgttacttcgtgtcggacgacgacgccccacgtggacgggctaacgnggtgggagccttaacgacgttttcgacgtacggtcggggaccgaacggggtaccctcggtcctccgtcctcctccgacgccctacccgaccgaaccgggccccgtacgttcccggttcccttcccccgtcggaccccgtacccttcccaccaacgacccgaccgtcccgtcgggtaccgggggcctaccggacgcccgggtcccggtcgggccgtccggtaccgttcggtacgtaaccggtaccttaccgtacccgtacggtntaccggcgtacggtacggtcgggccgggtacggtcgggaccgacgggtccgacgaggtacngntg

SEQ ID NO: 222008 - DNA, 799 bp, Homo sapiens
  misc_feature: GYAE6OF01C5C06.38.4.A04.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
  modified_base (791)..(791): a, c, t, g, unknown or other
  misc_feature (791)..(791): n is a, c, g, or t
tcagtcgatcacgtcacgaccggtgctcgatttagagtagtgatcgagggggggtccctgagactctcctgtgcagcctctgcattcacctttagtaacttatttaatggagcgtgggtccgccagcctccggaggggaaggggctgggaggtgggtcggccagactaattaaccgaagtagtagggaacgtaaagaaaaatatagtggtggactcgtaggtaggaacgggtccgtacttaccgacctacttccaccgaaggaacgaacgaaccgaccaaaagacctacgacgttggtcggcncggacacgtaagtacggaaccggtcgaggaaggacggacgaccgacgacggtctaggtacgtacttcgngtcgaccgagtacccgccccagtggacggactaggaggcgganacgtacgttacgttagaacgtcgggtacggggaccgtaccgggaccttggaccctacgttccctacctacgaccccgtcccaaacccggaaccgtaccggacccgtacgttaccggttcccccgttaccccggtacgaccccgttaccccctaaccgtaaccgaacggtacccgtaccgtacccgggtcgggaccgggaccgtaaccggcccgggtccggaccccgggtcggtacccgttcgggaaccccggttacggaaccgtaaaccggttacccttacccggttaaccgacggttacgtaaccggtaccggtacgggtaccgggtacggggacccgggtcggtaaccgggaacggtaacgggccgaaacaggngtccaggc

SEQ ID NO: 222009 - DNA, 680 bp, Homo sapiens
  misc_feature: GYAE6OF01DMFVY.38.4.A04.1.454.CMB.1.raw
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
tcagtcgatcacgtcacgaccggtgctcgatttagagtagtgatcagggggggtcccgtgagactctcctgtgcagcctctgcattcacctttagtaactatttaatgagctgggtccgccagcctccagggaaggggctggagtgggtgccagcattaacaagatggacgtagaaaatactatgtggactctgtgaacgggccattcgccatcctccagagacaacgccaaagaactcactgtggctgcacatgaacgcctgagaggcgacgacacggctgtgtacttctgtgcgagcgccccanggaggctagaggtgggntacgtacgtactttgaccgtacggtcggggaccacgggtaacccgttgtcctaccgttctacctccacgtcccctaccgaaccgtaaccgggcccgttacgtcccgggttcccctttccccccgtcggacccctacccccgttaccgtacccgaaacgaccgtaccctaaccggttcccggtagggggtacccctacggaccgggccccgggtcccggtaccgggtaccgtccggtacgttacgggtaccgtaaaccgttacccttaccgtacccgtacggttacgtaccgtacggtacggtcggtaggggtccggtccgtcgggacccgaacggggtcgtaacgatacggntnacg

SEQ ID NO: 222010 - DNA, 669 bp, Homo sapiens
  misc_feature: GYAE6OF01BGQI0.38.4.A04.1.454.CMB.1.raw
  modified_base (288)..(288): a, c, t, g, unknown or other
  misc_feature (288)..(288): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaggccgattcgccatctcagagacaacgcaagaactcactgtggctgcacatgaacggcctgagaggcgacgacacggctgtgtacttcngtgcgagacgcccccagtcgagggctacgaggtgggagcgtacgtactttggaactagtcggggccacgggtaaccctggtccaccgttctccctcgacgtccctaccgacccgtaacgggccctacgtcccggttccttccccgacttcggcctacccctaccctacccaacgtacgccctaccgtccggtggggaccaaccgtcggacccgggccccgtacgggtcccgtacgggtcccgttacgggtaccgtaaacgggtacccttaacccgtttacccggtaaccggttccggtaaccgttaccgggaccgttaaggggaaccgggtccgggggtacccgtacgggaacggaacgggaccgaccgtaacgtaggcgc

SEQ ID NO: 222011 - DNA, 754 bp, Homo sapiens
  misc_feature: GYAE6OF01A78GS.38.4.A04.1.454.CMB.1.raw
  modified_base (120)..(120): a, c, t, g, unknown or other
  misc_feature (120)..(120): n is a, c, g, or t
  modified_base (749)..(749): a, c, t, g, unknown or other
  misc_feature (749)..(749): n is a, c, g, or t
  modified_base (753)..(753): a, c, t, g, unknown or other
  misc_feature (753)..(753): n is a, c, g, or t
tcagtcgatcacgtcacgaccggtgctcgattttagagtagtgatcagggggggtccctgagactctcctgtgcagcctctgcatttcacctttagtaactatttaatgagctgggtccnccagcctccagggaagggctggagtgggtggccagcaattaaccaagatggacgtagaaaaatctatgtggactctgtcggaagggcctattccgcatcctacagagacaacgccaagaactcactgtgctgacacatgaaccgctagaagagggccgagacacggtctggttactactttccgtggtcggacgtacgggcccgccccctagtaggacgggtaccgttagacggggttagggtacgacttaccggtacgtttcggaacgtacggttacgggggacctaacgggaacccgtcggtacccgtaccgtcgttacccacgaccggtaccctacccgaaccgtacgggtaccctaccgttcccggttaccccttacccccggtccggtacccctacccccgttaccgtaacccgtaaccgaccggtaacccgtacccggttcccgggtacgggggtaacccgtaccggtaaccgggcccgggtcccgggtccgggtaccgtccggtaccggttacgggttaccgaagggttaacccttaccgttacccggtacggtacgttaaccgtaccggtacgtacgggtagggtccgggacgtacgggacgacggtacgacgtaagtcgngtcng

SEQ ID NO: 222012 - DNA, 854 bp, Homo sapiens
  misc_feature: GYAE6OF01CASG4.38.4.A04.1.454.CMB.1.raw
  modified_base (119)..(119): a, c, t, g, unknown or other
  misc_feature (119)..(119): n is a, c, g, or t
  modified_base (848)..(848): a, c, t, g, unknown or other
  misc_feature (848)..(848): n is a, c, g, or t
  modified_base (853)..(853): a, c, t, g, unknown or other
  misc_feature (853)..(853): n is a, c, g, or t
tcagtcgatcacgtcacgaccggtgctcgatttagagtagtgatcaggggggggtccctgagactctcctgtgcagcctctgcattcacctttagtaactatttaatgagctgggtccnccagcctccgagggaaggggctggagtgggtggccagcaattaaccaagatggacgtagaaaaatactatggtggactgtgtggaagggcctattcgccatcctccagacgaaccaacgccaaagaactcactgtggctgcacagtacggaaccggcctaggaaggacggaccgaacgacgaccggtcttaggttcgttaccttcgtaggttcggaccggaacgaccccgcccccgtaggtagggaccgggtacctaacggtagggtacgggaccgtaccgttaaccggtacgttttacggaccgttaccggggtacggggacccggaaccgggtacccgtcgggtaccctacccgttccgtccctacgtacccgtaccccgtacccgaaccccgggaaccgggtacccccgttaccggtttcccccgggtttccccccgtttaccccccggtaccggggtaccccccctaaaccccccgtttaccccgtaacccggtaaaccggtacccgtaaccccggttaccccgggttaccggggttaccgggggaccctaacccgggtacccgggccccgggttcccgggtcggggtaccgttccgggtacccgggttacgggtaaccgtaaaccgggttacccttaccggttaccgacggttaccgacgttaaccggacggtacgggacgggtccgggtacggtcgggaacggacggtccgaagtaggtacgngtagng

SEQ ID NO: 222013 - DNA, 620 bp, Homo sapiens
  misc_feature: GYAE6OF01CKFAX.38.4.A04.1.454.CMB.1.raw
  modified_base (617)..(617): a, c, t, g, unknown or other
  misc_feature (617)..(617): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggaggtgggtggccagcaattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccacgtggacgggctacgaggtgggagctacgtactttgacttacgtcggggccacgggaaccctggtccaccgtctcctcacgccctccaccgaacggcccacgttccggtccttccccgtggcccaccctccctaccaagaccgcctacccgtcgtacgggggaccacgacggcccgggtccgtcgggaccttcggtcccgtagggtaccgtaaacgggtaaccttaccttacccgacggtcgtacgtccgtacggtcgggaccgggtcggggcgtcgggaccgaaacgggtccgactaagacggtcngcg

SEQ ID NO: 222014 - DNA, 733 bp, Homo sapiens
  misc_feature: GYAE6OF01CD1G5.38.4.A04.1.454.CMB.1.raw
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccgaggggaagggctgggaggtgggtggccagcaattaaccaagatggacgtagaaaaatctatgtggactctgtggaacgggccgattcgccatctccagagacaacgccaagaactcactgtggctgcacntgaccgctgagaggccgacgacncggctgtgtacttcngtgcgagccgccccagtggaggctagaggtgggacncctaacggtactttacggacgttaccggtcgggggacccgaacgggtaacccgtcggtacccgtacccggttccctccccgtaccgaacccggtccccctaccccgaacccggtaaccgggggtaccccctaaccggttccccgggtttcccccgtttacccccccggttccgggtacccccgttaccccctccccgttaacccggaaacgtacccggtaccctaaccccgggtttccgggtaccgggggacccaacccgggaccgggtcccgggtccccggtacgggtccgtaccggtcccggtaccgggtaccgtaacggtacccgttaccgttcccgtacggtcgtaccgaccggtacgtgacgggtccggcgtcggacgacgcgactatagngncg

SEQ ID NO: 222015 - DNA, 808 bp, Homo sapiens
  misc_feature: GYAE6OF01DAV55.38.4.A04.1.454.CMB.1.raw
  modified_base (442)..(442): a, c, t, g, unknown or other
  misc_feature (442)..(442): n is a, c, g, or t
  modified_base (671)..(671): a, c, t, g, unknown or other
  misc_feature (671)..(671): n is a, c, g, or t
tcagtcgatcacgtcacgaccggtgctcgatttagagtagtgatcgagggggggtccctgagactctcctgtgcagcctctgctattcctacctttaagtaacttatttaatggagcgtcgggtccgccacgccctccggagggggaaggggcgtgggaggtgggtcggccagctaattaaccgagagtggacgtaagaaaaatctagtcggtaggactcgtggtaggaacgggcctattccgaccattccaccgaagacgaaccaaaccggaccaaaagtaacctcaacgttggtcggcctaggaccaacgtaacggtaacgggaacccggtccgtaagggaacggaccgggaccggaaccggtacggaccgggtcttggttacttacgttcgtggacggccgaacgccccgccccgtagggtcggaacggtactaacggngggttacggggactacgttaacggtacgtttacgaaaccggttccgggacggggaacccgtaaccgggtacccttcgggtaccctaccggttctacccgtacgaccgaccctacccggaaccggccggtaccctcgttcccgtacccccgtcccgtacgacccccttacccgacgacccgaagtcccgccgtaaccggcgggtacggacaccgacgggcccggtccggngtcccgtacggtaccgtacgggtaaaccgaaccggttaccttccgtaccggtaggtacaccggtaccgtacggggtaccggagggtcccggggtgtaccgggaacgcccggggtaaactcggtaagtcgaggctcgg

SEQ ID NO: 222016 - DNA, 611 bp, Homo sapiens
  misc_feature: GYAE6OF01B7SB5.38.4.A04.1.454.CMB.1.raw
  modified_base (328)..(328): a, c, t, g, unknown or other
  misc_feature (328)..(328): n is a, c, g, or t
  modified_base (435)..(435): a, c, t, g, unknown or other
  misc_feature (435)..(435): n is a, c, g, or t
  modified_base (607)..(607): a, c, t, g, unknown or other
  misc_feature (607)..(607): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcaattaaccaagatggacgtagaaaaatctatgtggactctgtggaagggccgattcgccatctcagagacaacgccaagaactcactgtggctgcacatgaacggcctgagaggcgacgacacggctgtgtacttctgtgcgagacgcccccatgagggctacaggtgggancgtacgtactttcgactacgtcggggccacggggtaaccctggtccaaccggtctcctcacgccctaccgaccgaacggccctacgtccggtccctttcccccccgngggtcccctaaccccgtccctaccgaaggaccgccacccgttcggcggggcaccgacggtccggcccgtggggacctcggcccgttagggtaccgaacgggtccttaccgttcccgacggttcgacgtccgacgtcggaggcgggtctcgggacgacggtacgctagtcggncgtg

SEQ ID NO: 222017 - DNA, 693 bp, Homo sapiens
  misc_feature: GYAE6OF01DQAOD.38.4.A04.1.454.CMB.1.raw
  modified_base (688)..(688): a, c, t, g, unknown or other
  misc_feature (688)..(688): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccgagggaagggctggagtggtggccagcaattaaccaagatggacgtagaaaaatctatgtggactcgtgtaggaagggccattccgccatctccgaagacgacaacgccaaagaactcactgtgctgcacatgacggcctgagaggcgacgacgacggctgtgtacttcgtgtgcgagaccgcccccagtgacgggctaacgaggtgggacgactaacgtacgtttagaaccgttacggtcggggaacccgtaacggggaacccgttcggtaccacccggttcctacccgtccgaaccggtccctaaccccgaaccgaaaccggggtcccctaacggtttccccgggttccccttttccccccgacgggtaccccctaacccctaaccccgtaacccgtaacgaccgtacccgttaacccgtcgggtacgggggtaccaaccgacggcccggccgtagggccgtacgccgttaggtaccgaagtaccgtacctccgaacggtgtacgtacgacgtcggagggccgggtctacgggactaaacggcccgaatacgtaacgntgacg

SEQ ID NO: 222018 - DNA, 805 bp, Homo sapiens
  misc_feature: GYAE6OF01BRCXR.38.4.A04.1.454.CMB.1.raw
  modified_base (801)..(802): a, c, t, g, unknown or other
  misc_feature (801)..(802): n is a, c, g, or t
  modified_base (804)..(804): a, c, t, g, unknown or other
  misc_feature (804)..(804): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactctggtaggaagggccgtattccgccatcctaccgagacgaccaacgaccaaagaacctcacgttggtggctgacaacagtacggaaccggcctaggacggacgggccgaaccgacgacgggtcgttggtacgttaccttcgtggtacggaccggacggtaccccgccccccgtaggtacgggacgggtacctaacggagggtacgggacgtaccgttaaccggttacgttttcggaaccgtacgggtccggggacccgtaaccggggtaaccccgttcgggtacccgtacccggttcccttcccgtaccgtaccggtaccccctacccgaaccggtaaccggggccccttaacggtttcccccggtttaccccttccccccggtacgggaccccccttaccccgtacccgtaaccgaacgccgtacccgtacccgttccgggtacgggggaccctacggaccggcccgggtacccggtgggtacccgtcggttaccggtaccggtaaccggtaacccgtaccgttacccgttaccgacggttcgtaaccggtccgtacggcgggtacgggcggttacggcgggacgaaccgggctacgtagacggnngng

SEQ ID NO: 222019 - DNA, 735 bp, Homo sapiens
  misc_feature: GYAE6OF01CY0ZM.38.4.A04.1.454.CMB.1.raw
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
tcagtcgatcacgtcacgaccggtgctcgatttagagtagtgatcaggggggggtccctgagactctcctgtgcagcctctgcattccacctttagtaactatttaatgagctgggtcccgccagcctccgaggggaaggggctggaggtgggtggccagcattaaccaagatggacgtagaaaatactatgtggactctgtggaacgggccgattccgccatctccagacgaaccaacgaccaagacctcactgtcggctgacacatacggaccggctggaggacgggaccggaaccgaccgacggtcgttcggttcgttactttcgtggtacggcggacgaccgaccccccaggtcggacgggactacgtagggacgggtacgtacgttaccgttacgttacgtacgtacgggtacggggacccggaaccggtaacccgtcggttacccacccggttcctccctaccgaccgtccctaccccgaacccggacccgggtccctacggttccccggttcccctttccccccgcggtaccccctaccccgtacctacccgacgaccgtcccgtaccggtccggtcggggaccaccggaccgggcccggtccggtcgggcctcggtccggtacggtactaacgggtaccttccgtaccggacgttacgaccggtccgacggtaccgggcggggttcccgggcggtcgggaaccgtacggggccgtacaggtcgncng

SEQ ID NO: 222020 - DNA, 647 bp, Homo sapiens
  misc_feature: GYAE6OF01D8564.38.4.A04.1.454.CMB.1.raw
  modified_base (220)..(220): a, c, t, g, unknown or other
  misc_feature (220)..(220): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (610)..(610): a, c, t, g, unknown or other
  misc_feature (610)..(610): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccagatggacgtgaaaaatctatgtggactctgtgaagggccgattcgccatctccaganacaacgcaaagaactcactgtggctgcacagtgaacggcctaggagaggcgacgtacacggctgtnttacttcgtgtgcgagccgtccccagtcggngggtctacgngtgggcnccgttagctttgaccttacggnggggtacccacggggaacccttgggtaccaccggttctcccgtcgacgccctcccaaccgaacgggcccctagtccggtccctttccccgcgtaccctacccctcctaaccgagtccgcgtacccgtaccgtcggggcctaaccgaccggccgggacccgttgggacccttcgggacccgttacggtcgaaacgttcccgttacgttaccgaccgttggtaaacctcggtaaccgtgggacccgtccggggtcncgggtaccgaaacgggtccaccggtataccggngcgn

SEQ ID NO: 222021 - DNA, 636 bp, Homo sapiens
  misc_feature: GYAE6OF01D7HJ1.38.4.A04.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccgagggaaggggctggagtgggtgccagcaattaaccaagatggacgtagaaaaatctatgtgactctgtgaggcattcgcatcncaganacacgcaagactcatgngctgcanatgacgctgagagcgacacgacgctgtcgtacttcgtgtcgacgacgacccgaccccgtagtacggacggtctaacgaggtgggactacgttaacgtacgttacgaacgttacggtacgggacccgaaccgggtaccgttcggacccgtaccgtccgtccctcgaccgtccctaccgaacggaccggcctacgtcccggtccctccccgtcgcccctaccctccaccgaacgccgtcctaccgtcggtcgggaccacggtcggcccggccgtcggccgtccgtccggtacggtaaccgacgttaccttaccgtccgacggtcgaccgttacgacggtcggtacgggtcccggtagggtaccgaaccggaacgggtcctacgtaagcgtgcgtacg

SEQ ID NO: 222022 - DNA, 813 bp, Homo sapiens
  misc_feature: GYAE6OF01BV5PB.38.4.A04.1.454.CMB.1.raw
  modified_base (327)..(327): a, c, t, g, unknown or other
  misc_feature (327)..(327): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagccctccgagggaaggggctggagtgggtggccagcattaaccaagatggacgtagaaaaatactatgtggactctgtgaagggccgattcgccatctccagagacaacgccaaagaactcactgtggctgcacatgaacggcctgagaggacgacgacacggctggtgtacttctgtgcgagacgcccccagtgaggcctacgnggtgggagtaccgtacgtacgtttcgaacgtacgtcggggacccaaggggaaccccttggtacctaaccggttcctcccgttacgaacgtaccccgtacccgaacccggtaaacgggaccccgtaacgttcccgggttacccctttaccccccccggttcgggtaccccctaaccccccgttaaccccccgaaaaccggtaccggacccgtaaccccggttaccgggttaccgggggggaaccctaacccgggaccgggtaccccggggtccccccgggttcgggggtacccgttacccgggtaccccggttaacggggttaacccggtaaaacgggttaaccccgtttaacccgtttacccccgtaaacccgggttacggtaaccggttacccgggtaacggttaccgggaaccggggtacccgggggtaccggtacgggaaccggaaaacggggcccggtaacgaacggttaaccgagtgacgc

SEQ ID NO: 222023 - DNA, 823 bp, Homo sapiens
  misc_feature: GYAE6OF01D4BYD.38.4.A04.1.454.CMB.1.raw
  modified_base (150)..(150): a, c, t, g, unknown or other
  misc_feature (150)..(150): n is a, c, g, or t
  modified_base (818)..(818): a, c, t, g, unknown or other
  misc_feature (818)..(818): n is a, c, g, or t
  modified_base (820)..(820): a, c, t, g, unknown or other
  misc_feature (820)..(820): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggaagggtctgggaggtgggnggccagcaattaaccaagagtggacgtagaaaaaattctatggtggactcgtgtaggaacgggcctattccgcctatcctaccgagaacgaaccaaaccgaccaaagtaacctccacttgtaggctcgacacgacgtacggaaccggtcctaggaggacgggaccgaaccgacgacggtctgttcgttacgtttctcggtggaccgtacggaccccgccccccgtaacggttggggaaccgggtaccgttaacggaggggtacggggaacgttacccgtaacggtttacgtttaacggacccgttaccggggtacggggtaccccgaaacggggtaacccccggttcggttaccccgacccgttccttacccgtccgacccgtccccgtacccggaaccggaccccgggtacccttaccgttccccggttccccctttacccccggtccggacccccttaaccccgtcccacccgtaaaccgcccgtacctacccggtccgggtcgggaccctaccgacgggtcccccgggtccgggtccgggaccttcgggtaccccgttagggtaaccgtaacgttacccttacccggtccgaacgtcgtaccgtacgaccggtgggacgggccgggtccgtagggaacccggttaacggccgtaacgtaagcggntnacg

SEQ ID NO: 222024 - DNA, 698 bp, Homo sapiens
  misc_feature: GYAE6OF01B748T.38.4.A04.1.454.CMB.1.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
  modified_base (694)..(694): a, c, t, g, unknown or other
  misc_feature (694)..(694): n is a, c, g, or t
  modified_base (696)..(697): a, c, t, g, unknown or other
  misc_feature (696)..(697): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactctgtgaagggccgattcgccatctccagagacaacgccaagaactcactgtggctgcanatgaacgcctgagaggcgacgacacggntgtgtacttctgtcgcgagaccgcccccgagtggacgggctacgaggtgggatcgtacgtactttacgaccgttacggtcggggacccgaacgggtaacccttggtacccgtaccgttcccgtacccgtaccgaccgtacccctacccgaacccggtaaccgggccccgtaacgttccccgggttacccctttccccccggtacgggtaccccctaccccgtaccctacccgaaacggaccgtaccctaccgttccggtcgggggaccacgtaccgggcccggcccgggttcgggtccgtccggccgttacgggtaaccgtaaacggttaccctaccgttacccgtaggtaccgtacgtaccggtaccgtcgggaggccggggtcgcgggtacgaacgggtcacgtatacgngnng

SEQ ID NO: 222025 - DNA, 639 bp, Homo sapiens
  misc_feature: GYAE6OF01BXF7O.38.4.A04.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (397)..(397): a, c, t, g, unknown or other
  misc_feature (397)..(397): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctggagtggggtggccagcattaaccaagatggacgtagaaaaatactatgtggactntgtggaagggccattcgccatctccagagacaacgccaagaactcactgtggctgcanatgacggcctgagaggcgacgacncggctgtnttacttctgtgcgagccgccccagtcggagggctacgaggtgggagcgttacgtactttcggactacggtcggggaccctaacggggaccctcggtccaccgttctcccncacgtccctccaaccgacggcccacgtccgggttcccttcccccgtcggaccctacccctcctaccgaacgcgcctaccgtcggtcggggccacgcggcccggcccgtgggtcctcggtccgtcgggtaccgaacggtaccttaccgttacccgtacggttagaacgttccggaccggttgggaacgggtccgggggtccgtacggggaccggtaacggggaccgtacgaaggttncgngtc

SEQ ID NO: 222026 - DNA, 856 bp, Homo sapiens
  misc_feature: GYAE6OF01CDY6O.38.4.A04.1.454.CMB.1.raw
  modified_base (853)..(853): a, c, t, g, unknown or other
  misc_feature (853)..(853): n is a, c, g, or t
tcagtcgatcacgtcacgaccggtgctcgatttagagtagtgatcgagggggggtccctgagactctcctgtgcagcctctgcattctacctttagtaactatttaatgagcgtggtccgccagcctccgagggaggggctgggaggtgggtcggccagctaacttaaccgaagtagtaggaacgtaagtaaaaaactcgtagtggtcggacttcgtggtaggaacgggtcctaattccgacctattcctaccgaggaacgaaccaaccggaccaaagtaacctcgtacgttggtacggcctagaccaactagtacggaaccggccgaggacgacgggaccgtaacccggaacgacggtcgttcggttacgttacgtttccgtgggtacgaaccggacgaccccggtaccccccgtaggtcggggaaccggtaccgttaacggaggggtacgggtacggtaaccgttaccggttaaccgttttacggaaccggttacggggtccggggaacccggtaaccgggtaacccgtggtacccgtacccggtcctacccgttacgcctacccgtacccgaaccgggtaccggcctacgttcccgtaccccgtccccgacgcccctaccctaccgtaccaagtcccgtacccgtaccgtacgggtcccgggaccacccggaccggtccccgggtccggtaaccgggtcccgttaccggtacccgggttaaccggtaccgtaaaccgggttacccttaccggtaacccggtacggttacgaccggttaccgtaacggggtacggacggggtccgggtacggttaccgggaacggaaccgggtaccgacgttagacgcggngag

SEQ ID NO: 222027 - DNA, 694 bp, Homo sapiens
  misc_feature: GYAE6OF01CRKTW.38.4.A04.1.454.CMB.1.raw
  modified_base (655)..(655): a, c, t, g, unknown or other
  misc_feature (655)..(655): n is a, c, g, or t
  modified_base (663)..(663): a, c, t, g, unknown or other
  misc_feature (663)..(663): n is a, c, g, or t
  modified_base (680)..(680): a, c, t, g, unknown or other
  misc_feature (680)..(680): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcttgggttttcctgttgcttattttagaggtgtcagtgtgaggtgcgaacgtggtggagtcggtgggggagtcgttgggtccgacggggtcccggggggttccctggaacgtccttcgtccgtagtcgcgtacgtccttcgtgacctacttcctaaccgtttaagtaacttaatttaacgtggtacgtcggtcgggtacccacctaccgcccgtaccggaagggggtaacggggtccgtaggggttacggtcggggtcggaccgtaagtaccgttaaagtttaaaacccgaaggtacggtacggtaaacgtaaagtaaaaacgttacgtagtacggtacggtacttcggtaggtacgggaacgggtcctaacttccggacctacgtccgtacgaacggaactaacgaaacccgtacaaacgtactacgacgttggtacgtcgtcgacacgtatacggaccgtcgaggacgtacggaccgacgacgacgtccgtggtactagtcgtggacgngacgaccncccgagagcgtcgacgngggcgcgtctacgg

SEQ ID NO: 222028 - DNA, 733 bp, Homo sapiens
  misc_feature: GYAE6OF01E201B.38.4.A04.1.454.CMB.1.raw
  modified_base (257)..(257): a, c, t, g, unknown or other
  misc_feature (257)..(257): n is a, c, g, or t
  modified_base (727)..(727): a, c, t, g, unknown or other
  misc_feature (727)..(727): n is a, c, g, or t
  modified_base (731)..(731): a, c, t, g, unknown or other
  misc_feature (731)..(731): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccgaggggaaggggctgggaggtgggtggccagcaattaaaccaagagtggacgtagaaaaatactatgtggactctgtgaagggcgattcgccatctcagagacaacgcaagactcactgtgctgcacangaacgctgagaggcgacgacgacggctgtgtacttgtggtgcgacggaccgccccctagtggacggtactacgaggtgggacgtacgttacgtctttagaccgttacggtacggggacccgtaacgggtaacccgtcggtacctacccgtctacccgtcgaccgccctacccgaacccggaaccgggtcccgtacggttcccgttccccttaccccccgtcgggtacccctacccctacccgtaccgaaacggaccgtacccgtacccggtcgggaccgggggacccaaccgggaccgggtccccggggtaccccgggtcgggtcccgtaccgggtcccgttaacgggtaccgtaaaccgggttacccttacccggttccgaaccggttacgtaacgttaccggtacgggtcgggtacggggacccgggtccggtacgggaacccgtaacggggccgtaccgaaaggtcngtancg

SEQ ID NO: 222029 - DNA, 739 bp, Homo sapiens
  misc_feature: GYAE6OF01BOU50.38.4.A04.1.454.CMB.1.raw
  modified_base (314)..(314): a, c, t, g, unknown or other
  misc_feature (314)..(314): n is a, c, g, or t
  modified_base (424)..(424): a, c, t, g, unknown or other
  misc_feature (424)..(424): n is a, c, g, or t
  modified_base (582)..(582): a, c, t, g, unknown or other
  misc_feature (582)..(582): n is a, c, g, or t
  modified_base (735)..(735): a, c, t, g, unknown or other
  misc_feature (735)..(735): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
tcagtcgatcacgtcacgaccggtgctcgatttagagtagtgatcgagggggggtccctgagactctcctgtgcagcctctgcattctacctttagtaacttatttaatgagcgtcgggtccgccacgcctccggaggggaagggggctgggagtcggggtcggccagctaattaaaccaagagtagggacgttagaaaaattctagtggtggtactcgtggtggaacggggtcctattccggacctattcctccgaaggaagaaccgaaaccgtaccaaacgtaacctcgaacgttgggcggactggaccaanagttcggaacggcctaggaaggacggaccgaacgaccgacgggtctcggtacgttacgttccgttgtcggacggacgaccgtacccccaggtaggacgggtactaacggnggtacgggacgtaccgtacgtactttcgacgtacgggtcgggaccggaacggtacccgtcggtccctaccggtccttaccgcaccgtccctaccgaccgtaacgggccctacggtccgtcccgttccccgacgccctaccctccgtacacgtcgaccnccgttcggacggaccacggtacgggcccgtcccggtcgggctttaccgggccggtaccggttaacgtaccggtacctttacccgccggttaagcccgtacgtacgtcggacggtccggagggttccgacggaccgcgggtacacgtaagtcgngngn

SEQ ID NO: 222030 - DNA, 584 bp, Homo sapiens
  misc_feature: GYAE6OF01DOSUO.38.4.A04.1.454.CMB.1.raw
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagtcgatcacgtcacgaccggtgctcgatttagagtagtgatcagggggggtccctgagactctcctgtgcagcctctgcattcacctttagtaactatttaatgagctggtccaccagcctccagggaaggggctggaggtgggtggccagcattaaccaagatggacgtagaaaaatctatgtgactctgtgaaggccattcgccatctccagacgacaacgccaagaactcactggtgctgcacatgaacggcctgagaggcgacgacgacggctgtgtacttctgtgcgagaccgcccccagtggaggctacgnggtggganctacgtactttgactacgtcggggccaacgggaccctggtaccaccgtctccctcacgtccctaccgaccgacgggccctacgtccggttccccttcccccgtggcccctacccctccctaccgaacgtcgcctaccgtcggcggggccacgcgcccggtcccgtcggtccgttcgccgtggtacgaacggtacttacgtccgacgtgacgtcgacgtggaggcgggcgtgggctaacgggccgacgtagacgngn

SEQ ID NO: 222031 - DNA, 792 bp, Homo sapiens
  misc_feature: GYAE6OF01BEQBT.38.4.A04.1.454.CMB.1.raw
  modified_base (296)..(296): a, c, t, g, unknown or other
  misc_feature (296)..(296): n is a, c, g, or t
  modified_base (788)..(788): a, c, t, g, unknown or other
  misc_feature (788)..(788): n is a, c, g, or t
tcagtcgatcacgtcacgaccggtgctcgatttagagtagtgatcagggggggtccctgagactctcctgtgcagcctctgcattcacctttagtaactatttaatgagctgggtccgcagcctccagggaagggctggagtgggtggccagcaattaaccaagatgggacgtagaaaaatactatgtggactctgtgaagggccattcgcatctcagagacacgcaagaactcactgtgctgcacatgaacggctgagaggcgacgacacggctgtgtacttctgtgcgagaccnccccgagtggacgggtactacgagggtgggacgtcgtaacgtacgtttacggaaccgttacggtcgggggacccgtaacggggtaaccccgttgggtaccctaccggttcccttcccgtacgaccggtccccttacccgaacccggtaaccggggtacccctacggttcccgggttcccctttcccccccggtcgggtaccccctaacccccgtaccctacccggaaaccggtaccgtaccccgtacccggttcccgggtacggggggtacccaaccgggtacccggggacccccgggttccccgggtcggggtcccgttacccggggtaccccgtttaacgggggttaacccgtaaaccgggttaaccctttaaccccggttaccccgtaacggggttaccgtaaaccgttcccgggaaccggttcggggaccgggtccgggggtaccggtcggggaaccgggtaacgggcccgtaacggtaaagtcggtnagcg

SEQ ID NO: 222032 - DNA, 737 bp, Homo sapiens
  misc_feature: GYAE6OF01BV4AU.38.4.A04.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (734)..(734): a, c, t, g, unknown or other
  misc_feature (734)..(734): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaatctatgtgactctgtgaacggcattcgccatcnccgagagaccaacgccaagaacctcactggtgctgcanatgaaccgcctgagaggcgacgacgacggctgtgtacttntgtgacgagaccncccccgagtggacgggctacgaggtcgggactctacgtactttgaaccgttcggtcggggacccgtacggaacccgttggtaccctaccgtccttcccacgacgccctaacccgacccggaacgggtcccctaccggttccggttccccgttcccccgtcggaccccctaccccgtccctaccgaacggtacccgccgtaccccggttcgggtaccggggtacccacccggtaccgggccccgggtaccccggttcggggtacccgttcccgggtacccggtttacgggtaacccgtaaccgggttaacccttacccgtttaaccccggcggttaaccggtaccggttacccgggacgttaccgggtaccggggtaccgggtccggtcggggtaaaccgtaaacccggggcgtaacccgtaaggtggccngcg

SEQ ID NO: 222033 - DNA, 704 bp, Homo sapiens
  misc_feature: GYAE6OF01DFEU9.38.4.A04.1.454.CMB.1.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (700)..(700): a, c, t, g, unknown or other
  misc_feature (700)..(700): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggagggctggagtggtgccagcattaaccaagatggactagaaaaatactatgtggactctggtgaagggccattcgccatctccagagacacgccaagaactcactgtgctgcacatgaacgcctgagaggcgacgacacggtctagtgtacttntgtagcgagacgcccccatggaggcctaagngtggganccgtaacgtactttgactacggtcgggaccgaacggaccgtggtccaccgtctcctcgaccgtccctaccgaccgtaacgggcccgacgtccgggttaccccttcccccggtacggtacccccgtacccctaccccgttaacccgaaccgggtacgccccgtaacccgttccggtacggggggacccacccgaccgggtaccccgggtccccggttcgggacccggttaccgtaccccgggtcgggttaaccgtaaacggtaacccgtttacccggttacccgtaacccggttggtaaccgttaccggtaccggtacgggaccgggtccgggttacggaccgggtaccggaaaacgggtccggtaaacagttaacgncgtg

SEQ ID NO: 222034 - DNA, 743 bp, Homo sapiens
  misc_feature: GYAE6OF01CAR7N.38.4.A04.1.454.CMB.1.raw
  modified_base (283)..(283): a, c, t, g, unknown or other
  misc_feature (283)..(283): n is a, c, g, or t
  modified_base (737)..(737): a, c, t, g, unknown or other
  misc_feature (737)..(737): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcattaaccaagatggacgtagaaaaatactatgtggactctgtgaaggccattcgccatctccagagacaacgccaagaactcactgtggctgcacatgaacgctgagaggcgacgacacggctgtntactcgtgtgcgagacgcccccagtggaggctacgaggtgggacgctacgtactttgactacgcggggaccacgggaaccctggtccaccgtcctccctacgacgtccctaccgaacccgaacggggtcccctaacgttcccggttcccctttccccccggtcggtaccccctaacccccgttccctaacccgaacggaccgtcccgtaacccgttccgggtacgggggtacccaaccggtaccgggccccgggtacccggttcgggggtcccgttaccgggtaccccggtttacggggtaacccggtaaaaccgggttacccgtttaaccccgtttaccccgggtaaaccggttaccgggtacgttaccccgggttaacggttacggggaccgggtacccggggtcccggtacggggtaaccggaaccggggtaccgaacgtaacgttacggngtagcg

SEQ ID NO: 222035 - DNA, 916 bp, Homo sapiens
  misc_feature: GYAE6OF01CY7KL.38.4.A04.1.454.CMB.1.raw
  modified_base (162)..(162): a, c, t, g, unknown or other
  misc_feature (162)..(162): n is a, c, g, or t
  modified_base (273)..(273): a, c, t, g, unknown or other
  misc_feature (273)..(273): n is a, c, g, or t
  modified_base (410)..(410): a, c, t, g, unknown or other
  misc_feature (410)..(410): n is a, c, g, or t
  modified_base (810)..(810): a, c, t, g, unknown or other
  misc_feature (810)..(810): n is a, c, g, or t
  modified_base (893)..(893): a, c, t, g, unknown or other
  misc_feature (893)..(893): n is a, c, g, or t
  modified_base (907)..(907): a, c, t, g, unknown or other
  misc_feature (907)..(907): n is a, c, g, or t
tcagtcgatcacgtcacgaccggtgctcgatttagagtagtgatcagggggaagaccgatgggcccttggtggaggcttggtccaggcccgggggggtccctgagacctctcctgtgcacgtcctctgcctattccaccttttaagtaaacttagtttaagngagtcgtcgggtccaccacgcccgtaccggaagggggaaggggtcgtaggggaggtcggggtcggccaaggactaagttaaaacccgaagtacgtacgggaacggttaaanaaaaaatttcgtagttcgggacggtaaaccttggttagggtaaggaaccgggggtccttattccccggacttaatcccggtaaccgaaggaacggaaaccaaccggtaaccaaacgtaaccttcgagtaggtccggntacgacctacgagtaccggaaccggtactgggaacgcgggaccaacgcgttacgggctaggttacttccgtgtacgtcgggaaccggtacaaccccgcccgtaggaggggacgtaacgtaccggtagggtacgaccggttacttaaccgggtttactaccggtaacgttaccggggacggggacccggtaacgggtaaccccgacggttaccccgaacccgttaccggttcccctaaccggacccgtttaccccggaacccgaaaccccggggtaacccggtaaccccgttaccccggttccccggtttacccccgttaccccccggttccgaacccccttaaccccgttccgaaccccggtaacgcccgtacccgtaccggtcggggtaaccggacccnccgggttacccgccggtcccggtcgggcctttcggggactacggaaaccggttaccgttactttacccgacccgtaagggtanacccggtacccggnggtacgggg

SEQ ID NO: 222036 - DNA, 789 bp, Homo sapiens
  misc_feature: GYAE6OF01EMFB6.38.4.A04.1.454.CMB.1.raw
  modified_base (178)..(178): a, c, t, g, unknown or other
  misc_feature (178)..(178): n is a, c, g, or t
  modified_base (371)..(371): a, c, t, g, unknown or other
  misc_feature (371)..(371): n is a, c, g, or t
  modified_base (579)..(579): a, c, t, g, unknown or other
  misc_feature (579)..(579): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggagttgggctgagcgttgggtttttccttgttgcttattttagaggtntccagtgtgaggtgcaacgtgggtggaggtcggtgggggaggtcgtttcgggtccgacggggcccgggggggtccctggacgtacctcctccgtgtgccacgtcctctggctactttacctaccttttaagttaaacttatttaagtgacgtcgtcgggtcccgccacggccctcggaggggagggcgtgggnggtcgggtcgccgtagactacttaaccgaagagtaggaacgttaaagaaaaacttacgtacgtggtacggtacttacggttacgtagggaacggggtacccgttaacgttccgaacccgtactttaccgtacccgtaaggaacccgtaaaccgaaacccggaaaccctaaaacggaccctttaaccgacgtttacgggcgggttaacnccggtacctacgaacgttaccgggaaccgtccggtacggaaccgggtacggacccggtaacgaacccggtacgggtcctttacgggttactttaaccggtttcggtacggtcggtacccgggtaacgtacccccgtaccccccggaggtaccggggaaccgggttacccgtaacggttaggggtccgggtaaccgtccgtttaacccggg

SEQ ID NO: 222037 - DNA, 771 bp, Homo sapiens
  misc_feature: GYAE6OF01ECBP5.38.4.A04.1.454.CMB.1.raw
  modified_base (569)..(569): a, c, t, g, unknown or other
  misc_feature (569)..(569): n is a, c, g, or t
  modified_base (761)..(761): a, c, t, g, unknown or other
  misc_feature (761)..(761): n is a, c, g, or t
  modified_base (767)..(768): a, c, t, g, unknown or other
  misc_feature (767)..(768): n is a, c, g, or t
tcagtcgatcacgtcacgaccggtgctcgattttagagtagtgatcagggggtccctgagactctcctgtgcagcctctgcattcacctttagtaactatttaatgagctgggtccgccagcctccgagggaaggggctggagtgggtggcaactatatcatatgatggtaagttttaaagactatgcgactcgtagaggcattcacatctccagagacaattccaagagcacactctatttgactaaatacgaacacgccgtagggacgcgtaggaggaccgacggtctagttcttagtttacgtggtacggaaccggaaaaccggtaccccggtcccttacgttaagggttcgggggtacgggggtaagtttagttcgggtccggtacgggggaccgaaccgggtaacccgttcggaccccgtaccggttccctaccgttccgaaccggtcccctaacccggaacccggaaacccgggtccccttaaccggttccccggtttccccgtttcccccggtccggggtccccgtccccggtcgtacccgtaccccggaacggggtacccncccgaaccccgttaccggaacggaacgccctaacgaccgggcccgtcccggtcgggtacctcggtaccggtcgtaacccgggaaacgttcccgtttaaaccgttcccggaacgttccggtaagtccccggaggtacggaccgggtccggggtaacgtcgggacgggtaacggccggtaacacggttaagccngatcgnngcg

SEQ ID NO: 222038 - DNA, 910 bp, Homo sapiens
  misc_feature: GYAE6OF01AO5B2.38.4.A04.1.454.CMB.1.raw
  modified_base (114)..(114): a, c, t, g, unknown or other
  misc_feature (114)..(114): n is a, c, g, or t
  modified_base (148)..(148): a, c, t, g, unknown or other
  misc_feature (148)..(148): n is a, c, g, or t
  modified_base (338)..(338): a, c, t, g, unknown or other
  misc_feature (338)..(338): n is a, c, g, or t
tcagtcgatcacgtcacgaccggtgctcgatttagagtagtgatcagggggaagaccgatgggcccttggtggaggcttggtccgaggccggggggtccctgagactctcctgngcagcctctgcattcactttagtactatttaagngagcgtcgggtccgccagtccgaccgaaggggaaggggtctggaggtggggtcggacccagactaattaaccgaagacgtgggaacgtaagaaaaactacgtagtagtacggtactgtagtaggaaggccgtatccgaccatccacgagaacgaccgaacgaccaacggtaactcctagtaggttccggngttacgacgactacggtacggtaaccggaccggtaggacggtacgggaccgaacggaccgtacggtccttaggtacgttaccttcggtcgtggaccgtaacgcccgtaccccgtagtacggtacggaccgtaggacggtagggaccgtacgttacggtacgtttaacggaccgttaccgggtacgggtacccgggtaaccggtacccgtaccgtacccgtacccggttcctaacccgtaccgtacccgtaccccggttaacccgacccgggtaaacccggggtccctaaccggtttcccggttacccccctttacccgttacccggacccccgttacccgttaacccgacccgttaaaccggtccgtaacccggtttacccgggccgggtaccgggtaaccccgtaacgggttaaccccgggcccggggtttaccccgaccggggttcccggttaccgggttacccgggtttaaacccggaacccggttaaaccgggttacccgttttaaccgggtaaccccggtcggttaacccgggttaacctttaccccgggggaagtaaccccggggg

SEQ ID NO: 222039 - DNA, 600 bp, Homo sapiens
  misc_feature: GYAE6OF01AD36M.38.4.A04.1.454.CMB.1.raw
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccagggccgggggggtccctgagactctcctgtgcagcctntgcattcactttagtaactatttaangagctgggtccnccagcctccgagggaagggctggagtgggngcagcattaacagngtggacgtagaaaactctatgtgactcgtgtaggaacgggcccgtaagtttccgacctagttccgtaccgagtaacgaaccaaaccgacccaagtaacctccacgttaggcggcgtacgcctacgaagtcggaacggccgtaggaacggacgggaccgaaccgacgacggtctaggttcgtactttcgcgtacggccgagacccggcccccaggtacggacgggtaccacgtagggngggtacgtcggttaaccgg

SEQ ID NO: 222040 - DNA, 672 bp, Homo sapiens
  misc_feature: GYAE6OF01D0AQH.38.4.A04.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggaaggggctggagtgggtggccagcaattaaccaagatggactagaaaaatctatgtcgactctgtgacggccattcgccatctccagacgacaacgcaaagactcactgngctgctacngtacgaacgcgtgagaggcgacgacgcggcttgtcgtacttcgtgtcgacgacgaccgccccctaagtcggaacgggctaacggtaggtcgggactcgtaacgtatttcgacgtacggtacggggaccctaacgggtaaccctggtcctacgtccgtaccgtccgaacgtcccaccgtaacccggaacgggtaccctacggttcccggttacccctttacccccgtcggaccccttaccccgtacccgtaccgaaacgtcgaccctaccggttccggtacgggacctacggaccggccgggtacccgtgggtaccgtcgtaccgttacggtaccgaacggttacccttacttaccggaccgtagtaacgtcgtaccgtcgggaggaccggtgaccggtacgaacggtcgacaagtcagctag

SEQ ID NO: 222041 - DNA, 844 bp, Homo sapiens
  misc_feature: GYAE6OF01BIFYW.38.4.A04.1.454.CMB.1.raw
  modified_base (837)..(837): a, c, t, g, unknown or other
  misc_feature (837)..(837): n is a, c, g, or t
  modified_base (842)..(842): a, c, t, g, unknown or other
  misc_feature (842)..(842): n is a, c, g, or t
tcagtcgatcacgtcacgaccggtgctcgatttagagtagtgatcagggggggtccctgagactctcctgtgcagcctctgcattccacctttagtaactattaatgagctcgggtccgccacgcctccgaggggaagggctggagtgggtgccagctaacttaaccaagtatggaacgtaagaaaaatactagtgtggactgtagtgaacgggccgattccgcactctccagacgacaacgactaagactcacgtggtcgctgacaacgagtacggaaccggccgtagggaacggacgggaccgtaccggaaccggacggttacgtggttacgttaccgttcgtggtcgaacggaccgtaccccgacccccgtaggttagggaccggtcgtaaccggaggttcgggaactcgttaaccgttacgtttacggaaccgtaaccggggtcggggaacccgtaaccggggtacccgttcggtaccccgtacccgttcctacccgtaccgacccggtaccccgttcccgaaaccccgggtaaccgggtccccgtaccggtttaccccgggtttaccccctttcccccggtacccgggtacccccgtaacccctccccggtaaccgaacccgttacccgaccccggtttaacccggtccgggtaaccggggtaacccacccgggaccggtccccggttacccgggttccgggtccggtaccggtaccggttacggtaaaccgtaaacggttaccccttaccggtaccgtacccgggttagtaccgttacccggacggtacgggtacgggaccggtccggaccggtacggacgtcgaccggancggtngc

SEQ ID NO: 222042 - DNA, 279 bp, Homo sapiens
  misc_feature: GYAE6OF01D5VM6.38.4.A04.1.454.CMB.1.raw
  modified_base (112)..(112): a, c, t, g, unknown or other
  misc_feature (112)..(112): n is a, c, g, or t
  modified_base (211)..(279): a, c, t, g, unknown or other
  misc_feature (211)..(279): n is a, c, g, or t
tcagtcgatcacgtcacgaccggtgctcgatttagagtagtgatcgagggggggtccctgagactctcctgtgcacgctctgctattctaccttttaagtaacttatttaangacgtcgtcgggtccgccacgcccacggaggggaggggctgggaggttgggcgaccagacaaagttaaccaagtagtcgggaacgttaaagaaaaaacnnnnnnnnnnnnnnnnnnnnnnnnnnnnnnnnnnnnnnnnnnnnnnnnnnnnnnnnnnnnnnnnnnnnn

SEQ ID NO: 222043 - DNA, 677 bp, Homo sapiens
  misc_feature: GYAE6OF01A82GW.38.4.A04.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (430)..(430): a, c, t, g, unknown or other
  misc_feature (430)..(430): n is a, c, g, or t
  modified_base (675)..(675): a, c, t, g, unknown or other
  misc_feature (675)..(675): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctcgagggaaggggctggagtgggtggccagcattaaccagatggacgtagaaaaatctatgtggactctgtgaaggcattcgcatctcagagacacgcaagactnactgngctgcacatacggaacgcctaggagacgggcgaaccgacgacggcttgtacgttactttcgaggtcggacggacgacccgcccccgtaagtggacgggtaccttagagggtacgggagtaccttaacggtactttaggaccgttacggtcgggggacccgtaacgggtaacccgttcggacctaccgtcctccgtacncgtcccgtaccgaccggtaaccggccacgttcccggtccctttccccgcggtacccctaccctcccgtaaccgaacgaccgtccgtacccgtcgggtcggggaccacggtaccggcccgggtcccggtggtacccgtcgtcccgggttacggtaccgtaacggtaccttaccgttaccgaggttacacgttccgacgtcgggacggtaccgggtcgtcgggaacggacggtacacgtagtcgcgncg

SEQ ID NO: 222044 - DNA, 847 bp, Homo sapiens
  misc_feature: GYAE6OF01BKJ0F.38.4.A04.1.454.CMB.1.raw
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
  modified_base (832)..(832): a, c, t, g, unknown or other
  misc_feature (832)..(832): n is a, c, g, or t
tcagtcgatcacgtcacgaccggtgctcgatttagagtagtgatcagggggaagaccgatgggcccttggtggaggcttggtccaggccgggggggtccctgagactctcctgtgcagcctctgctattcacctttagtaacttatttaaagtgagtcgtcgggtcccgacccacgcccgtccggaagggggaaggggtcgtggggaggttgggggtcggacccgagacctaacgtttaaaacccgaagggtagttacgggaacgtaaaggaaaaaattacgtaagttggtcgggaacttgtaggtaggaacgggccgtattccgactacgtcaccgagacacgacacaagactacngtggcgctacgcacgataggacccgtgngacgagggccgtaacgaccgacggtctaggttctctttacgtggacggacggaccggttacccgaccccgtaggacggtacgggacctacggtgggtacgggaagttacccggttaactacgttttaacggaccgtaccgggtcggggtacccgggtaaccggtacccgttacgggttccccgttaacccgtccttacccggtaccgtaccgtacccccgtaccccgttaaccgggacccgggtacccttacccggttaccccggtttcccccgtcccccgttacggtacccccttacccccggttccccgaaacgtaccggacccgtaccggtacccccgtaggggtacccggggcacccgccgggacccggttcccgggttcggaacccgttcggtaccgtacggttacggaccgtttaacccgtccgtacgttcggtagtaccngggtccgtaacgggg

SEQ ID NO: 222045 - DNA, 720 bp, Homo sapiens
  misc_feature: GYAE6OF01CGM5Y.38.4.A04.1.454.CMB.1.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
tcagtcgatcacgtcacgaccggtgctcgatttagagtagtgatcaggggggggtccctgagactctcctgtgcagcctctgcattcacctttagtaactatttaatgagctggtccgccagcctccgagggaaggggctgggagtgggtgccagcattaaaccagatggacgtagaaaaatctatgtggactctgtggaagggccgattcgccatcctccaganaccaacgccaaagaactcacgtgtggctgcanatgaacggcctgagaggcgacgacacggctgtgtacttcnggtcgacgacgacncccccagtggacgggtcacgacggtgggacgtactacggtactttacgacgtacgacggggaccacggggaacctggtccacccggtctccctacgacgtccctaccgacccggtacgggaccctacgttccccggttccccttaccccccggtcggaccccgtcccgtccggcccttacccggaacgggtccgtccctaacccccggtccggaacggaccgaccggttaacccggacggtccccggggtacccccggttgggcccgttaccgggtacccgtttacggggtacccgtaaacggtacccttacccgttccccgtaaccgggttgtaaccggtccggtacgcgggttacccgggaccggggttcacgggggaccgtaaccgggtacgaccggtaagccgtg

SEQ ID NO: 222046 - DNA, 587 bp, Homo sapiens
  misc_feature: GYAE6OF01A8FV3.38.4.A04.1.454.CMB.1.raw
  modified_base (196)..(196): a, c, t, g, unknown or other
  misc_feature (196)..(196): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (487)..(487): a, c, t, g, unknown or other
  misc_feature (487)..(487): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
tcagtcgatcacgtcacgaccggtgctcgatttagagtagtgatcgaggggggtccctgagactctcctgtgcagcctctgcattcacctttagtaactatttaatgagctggtccgccagcctcgagggaggggctggagtggtggccagctaattaaccaagatggacgtagaaaaatctatgtggactcgtgngaagggccattcgcatcgtccagagacaagcctaagactcatgngctgcanatgaacggcctgagaggcgacgacgacggcttggtacgtacttgtcgtgcgtacgaaccgccccaagtcgaagggtctacgagtcggganacgttacgactttgaacttagcggggcacggtacccngggttcacgtctacgtcaggccctacacgaagggccctagtccgtcctccccgtcggcaacccgtccacccgaagaccggacctaccgtcgtacggggcaacgcgccgtccgngggtcctacggtccgtacggttacaacggaccgttacgtcctaagtcgtaaacgtcgtaacgcgtggaccggtcgagacgaggtcgacgtagacgngcgn

SEQ ID NO: 222047 - DNA, 730 bp, Homo sapiens
  misc_feature: GYAE6OF01B2XVU.38.4.A04.1.454.CMB.1.raw
tcagtcgatcacgtcacgaccggtgctcgatttagagtagtgatcggagggggggtccctggagactctcctgtgcagcctctgcattcacctttagtaactatttaatgagcgtggtccgccagcctccgagggaaggggctggaggtgggtggaccagcaacttaaccgaagagtcggaacgttacgaaaaaattactacttggtacggacttcgtggtaggaaacggggtccctattccggacctaatctacccgagacgaacaaccgtccaaagaaccgtcaactgtggctgacacagtgaacggcctgagagcgacgaccaggctgtacgtacttactggtgacgacgacgcccccagtcggacgggactacgaggttcggggaacaccgtacgtactttcgaacgtaccgtggggaccgaacgggtaaccctgggtcctaccggtctaccgtcacggtccctaccgaacccgacgggccctacgtccgttccccgttcccccgaggtcccaccccttcctaaccgaaagtaccgacccgtaaccgtcggttacgggggaccaaccggtacggacccgggtcccgtggggtacctacggtcccgttagggaaccgttaacgggtacccttacgttacccgggaatttaacggcccgtaacgggtcggaacgggccgggacgttaccgggagaaacccgggctacccggtaataacggtcagcacg

SEQ ID NO: 222048 - DNA, 688 bp, Homo sapiens
  misc_feature: GYAE6OF01BU9LW.38.4.A04.1.454.CMB.1.raw
  modified_base (298)..(298): a, c, t, g, unknown or other
  misc_feature (298)..(298): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagtcgatcacgtcacgaccggtgctcgatttagagtagtgatcgagggggggtccctgagactctcctgtgcagcctctgcattcacctttagtaactatttaatgagcgtgggtccgccagcctccgagggaaggggctggagtgggtggccagcattaaaccaagatggacgtagaaaaatactatggtggactcgtgtgaagggccgattcgccatctcagagacaacgccaagaactcactgtggctgcacagtgaacggctgagaggcgacgacacggctgtagtacttcngtgcgagaccgcccccagtggacgggcctaacgagggtagggaacgtcgttaacggtacgttttcggaacgttaacggtcgggggacccgtaacggggtaaaccccttgggtaccacccggttacgtccccttacgaaccgtccctacccgacccgaaacggggtcccaacgttccggttccctttccccccgtacgggcccctaacccgttacccctacccgaaacggaccgcccgtacccgttacgggtcggggacctacggacggcccggccggtcgggacgtcggtcccgttacgggtaccgtaaaggtaccgtaaccttccgacgtcgtacgtaccgacgtcggacgggcggtccgtacggcgtaacggcgacgtaatcgngngn

SEQ ID NO: 222049 - DNA, 814 bp, Homo sapiens
  misc_feature: GYAE6OF01EIXAU.38.4.A04.1.454.CMB.1.raw
  modified_base (782)..(782): a, c, t, g, unknown or other
  misc_feature (782)..(782): n is a, c, g, or t
  modified_base (810)..(810): a, c, t, g, unknown or other
  misc_feature (810)..(810): n is a, c, g, or t
  modified_base (812)..(812): a, c, t, g, unknown or other
  misc_feature (812)..(812): n is a, c, g, or t
  modified_base (814)..(814): a, c, t, g, unknown or other
  misc_feature (814)..(814): n is a, c, g, or t
tcagtcgatcacgtcacgaccggtgctcgatttagagtagtgatcgagggggggtccctgagactctcctgtgcagcctctgcattccacctttagtaacttatttaatgagcgtgggtccgccagcctccgagggaaggggctggagtgggtggccagctaattaaccaagatggacgtagaaaaatctatgtggactcgtgtaggaacgggccattccgcatctcagagacaacgaccaagaactcacgttggtgctcgacacagtaggaaccggccgtaggaaggcggccgaacgtacgacggtctgttgtactttcgaggtcgcggacgacccgacccccgtaggtcggaacgggtcctaacggtagggtacgggacgttaaccgttaacgttacggttttacggaaccgttaaccgggtccgggggacccgaaaccgggtaacccgtcgggtaccctaccggttacctccccgtacgacccgtcccccgttaacccgaaaccccggtaaccggggtaccccgttaccgtttcccccgggtttacccccgtttccccccccggtacgggtacccccccttacccccgtacccgttaacccggaaacgtacccgtacccgtacccgggttcccgggtaccgggggacccaaccggtacccgggcccgggtccccggtggggtccctccgggtacccgttacgggtaaccgtaaccggttaccttacccgttccgtaacggtcgtacggaccgtcgtacgggaccggggccgggttaacncgggtaacggaacggtccgaataggacngngn

SEQ ID NO: 222050 - DNA, 588 bp, Homo sapiens
  misc_feature: GYAE6OF01CP5OH.38.4.A04.1.454.CMB.1.raw
  modified_base (215)..(215): a, c, t, g, unknown or other
  misc_feature (215)..(215): n is a, c, g, or t
  modified_base (404)..(404): a, c, t, g, unknown or other
  misc_feature (404)..(404): n is a, c, g, or t
  modified_base (487)..(487): a, c, t, g, unknown or other
  misc_feature (487)..(487): n is a, c, g, or t
  modified_base (584)..(585): a, c, t, g, unknown or other
  misc_feature (584)..(585): n is a, c, g, or t
  modified_base (587)..(587): a, c, t, g, unknown or other
  misc_feature (587)..(587): n is a, c, g, or t
tcagtcgatcacgtcacgaccggtgctcgatttagagtagtgatcagggggggtccctgagactctcctgtgcagcctctgcattccacctttagtaactatttaatgagctggtccgccagcctccgagggaagggctggaggtgggtggccagcaattaaccaagatggacgtagaaaaatactatgtggactctgtgaaggcatcgccatcncagagacacgaccaagactcactgtgctgcacatgaacggctgaggagcgacgacgacggcgtgtcgttacttcgtggtcgacgcgaccgcccccagtcggacggctacgaggtcgggagccgtaacgtctttgacgttacggtcgggaccgtaccgggacccgtggtacccgaccgtcctcctcgacnccctaccgaccgacggccctacgtccgttccctcccgtcgcccctacccgtcctaccgagccgccgtaccgtcggcgggaccncgacggcccgcgtcggtccgcgtcgtcgacgacgtacctactacgcgtcgactccgagcggtacgggcggcgtacggacgacggaccgacttagcgnngng

SEQ ID NO: 222051 - DNA, 721 bp, Homo sapiens
  misc_feature: GYAE6OF01ALBZD.38.4.A04.1.454.CMB.1.raw
  modified_base (339)..(339): a, c, t, g, unknown or other
  misc_feature (339)..(339): n is a, c, g, or t
  modified_base (718)..(718): a, c, t, g, unknown or other
  misc_feature (718)..(718): n is a, c, g, or t
tcagtcgatcacgtcacgaccggtgctcgatttagagtagtgatcagggggggtccctgagactctcctgtgcagcctctgcattccacctttagtaacttatttaatgagctgggtccgcagcctccagggaagggctggagtgggtggccagcaattaaccaagatgggacgtagaaaaatactatgtggactctggtgaacggccgattcgcatctaccagacgacaaccgccaaagaacctctacgtggtgctgacacagtacgaaccgcgtagaggaggcggaaccgacgacggtctggttactaccgtttctgggtcgaccgaacggaccccnccccccgaagttcgggacgggtacctaacggtgggcgggtacaccgttaaccgttacgtttacgaacggttaccgggccgggggtacccgaacgggtaaccccgtttggtcccaccggtccttaccctcgaaccgtcccttacccgaacccggacgggcccgtaccgtccgttccctaccccgtcgccccctccctcctacccgaacgccgtacccgtaccgtcggtaccgggacgaaccgccggtcccgggtcccggtcgggaccgttccggacccgttacgggtaaccggtaacctaacccgtttaccgccgtacggttcggaccgttcggcggttacggaggtcccggctcgggaccgtacgggcctacgataggntgc

SEQ ID NO: 222052 - DNA, 669 bp, Homo sapiens
  misc_feature: GYAE6OF01EFOJG.38.4.A04.1.454.CMB.1.raw
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
  modified_base (666)..(666): a, c, t, g, unknown or other
  misc_feature (666)..(666): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctgggagtgggtggccagcattaaccaagatggacatagaaaaatactatgtggactntgtgaagggccgattcgccatctccagagacaacnccaagaactcactggtggctgcacatgaaccgcctgagaggcgacgacacgctgtnttacttctgtgcgagaccgccccagtggacggctacgaggtgggagcctacgtactttcgaacgtacggtcggggaccgacggggtaacccctggtcccgtaccgttccctcctcgaccgtccctacccaaccggaacggcccgtaaccgttccggtccccttcccccgtcggacccctacccctccctacccaacggaccgtacccgacccggttcgggtaccggggacccacggaccgggtcccgggcccggtggggccccgttgggtcccgttacggtaccgtaaccgggtacccttaacccgttccgtacgtacgtaacgttccggacgtagggacggcggggccgtacggaacggtacgggacgtacgagtgngag

SEQ ID NO: 222053 - DNA, 779 bp, Homo sapiens
  misc_feature: GYAE6OF01B7MEX.38.4.A04.1.454.CMB.1.raw
  modified_base (236)..(236): a, c, t, g, unknown or other
  misc_feature (236)..(236): n is a, c, g, or t
  modified_base (775)..(775): a, c, t, g, unknown or other
  misc_feature (775)..(775): n is a, c, g, or t
  modified_base (777)..(777): a, c, t, g, unknown or other
  misc_feature (777)..(777): n is a, c, g, or t
  modified_base (779)..(779): a, c, t, g, unknown or other
  misc_feature (779)..(779): n is a, c, g, or t
tcagtcgatcacgtcacgaccggtgctcgatttagagtagtgatcagggggggtccctgagactctcctgtgcagcctctgcattcacctttagtaactatttaatgagctcgggtccgccagcctccgaggggaaggggctgggaggtggggtggccagcaacttaaaccaagagtggacgtagaaaaatactatggtggactcgtgtggaacgggccattcgccatctccaganaccaacgccaagactcacgtgtgctcgacacagtcggaacggcctaggaggacggacggacgacgacggctggtcgtaccgttcgtggtggcgagaccgcccccgtagtggacgggactacgtagggtagggacgtccgtacgtacgtttacgaccgtacggacggggaccgacgggtaacccgtcggtaccgtaccgttccctaccgtccgaccgtcccgaccccgaacccggtaacccgggccctaccggttaccccgggtttcccccttccccccggttaccgggtaccccccttacccccttaccccgtaacccggaaaccggtacccgtacccgttaccccggttaccggggtcccggggtaccgaacccggtaccggggcccccggacccgggttcggggtcccgttaccgggtcccggttacgggtaaccggtaaccggtacccttacccgggttacctaccggtcgtaaaccgtccgtacggtcggtacgggtccgggtcggtacggaaccggacggtccgagtagtacgngngn

SEQ ID NO: 222054 - DNA, 350 bp, Homo sapiens
  misc_feature: GYAE6OF01BMVQQ.38.4.A04.1.454.CMB.1.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (292)..(350): a, c, t, g, unknown or other
  misc_feature (292)..(350): n is a, c, g, or t
tcagtcgatcacgtcacgaccggtgctcgatttagagtagtgatcaggggggggtccctgagactctcctgtgcagcctctgcattcaccttttagtaacttatttaatgagcgtgggtccgccagcctccgagggaaggggctggagtgggtggccagcaattaaccaagatggacgtagaaaaatctatgtggactntgtgaagggcattcgcatctcagagacaacgcaaagaactcactgngctgcantgaacgctgagngcaacgacacggctggtctacttcgtannnnnnnnnnnnnnnnnnnnnnnnnnnnnnnnnnnnnnnnnnnnnnnnnnnnnnnnnnn

SEQ ID NO: 222055 - DNA, 580 bp, Homo sapiens
  misc_feature: GYAE6OF01E0J68.38.4.A04.1.454.CMB.1.raw
  modified_base (219)..(219): a, c, t, g, unknown or other
  misc_feature (219)..(219): n is a, c, g, or t
  modified_base (471)..(471): a, c, t, g, unknown or other
  misc_feature (471)..(471): n is a, c, g, or t
  modified_base (492)..(492): a, c, t, g, unknown or other
  misc_feature (492)..(492): n is a, c, g, or t
  modified_base (579)..(579): a, c, t, g, unknown or other
  misc_feature (579)..(579): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggggctgggagtgggtggccagcaattaaccaagatggacgtgaaaaatactatgtggactctgtgaagggccgattcgccatcnccagagacaacgccaagactcactgtggctgcacatgaacggcctgagaggcgacgacacggctgtgtacttctggtgcgagacgccccccagtcggagggctacaggttgggagcgtacgactttggactcgtcgggggccacggggaaccctgggtcctaccgtcctcctccagccctcccgacccgaacgggccccacgtccggtccttccccccgtggcccaccctcctcccaacgacgcaccctcgnggggccacgcgccgggcccgngggcctcggcagtcggtacgaacggtacctcgtcccacggttcacgtcggactggcggcgggctcggaccgagggcgacacggtgcng

SEQ ID NO: 222056 - DNA, 669 bp, Homo sapiens
  misc_feature: GYAE6OF01EOJVF.38.4.A04.1.454.CMB.1.raw
  modified_base (277)..(277): a, c, t, g, unknown or other
  misc_feature (277)..(277): n is a, c, g, or t
tcagtcgatcacgtcacgaccggtgctcgatttagagtagtgatcaggggctctcagagaggagccttagccctggactccaaggcctttccacttggtgatcagcactgagcacagagactcaccatggaattggggctgagcttgggttttccttgttgcttattttagaaggtgtccagtgtgaggtgcaagtggtggagtcggtgggggagtcgttggtccgacgggtcccggggggtccctgacgacctcctcctggtcgcgagtcctgtcnctattcctacctttaagtaaacttattaactgagtcgtcggtccgccaggtccctcggaaggggacgggtcgtgggaggtcgggtggccctagactaactaaaccgaagagtacggaacgtaaagaaaaattcgtacgtgtacggtactgtaggtacggaacgggtccgtattccgacctagttctaccgagacgaaccaacgaaccgaagacctcgacgtggtcgactcgactagacgtcgaacggtcctaggacgtacggaccgaacgaccggcgtacgttgttaccggtcttcggtacgtcgaacccggtacgaaccccggtcccccgtaaggtcggggaacggttacccggtaaacggtgggtacggtaaccgtccgtttaaaccggg

SEQ ID NO: 222057 - DNA, 743 bp, Homo sapiens
  misc_feature: GYAE6OF01BEO94.38.4.A04.1.454.CMB.1.raw
  modified_base (184)..(184): a, c, t, g, unknown or other
  misc_feature (184)..(184): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
tcagtcgatcacgtcacgaccggtgctcgatttagagtagtgatcagggggggtccctgagactctcctgtgcagcctctgcattcacctttagtaactatttaatgagtctgggtccgccagcctccgagggaagggctggagtgggtgccagcattaaccagatggactagaaaatctatgngactctagtgaaggctatcncatcncagagacaacacaagactcagtgtggatcgacactagtacgaacggtcctagacgaggtacgaccgaacgacggtcgttgtacgttcttactggcgacaggtaccnccctagagacggactacgaggtgggacncgttaacgtactttcgaacgtacgggtcgggaccgtaacggaccttggccgtaacgtcctccgtccgaacgtcccaccgtaaacggcccgggtaccctacgttcccgttaccccgtttaccccgacggtacccctacccgttaccgaacggtaaccgaccgtacccgttcccggtaaccggttccggggaacctaaccgggtacccggaccgggtaacccgggttccgggacccgggttacccgttcccggggtaaaccgggttaacccggtaaccggttaacccgttacccgttaaccgggttaccgtaccggtaaaccgttaccgggacccgtttagggaccgggtcccggtgtaaccgggtaccgaagtcccgggtaacaaggtccctagtctacgg

SEQ ID NO: 222058 - DNA, 933 bp, Homo sapiens
  misc_feature: GYAE6OF01BGG2H.38.4.A04.1.454.CMB.1.raw
  modified_base (927)..(927): a, c, t, g, unknown or other
  misc_feature (927)..(927): n is a, c, g, or t
tcagtcgatcacgtcacgaccggtgctcgatttagagtagtgatcgagggggggtccctgagactctcctgtgcagcctctgcattcacctttagtaactatttaatgagcgtgggtccgccagcctcgaggggaaggggctggagtgggtggccagcaattaaccaagagtggacgtaagaaaaattactagtggtggactcgtggtacggaacgggccgtagttccgacctatcctaccaagacggaaccaaaccgaccaaacgaactcctacgtggtcggctagccacagtacgaaccggtccgtaggacggaggaccggaaccgacgacggtcttcggttacgttacttcgtggttcggacggaacggtacccgccccccgtaggtacgggtaacgggtaccttaaggacgggttacggggaacggtccgttaaccggttacgttttacggaaccggttacgggtaccggggggtacccgggtaaacccggggtaaccccgtttcggggtaccccgtacccggtttccccttccctacccggttaacccgtaccccttaacccccggaacccgggtaacccggggtaccccgttaacccgggttttcccccggttcccccgtttaccccccggttcccggtaccccctaacccccgtttccccgtaacccgtaaaccgggtacccgtacccggtacccggttacccgggtaccgggggaccggaacccggtacccggggccccgggtaccccgggtccgggttaccggtcccggttaccgggttaccgggtaaccgggtaaccggtaccgttaccccgttaccgtaccgggttaccgtaccgggttacccgtacgggtacgggaccgggtaccggggtccggtcccggggaccggtacgggtaacccggacgtaaggttacgngcgtcg

SEQ ID NO: 222059 - DNA, 670 bp, Homo sapiens
  misc_feature: GYAE6OF01AVFTP.38.4.A04.1.454.CMB.1.raw
  modified_base (667)..(667): a, c, t, g, unknown or other
  misc_feature (667)..(667): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctggagaggcgacgacgacggctgtgtacttctgtgcgagcgcccccagtggagggctacgaggtgggagctacgactttgactacgtggggccagggaccctggtccaccgtctccctcgacgtccctaccaccgaacgggtcccacgttcccggtcccctttccccccgtcggtacccctaccccgttccctaccgaaacgaccgccctaacccgtccgggtacgggggcccaaccggaccggccccgggtccccggtggggtaccctccgggtaccccgttcggggtaacccgtaaacggtacccttacccgttcccgtaacggttcggtaccttaccgggtaaccgttgggaccgggccggggtccggtacggggaccggaacggggacccgtactaagtcggcgngcg

SEQ ID NO: 222060 - DNA, 689 bp, Homo sapiens
  misc_feature: GYAE6OF01APV7S.38.4.A04.1.454.CMB.1.raw
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (587)..(587): a, c, t, g, unknown or other
  misc_feature (587)..(587): n is a, c, g, or t
  modified_base (684)..(684): a, c, t, g, unknown or other
  misc_feature (684)..(684): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
tcagtcgatcacgtcacgaccggtgctcgatttagagtagtgatcagggggggtccctgagactctcctgtgcagcctctgcattcacctttagtaactatttaatgagctggggtccgccagcctccgaggggaaggggctgggaggtgggtggccaggcaattaaccaagatggacgtagaaaaatctatgtggactctggtgaagggccatcgccatctcagagacacgccaagactcactgngcngcacntcgacgctgngagcgacacgacggctggtgtacttcgtagtcgacgacggaccgccccgatggacggtctaacgagggtgggtacgcgttacgtactttcgaaccgtacgggtcggggacccgaacggggtacccgttaggtccctacccggttctaccctccgaccggtccctcccgtaacccggaccgggtccccgtacgtttccccggttacccccgtttcccccggcgtacccccgtaccccgttccctaacccgaagggcctaacccgtccccgttaacgggccgggggacccaaccggacgggtcccgggtcccgtcggggttaccnccgggtacccgttacgggacgtaaccggtaaccttccgtaccgtacgtagtccgaccgtacgtgggaccggcgggtcacggacgtacggccagtacngtngn

SEQ ID NO: 222061 - DNA, 784 bp, Homo sapiens
  misc_feature: GYAE6OF01BP4MW.38.4.A04.1.454.CMB.1.raw
  modified_base (119)..(119): a, c, t, g, unknown or other
  misc_feature (119)..(119): n is a, c, g, or t
  modified_base (186)..(186): a, c, t, g, unknown or other
  misc_feature (186)..(186): n is a, c, g, or t
  modified_base (779)..(779): a, c, t, g, unknown or other
  misc_feature (779)..(779): n is a, c, g, or t
tcagtcgatcacgtcacgaccggtgctcgatttagagtagtgatcagggggggtccctgagactctcctgtgcagcctctgcattcacctttagtaacttatttaatgagtctggtccnccagcctccgaagggaagggctggagtgggtggccagcaattaaccaagatggacgtagaaaaattntagtgtggaccttctggtggaacgggcctattcgccatcctccagagacaacgccaagactcacgtgtggctgcacatcggaacggcctggaagacggcgacgacgacggtctgtgttaccttcgtggtcggcgacggtaccgcccccgtaagtcggaccggtactacggagggtcgggtactcgttaaccggtactttacggaacgtacgggtcggggtacccgtaaccggggtaacccgttcggtacccgtaacccggttcctacccgtaccgaccggtccccgttaacccgaaccgggtaaccgggtcccctaacggtttccccggttaccccgtttccccccggtacggacccccttaccccgtaccctaacccggaaaccggtcccgtacccgttacccggttccgggtccgggggaaccaccgggtacgggtccccggtcccgggtacgggtccgttaccgggtccgttaacgggtaccgtaaacgggtacccgttaccgtccgtacgggtactaccggttacggtaccggtgggacccgggtcggtccggtaacgggaccgaacgggtccggtactaagtacggtncggtc

SEQ ID NO: 222062 - DNA, 659 bp, Homo sapiens
  misc_feature: GYAE6OF01AKSMF.38.4.A04.1.454.CMB.1.raw
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
tcagtcgatcacgtcacgaccggtgctcgatttagagtagtgatcaggggctctcagagaggagccttagccctggactccaaggcctttccacttggtgatcagcactgagcacagaggacctcaccatggaattggggctgagcttgggttttccttgttgcttatttagaggtgtccagtgtgaggtgcaacgtggtggagtcgtgggggagtcgttggccgacgggtccggggggtccctgacgcctctcctgtgcacgtcctctgctattcctacctttagtaacttatttaangagcgtggtccncagcctcgaggaggctaggagtgggcgcagactataaccagtacgtaggaacgtaaagaaaatctagtggtaggtaccttcgtaggtacgggtaaaccgggccgtaacgtttccgacctacgttccgacccgtaaggaaccgtaaacccgaaacccgaaccgtaaacgtaacccgtacgtaccgttggtacggcctacgacctaacgtacgtaccggtaaccgggttcagggtacggacggaccgaaccgacggaccgtctaggttactacgttgtcggtacgtaccgacgtacccgcccctaggtcgggaccgttcgaacggtgggtacggtcgtacgttaaccggg

SEQ ID NO: 222063 - DNA, 598 bp, Homo sapiens
  misc_feature: GYAE6OF01B7YN5.38.4.A04.1.454.CMB.1.raw
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (593)..(593): a, c, t, g, unknown or other
  misc_feature (593)..(593): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaaggccattcgccatctccagagacaacgccaagactcactgtggctgcacagtacgaacggcctaggaggacggcgaccgacgacggctgtgttacttcgtgtgacgacgaccgcccccagtggacgggctacgaggtcgggacgtcgtacgtacttacgacgtacggtcggggaccgacgggtaacctcggtaccaccgtcctcctcgacgccctaccgaccgacggccctacgtccgtcctccccgcgccctaccctccncagctaccnccgtcggtcggcacgacgtccggccgtcggtctcgtccgtaggtaccgaacggtacccttaccgtccgtacgtcgtacgtacgacgtacggacggccgggtcgcggtacgacggtcgacagtgncgtag

SEQ ID NO: 222064 - DNA, 657 bp, Homo sapiens
  misc_feature: GYAE6OF01DB5OT.38.4.A04.1.454.CMB.1.raw
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (476)..(476): a, c, t, g, unknown or other
  misc_feature (476)..(476): n is a, c, g, or t
  modified_base (513)..(513): a, c, t, g, unknown or other
  misc_feature (513)..(513): n is a, c, g, or t
  modified_base (650)..(650): a, c, t, g, unknown or other
  misc_feature (650)..(650): n is a, c, g, or t
  modified_base (655)..(655): a, c, t, g, unknown or other
  misc_feature (655)..(655): n is a, c, g, or t
tcagtcgatcacgtcacgaccggtgctcgatttagagtagtgatcagggggggtccctgagactctcctgtgcagcctctgcattcctacctttagtaacttatttaatgagtcgtcggtccgccagcctaccgagggagggctggagtgggtcgccagcattaaccgagagtcggacgtagaaaaatctatgtaggactcgtgtacggaacgggcctattccgactacncctaccaagacgaaccaaccggaccaaagtacctacacttggacggcncggaacncgaagttacgaacggccgtagacggacggacacgtacacggtcctggttcgtacttcgttaggcgacgtaccgaccgtacccccaaggttcggaccgggctaacgacgggtagggcccgtaacgtacgttacgtttacgcgttaaccggcgggacggtaaccggtacccgtctccgtaccgtctccgtacnccgtaccacccgagtaccgccgactccgtccttcccncggaccctccgtaccaccgacgcgtacacgtcggtacggcacggccggcggtcgacggtcgctacgtcgagtaccgtaccttactaccgcgttagcccgtagacggtacggcggcggacgtcggacgacgggccaancggangc

SEQ ID NO: 222065 - DNA, 748 bp, Homo sapiens
  misc_feature: GYAE6OF01BL0AO.38.4.A04.1.454.CMB.1.raw
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
tcagtcgatcacgtcacgaccggtgctcgatttagagtagtgatcagggggggtccctgagactctcctgtgcagcctctgcattcacctttagtaactatttaatgagctgggtcccgccagcctccagggaagggctggagtgggtgccagcattaaccaagatggacgtagaaaaatctatggtggactcgtgtggaagggccgtattccgcctatcctccgagagaccaaccgaccaagtaacctcacgtgtggctgccacatacgaacggcctaggaggacggccgacgacgacggctggtcttacttgtgtgcgagccgccccagnggacggctacgngggtgggactaccgtacgtacttcgaccgttacggcggggaccgaaccgggtacccttcgggaccctacccggttcctccgtaccgaccgtcccctacccgaacccggtaccggtccccgacgttccccggttcccccttaccccccggtcggtaccccctacccccgtaccctaacccgaacgtacccgccccgtacccggtccgggttacggggaccccaaccggtccggggtaccccgggccggttccggggccccgttaccgggtacccggtaccgggtaaccgtaaacccggggttaccctttaccggttaccccggacggttaccgtacccggtaccggtacggacggtacccgggtcggggacctaccgggacggaccggtcgtgtagcgtgcgacg

SEQ ID NO: 222066 - DNA, 705 bp, Homo sapiens
  misc_feature: GYAE6OF01AQRHI.38.4.A04.1.454.CMB.1.raw
  modified_base (701)..(701): a, c, t, g, unknown or other
  misc_feature (701)..(701): n is a, c, g, or t
tcagtcgatcacgtcacgaccggtgctcgatttagagtagtgatcagggggggtccctgagactctcctgtgcagcctctgcacttcactttagtaactattaatgagctggtccgccagcctcagggaaggctggagtgggtgccagcattaaccaagatggacgtagaaaaatctatgtggactcgtgtgaacggccgattcgccatctccagagacaacgccaaagactcacgtgtgctgcactatcgaacggctggagacggcgacacgacggctgtcgtacttcgtgtcgtcgacgaccgcccccagtacggacgggtctaacgaggtacgggacgtacgttaccgtatttacgaccgttacgagggggtcccaaacgggtaccctcgggttaccaccggttacccgtcgtccgacggttcccaccgtaaccccggaacgggtccctaccggtttaccggttcccgttaccccccggtggtacccccttaaccccgtccgttaacccgaaacgtacgacccggtacccgtcgggtaccggggacgaaccgtacgggcccgggtcccggtcgggtaccgtcggtacccgttaccgggtacgtaacgggttacctacccgttaccggtaccgttcgtaacgtcggaccgtgggtaaccggccgggtacgtacggacgaaacggcgtaacacggtaacngtgc

SEQ ID NO: 222067 - DNA, 631 bp, Homo sapiens
  misc_feature: GYAE6OF01EMSFK.38.4.A04.1.454.CMB.1.raw
  modified_base (107)..(107): a, c, t, g, unknown or other
  misc_feature (107)..(107): n is a, c, g, or t
  modified_base (119)..(119): a, c, t, g, unknown or other
  misc_feature (119)..(119): n is a, c, g, or t
  modified_base (140)..(140): a, c, t, g, unknown or other
  misc_feature (140)..(140): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (625)..(625): a, c, t, g, unknown or other
  misc_feature (625)..(625): n is a, c, g, or t
tcagtcgatcacgtcacgaccggtgctcgattttagagtagtgatcgagggggggtccctgagactctcctgtgcagcctctgcattcacctttagtaactattaangagctgggtccncagcctcagggaagggctggngtgggtgccagcattaaccaagatggacgtagaaaaattctatgtggactcgtgtggaaggccattccgccatctccagagaccaacgccaagactcatgtggctgcanatgaacggcctgagnggcgacgacacggctggtntactttngtgcgagaccgcccccattcggagggtcttacgacggttgggacncgtacgtactttgaccgttacgngggggcccacggggaaccctgggtccaccgtctcctcgacgtccctaccgaaccgaacgggtcccacgttacccggtcctttaccccccgtggacccctacccctaccttcccgaaagcgaccgtacccttcgggtcggggaccacgaccggccggacccgttgggccttcggccttgggtaccagggtaccctacggttcccacgttacgacgtcgtacgtggaccggcgggtcctaagggccgtaaacgggtcctacgagtagtncgtacg

SEQ ID NO: 222068 - DNA, 764 bp, Homo sapiens
  misc_feature: GYAE6OF01CIIAM.38.4.A04.1.454.CMB.1.raw
  modified_base (762)..(763): a, c, t, g, unknown or other
  misc_feature (762)..(763): n is a, c, g, or t
tcagtcgatcacgtcacgaccggtgctcgatttagagtagtgatcgagggggggtccctgagactctcctgtgcagcctctgcattcctacctttaagtaacttatttaatgagcgtggtccgccagcctccgaggggaaggggctgggaggtgggtcggccagcaattaaccaagagtggaacgtagaaaaatatatggtagactgtggtaggaacgggccgtatccgcctagtcctacacgaagaaccgaaccgaccaaacgaactcaacgtggtggctcgccaacagtacggaacggccgtggacgaggaccggaaccgacgacggtcgttagtacgttacttcggtggcgcggaaccgaccggccccagtcggtacggtactagacgggtcggacgtaccgtacgtacgtttacggacgtacggggacgggtacccggaaccgggtacccgttcggtacccgtaccgtcccgtaccgtccgacgtcccctaaccgaccggtaccggacccgtcgttcccgtccccgttccccgtcccgtaccctaccctcccgaaccgtaccggaaccgtcccgtaccggtaccgggtacggggaccgtaccggacgggtccccgggttccgggacggttccgtacccgggttccggtaacggttacgaaacggttacccgttaccgtaccggacgttaccggtacgtaaccggccgggtacggtcggggaccggtcgtaccgggacgtacggcgtaagacgtagcgnng

SEQ ID NO: 222069 - DNA, 770 bp, Homo sapiens
  misc_feature: GYAE6OF01ARNTP.38.4.A04.1.454.CMB.1.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (644)..(644): a, c, t, g, unknown or other
  misc_feature (644)..(644): n is a, c, g, or t
  modified_base (717)..(717): a, c, t, g, unknown or other
  misc_feature (717)..(717): n is a, c, g, or t
  modified_base (756)..(756): a, c, t, g, unknown or other
  misc_feature (756)..(756): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgctattcacctttagtaacctatttaatgagcgtgggtcccgccagccctccgaggggtaacgggctgggaggtgggtcggccagaccattaaaccaagntggacgtagaaaaatctatgtgactntgtggaagggccattccgcctatcctccagtacaccgaacgccaagacctcacgtggtggctcggacaccgtagtacggaaacggccgtaggaacggcgggaccgaaccggtaccgtccgggtcgtttaggttacgtttacccctttcggtagttcgggaccggaacggtaccccggaccccccgtaaggtcgggacgggggtacctaacggtaggggttcggggacgttacccgttaaaccgttacgttttacggaaccgttaccgggtcggggtaaccggtacccgggggaacccttgggtaccccaacggttccccttacctccgacccgccccggtaaccctaacccgggtaaccgggcccctaccggttcccggttccccgttacccccgngtacccccttaacccctccgtaaccacggcccgtcccgtacgtcgggtacgggccaacgccggccggtcccgnggtcgccgtacgttcgacgtacgtccttactccgacgtnaccgtcgactcggg

SEQ ID NO: 222070 - DNA, 845 bp, Homo sapiens
  misc_feature: GYAE6OF01E0G2D.38.4.A04.1.454.CMB.1.raw
  modified_base (273)..(273): a, c, t, g, unknown or other
  misc_feature (273)..(273): n is a, c, g, or t
  modified_base (375)..(375): a, c, t, g, unknown or other
  misc_feature (375)..(375): n is a, c, g, or t
tcagtcgatcacgtcacgaccggtgctcgattttagagtagtgatcaggggggggtccctgagactctcctgtgcagcctctgcattcacctttagtaactatttaatgagctgggtccgccagcctccgaggggaaggggcttgggaggtggggtggccagcaattaaccaagatggacgtagaaaaattctatggtggactcgtggtaggaacggggcccgattccggaccatcctaccgaagagacctaacgccaaagaactcacgtggnggctgacacgagtgaaccggcctagagaggcgacgacgacggctcggtcgttacttcgtggtcggacgacggaccgcccccgagttggacgggtcgttacgngggttagggacgtcgttacgtacgtttcgaaccgttacggtacgggggaccgtaaccgggtacccgttacgggtacccgttaacccgttccgttaccccgtacgtaaccgtaccccgttaaccccggaaaccccggaaccggggttaccccctaccggttttaccccgggtttacccccttaccccccggttaccgggacccccttacccccggttacccttaacccggaaacgtaccggtacccgtaacccggttccggggtaccgggggacccaaccggtaacccgggtcccggtcccgggttacgggtcccgtaccgggtacccggtttacgggaaccgttaaaccggttacccgttaaccgttaccccggtaacggttacggtaccggttaacccgtacggttccgggacgggtcccggggtcggtacgggaccggaacgggtccggtacaaaggtttgacgcgtg

SEQ ID NO: 222071 - DNA, 619 bp, Homo sapiens
  misc_feature: GYAE6OF01DQHIW.38.4.A04.1.454.CMB.1.raw
  modified_base (287)..(287): a, c, t, g, unknown or other
  misc_feature (287)..(287): n is a, c, g, or t
  modified_base (319)..(319): a, c, t, g, unknown or other
  misc_feature (319)..(319): n is a, c, g, or t
  modified_base (561)..(561): a, c, t, g, unknown or other
  misc_feature (561)..(561): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggagggctggagtggtggccagcattaaccaagatggacgtagaaaaatactatgtggactcgtgtgaagggccgattcgccatctccagagacaacgccaagaactcactgtggctgcacatgaacggcctgagagcgacgacacgctgtgtacttntgtgcgacgacgcccccagtggaggctaacgnggtggactcgtaacgtactttgaccgtacgtcggggaccgaacgggaacccgtggtaccacccgttctccgtacacgccctaccgaaccgacgggccctacgttcccggttaccccttcccccgtacggcccctacccctacctacccgaacgacgccgtacccgtcggtcggggaccctacgacggcccggtccgtcgggcctcgccgtggaccgtaacgtaccgttacttccgaacgttnacgtaccgacgtgggacggcgggtacgtacggacgtaacgggccgactagtagngngn

SEQ ID NO: 222072 - DNA, 876 bp, Homo sapiens
  misc_feature: GYAE6OF01BYABT.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccagtggaagttggggctgagtcgttgggttttccttgttgcttattttagaggtgtcctagtgtgaggtgctaacgtggtggagtcggtgggggagtcgttgggtcccgacgggtccccgggggggtccctaggacgtcctcttccgtggtcgccacgtcccgtctcgcctacttttcctaaccgtttttaactaaaccgttttaattttaaagtcggtacggtccggttacgggggttcccccaccggtacgtaccccgttaccggggaaggggggtaacgggggtccgttaggggacggggtttcggggacgggaccccgtaggtaacctaaacgtttaaaacccggaaagttacggggtaaggtaaaccggttaaaagtaaaaaacttaacgttacgtacgggtttaggtaaccgtttcgttaggggtaacgggtaaaccggggtcccgttaacgtttcccggttaaccctacgttacccgaaccggtaacgaaaccggaaacccgaaacccggtaaaccaaaccggttaaccctacggttaacccgttaggtccggtaccgtcgaacccgtaacgtaacgttaccgggaaccggttacccgaagggaacggaacggggtacccggacggtacccgaacgggtcgttcggttaacgtttcgttcgtggttaccggacggtacgacccccgtaccccggtagacgggacggttccgtaacgggtaggacgggtaccctggttaaccgg

SEQ ID NO: 222073 - DNA, 780 bp, Homo sapiens
  misc_feature: GYAE6OF01BS5R8.38.4.A04.1.454.CMB.1.raw
  modified_base (108)..(108): a, c, t, g, unknown or other
  misc_feature (108)..(108): n is a, c, g, or t
  modified_base (774)..(774): a, c, t, g, unknown or other
  misc_feature (774)..(774): n is a, c, g, or t
  modified_base (779)..(779): a, c, t, g, unknown or other
  misc_feature (779)..(779): n is a, c, g, or t
tcagtcgatcacgtcacgaccggtgctcgatttagagtagtgatcgagggggggtccctgagactctcctgtgcagcctctgcattcacctttagtaacttatttaangagcgtgggtccgccagcctcgagggaagggctggagtgggtgccagcaattaaccaagagtggacgtagaaaaatctatggtcggactcgtggtacggaagggcctattccgacctatcgtaccagaagaccaaacgccaaaagaaccttcacgtggtcgctgacactgtacggaacggccgtggaacggcgggtaccgaacggaccgtaaccgggtctggttacgttacttctaggtcgacgacgaccccgcccctaagtgggacgggtcctaaggcgggttacggggactacctttacgggtactttacggaaccgtacgggtacggggacctaaccggggacccgttcgtaccgcccggtacttcccgcgtacgtacccctacgaacccggtaaccgggtccctaccggttcccggttccccttcccccggaccggttaccccgtccccgtaacccgtacccaacggtaccgtacgtaccccggttgggaccgggaccgacccgggtacgccccgggtccgttcgggcccgtaccggcccggtacgggttaccgtaaccggttaccgtaccgttaccggacgtacggtacgtaccggtacggtcgggtaccgggccggggttccggaaggtaccggaacccgacggttaccgaggtttaacngtcgng

SEQ ID NO: 222074 - DNA, 919 bp, Homo sapiens
  misc_feature: GYAE6OF01D3PRN.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccatggaagttggggctggagtcgttggggtttttccttggtttgtcttaagtttttaaggaaagggttgtccgaaggttggtggaaggttgactaacgtgggtgggtaggtcggtggggggaggtcgttcgggtccgacggggtcccggggggggttccctaggacgtccttccgttccgtggtcgcgacggtcccttcgtcggtactactttacccgttaaccgtttttaaaggtttaaaacctttaagtttttaaaacgtcgggtaacggttccgggttaccggggggttaccccgacccggtaaccggtacccccgttaccggggaaacggggggggtaacgggggtcggttagggggtacgggttcggggtcggaccgacggtacgtaaacgttaaaccgaaggtacggtaacggtaaacgtaaagtaaaaacttacgtagtggtaggtacgttcgtaggtacgggaacggtccgtacgttccgacctacgtaccgtaacgaacggtaaccgaaaccgaacccgaaaccgtaaacgtaccttaccggtaggttacgggtcgtacgtacgactaacgtacggtaaccggaacggtcggtaagggaaccgggaacggtaccgggaacccgtaaccgggcggttacgtttacggttccgtttaaccggttcgtggtaacccggaccggtaacccggacccccgtaccccggtaagggttaccggggaaccccgggtaacttttaccggggaagggggttaaccgggtcgttaaacccggttttaacccgggg

SEQ ID NO: 222075 - DNA, 752 bp, Homo sapiens
  misc_feature: GYAE6OF01BUP80.38.4.A04.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
tcagtcgatcacgtcacgaccggtgctcgatttagagtagtgatcagggggggtccctgagactctcctgtgcagcctctgcattcacctttagtaactatttaatggagctgggtccgccagccctccgagggagggctggagtgggtggccagcattaaccaagagtggacgtagaaaaatactatgtggactntgtagaagggccgtattccgcctactctaccagacgaccaacgccaagaactcactgnggctgcanagtgacggcctgagaggcgacgacgacgntcgtntacttctgngcgagaccgccccctaagnggacggtacctagagggtcggacgtcctacggtacctttacggtacgtacgtacgggggtacccgtaacggggtaccccgttcgggtaaccctaccggttccccttacccgtaccggacccgtcccccgttaaccccgaacccggtaaacccggggtaccccgttacccgggttacccccggtttccccgtttaccccccccgtcccgggtaacccccctaccccccgttaacccccgtaaccgtaaacccggacgttaacccccgtaacccgttcccggggtacgggacccgaacggacccggccccgggtcccgtacgggtcccggtcggtacccgttccggtacgaacggtccttaccggtccgtacgcgtatacggccgtggcgggaccggcggtacggaccgaaggccgtacagtacgngngn

SEQ ID NO: 222076 - DNA, 657 bp, Homo sapiens
  misc_feature: GYAE6OF01EBF2Z.38.4.A04.1.454.CMB.1.raw
  modified_base (118)..(118): a, c, t, g, unknown or other
  misc_feature (118)..(118): n is a, c, g, or t
  modified_base (139)..(139): a, c, t, g, unknown or other
  misc_feature (139)..(139): n is a, c, g, or t
  modified_base (160)..(160): a, c, t, g, unknown or other
  misc_feature (160)..(160): n is a, c, g, or t
  modified_base (506)..(506): a, c, t, g, unknown or other
  misc_feature (506)..(506): n is a, c, g, or t
  modified_base (541)..(541): a, c, t, g, unknown or other
  misc_feature (541)..(541): n is a, c, g, or t
  modified_base (551)..(551): a, c, t, g, unknown or other
  misc_feature (551)..(551): n is a, c, g, or t
  modified_base (560)..(560): a, c, t, g, unknown or other
  misc_feature (560)..(560): n is a, c, g, or t
  modified_base (598)..(598): a, c, t, g, unknown or other
  misc_feature (598)..(598): n is a, c, g, or t
tcagtcgatcacgtcacgaccggtgctcgatttagagtagtgatcgaggggggtccctgagactctcctgtgcagcctctgcattcacctttagtaactatttaatgagctgggtccnccagcctcagggagggctggngtgggtgcagcattaacgagntgacgtagaaaatctatgtgactcgtgtgaggcattcgccatccgtccagtagaccaaaccgtccaagtaacctccacgtggtaggctcgtacgacacgtacggaaccggtccgttagaggtacggaccgaacgtacaccggggttctggttacgttactttcggtacggtcggaccgaacgacccgacccccgtagtagggacgggtactacggtacggtggacgtaccgtaccgtacgtttggaacgtcgggtccgggaccgtaacgggtacccgtgggttacccaccggtctacccggtcaccgcctaccgaacgtacgccctacggtcccgtccgttcccgngtccccacctccgtacacgtacgacctccgtacgngggccaacgngcccgccgngtcgccgcgtcgtacgtacgtaccgtacgtccgtcgtnaccgtcgtcgtagggccggacggtcgcgggtaacacgggttacaccgagccgatccgag

SEQ ID NO: 222077 - DNA, 667 bp, Homo sapiens
  misc_feature: GYAE6OF01ECVHK.38.4.A04.1.454.CMB.1.raw
  modified_base (117)..(117): a, c, t, g, unknown or other
  misc_feature (117)..(117): n is a, c, g, or t
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
  modified_base (659)..(659): a, c, t, g, unknown or other
  misc_feature (659)..(659): n is a, c, g, or t
tcagtcgatcacgtcacgaccggtgctcgatttagagtagtgatcaggggggtccctgagactctcctgtgcagcctctgctattcacctttagtaactatttaatgagctggtccnccagccctccgagggaagggctgggtacgtgggtacggccaggactaactttaaaccgaagagttggaacgtaagaaaaaactntaagtgtaggacttcgtgtaggaacgggcctattccgacctatcctccagacgaccaacggtacaaacgtactcctacgtgnggctgaccaacgngtacgaccggctaggagacggccaacggactacggcttggtcttaccttcgagtgcgagtacccgccctagtggacgggctagagggtcggtacacgttacgtacttacggacgtcggtacgggcgaaccggtacncggttaccaccgttcctccgacacccgtccctacccgaacgtaccggtccctaacgttccggttaccccgtccccgtcgtaccccgccttacccgactacgacctcgaccgtcggtacggcacgtacggccggtactcgggtctacggtcgtacgtaccgaacgtagtacctccgaggttcgacctcgacgtcgacgggtcggacggtcgacgaacggcgacgtaanccgtgctg

SEQ ID NO: 222078 - DNA, 731 bp, Homo sapiens
  misc_feature: GYAE6OF01AIYWL.38.4.A04.1.454.CMB.1.raw
  modified_base (730)..(730): a, c, t, g, unknown or other
  misc_feature (730)..(730): n is a, c, g, or t
tcagtcgatcacgtcacgaccggtgctcgatttagagtagtgatcagggggggtccctgagactctcctgtgcagcctctgcattcacctttagtaactatttaatgagctcgggtccgccagcctcgaggggaagggctggagtgggtggccagcattaaccaagatggacgtagaaaaatactatggtggactcgtgtgaagggccattcgcatcctccagacgacaacgccaagactcactgtggctgcacgatcggaaccggcctaggaggacggcgaccgacgacggcgtggtcgttacttcgtgtcgcgacgaccgcccccgaggtcggacgggaccgtacgagggtgggaacgaccgttacgtacgtttacgacccgttacggtcggggacccgaacggggtaccccgtcggtaccctacccggttcctacccgtccgtacgtcccctacccgaacccggtaaccgggtacccctaccggttcccggttccccgtttccccccggtcgggtccccctaaccccgtcccgtaacccgaaacgccgtacccgtaccggtccggtacggggacccaaccgggccggcccgggtcccggtcgggtccttccggtcccgttaccgggtaccgtaaaccggtaccgttacccgttaccggacgtacggtaccgtacggaccggtcggacgggccgggtcgtacgggacgacgggtacgacacgagcganc

SEQ ID NO: 222079 - DNA, 694 bp, Homo sapiens
  misc_feature: GYAE6OF01BBEZO.38.4.A04.1.454.CMB.1.raw
tcagtcgatcacgtcacgaccggtgctcgatttagagtagtgatcagggggctctcagagaggagccttagccctggactccaaggcctttccacttggtgatcagcactgagcacagaggactcaccatggaattggggctgagctggttttccttgttgctattttagaaggtgtccagtgtgaggtgcaactggtggagtcgtgggggaggcttggtccgaggccgggggggtccctgagactcctcctgtgcagcctctgctattcacctttagtaacttatttaatgagcgtgggtcccaccgagcccgttaccgaggggaaggggctagggaggtggggtggccagcaacgttaaaccgaagagtaggaacggtaagaaaaaattcgtaagtggtacgggacttccgtaggtaggaaacgggcccgtaagttccgaccagttcccgtaccgaaggtaacgaaccgaaaccgacccgaaaagtaacctaccacgtggttacgggcctacggaccaaccgtacgtacgggaacccggtccgtaaggaccggtaacgggccgaaaccggaccgtaccggggtctaggttccggtaacctttcgaggttcggaccggtaaggaccccgccccccgtaacggtggtaccgggtaccttaacggaagggtcggggtaacgtcggttaaacccgg

SEQ ID NO: 222080 - DNA, 699 bp, Homo sapiens
  misc_feature: GYAE6OF01A2W3S.38.4.A04.1.454.CMB.1.raw
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
tcagtcgatcacgtcacgaccggtgctcgatttagagtagtgatcaggggctctcagagaggagccttagccctggactccaaggcctttccacttggtgatcagcactgagcacagaggacctcaccatggaagttggggctgagtcgttgggttttccttggttgctttagttttaggaaggtgtcctagtgtgaggtgacctacgtggtggtaggtcggtgggggagtcgttcggtccgacggggtccggggggtccctaggacgtccgtcctcgtggtcgacacgtcctcgngactacttcctaacctttaataactttattagngacgtcgtcggaccgcncgtccgtccggaaggggacggtcgaggtaggtggtacgcacgtctaacgtaacggagtaggacgtaagtaaagtaaatcgtagtagtacggtactacgtaggtacggtaacggtcgtacgtccgactacgtcaccgagacaccgacgaaccacggtacctgtcgtaggtacgcctacgtcaacggataccggaccgtgtaacggacggacgtacgaacctacgggaccgttagttccggaactttccggtacggttacggtaccgaacggtcccggtaaccccgtcccgacggtacgggtaacccgtcgtaaccggggtaaggtacccgggtccgttaacgttaaacccgggg

SEQ ID NO: 222081 - DNA, 774 bp, Homo sapiens
  misc_feature: GYAE6OF01B0I9J.38.4.A04.1.454.CMB.1.raw
  modified_base (118)..(118): a, c, t, g, unknown or other
  misc_feature (118)..(118): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (772)..(772): a, c, t, g, unknown or other
  misc_feature (772)..(772): n is a, c, g, or t
tcagtcgatcacgtcacgaccggtgctcgatttagagtagtgatcagggggggtccctgagactctcctgtgcagcctctgcattcacctttagtaactatttaatgagctgggtccnccagcctccagggaaggggctggagtgggtggccagcattaaccaagatggacgtagaaaaatctatgtggactntgtgaagggcctattcgcatcncagagacacgcaagactcactgtgctgcacatgaacgcctggagaggcgacgacgacggctgtcgtacttcgtgtggcgacgaccgcccccatcggacggtactaacgaggtagggacgtacgttaaccggtacttttaggaacttaaccggtcgggggacccgtaaacgggggaaacccctttcggggtaccctaacccggttcccttacccgtaccgtacgcccccttacccgaaccccgtaaaccggggcccctaacggtccccgggttacccctttacccccccggtcgggtaccccctacccccgttacccgtaaccccgaaaggtacccggacctacccggttccgggtcgggggacccaaccggtaacgggccccgggtaccccggttcgggggacccttccgggtaccccgtttacgggtaaaccgaaacgggtaccctttaacccgttacccgtaacggttacggtaacccgttaccaaccgggttacggacgggtaccggggtccggttacggaccgggtaaacgggccggacgtaacggtgaccgntg

SEQ ID NO: 222082 - DNA, 880 bp, Homo sapiens
  misc_feature: GYAE6OF01EL2S0.38.4.A04.1.454.CMB.1.raw
  modified_base (124)..(124): a, c, t, g, unknown or other
  misc_feature (124)..(124): n is a, c, g, or t
tcagtcgatcacgtcacgaccggtgctcgatttagagtagtgatcgagggggggtccctgagactctcctgtgcagcctctgcattcacctttaagtaacttatttaatgagcgtcgggtcccnccagccctccgaggggaaggggctgggaggtggggtcggccagacaacttaaccgaagagtacgggaacgttaagaaaaaattacttagtggttagaccttcgtggtacggaacgggcctagttccgacctatcctaccgagacgaaccaaccgaccaagaacctcgacgttggtggctgaccactacgtacggaaccggccgtaggaacggacggacgaccgtaaccgcggtcgttggtacgttacttcgtggtcggaccgacgtaccccgacccccaggtaacggcggtacctaggtaggggtacggaacgtaccgtaacgttcgtttacgaccgtaacggggtccggggtacccgaaccgggtaacccggtccgtaccgttacccgtcctccccgtaccaaccggtcccccgtaacccgaaacccgggtaaccggggtaccccgttaaccggtttcccccgggttacccccgtttaccccccggttaccggtacccccctaccccgttacctaacccgaaccggaaccgtccctaacccggtccgggtacgggggtacccaccggacccgggtcccgggtaccggtccgggtaccgtcggtacccgggttacggtaaccggtaaccgttaccccgttacccgtacccggttaacgggtacgtacccggttagtacccgggttacggggaccgggtcccgggtcgggtaccgggaacccgggaacccgggttaccgacgaaggttcgagcggta

SEQ ID NO: 222083 - DNA, 518 bp, Homo sapiens
  misc_feature: GYAE6OF02G1FB0.38.4.A04.1.454.CMB.1.raw
  modified_base (324)..(324): a, c, t, g, unknown or other
  misc_feature (324)..(324): n is a, c, g, or t
  modified_base (517)..(518): a, c, t, g, unknown or other
  misc_feature (517)..(518): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactactggggccagggaaccctggtcaccgtctcctcagcctccaccaagggcccatcggtcttccccctggccaccctcctccaagacgcacctcgtcggggcacgagccggcccgtgggctcgcctggtcaaggactactccgacgtgatcgactgagcgggctggcaggcgacatacgnn

SEQ ID NO: 222084 - DNA, 527 bp, Homo sapiens
  misc_feature: GYAE6OF02GJ1VK.38.4.A04.1.454.CMB.1.raw
  modified_base (525)..(527): a, c, t, g, unknown or other
  misc_feature (525)..(527): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagccctccaccaagggcccatccggtccttccccctggccaccctccctccaacgacgccacctcgtcggggccacgacgccggccctgggcctgcctggtcaaggactacttccacgtgatcgactggacgcgggctggcgaggcgcagtagnnn

SEQ ID NO: 222085 - DNA, 529 bp, Homo sapiens
  misc_feature: GYAE6OF02GPKKU.38.4.A04.1.454.CMB.1.raw
  modified_base (527)..(529): a, c, t, g, unknown or other
  misc_feature (527)..(529): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagcctccaccaacgggcccatccggtccttccccctggccaccctcctcccaacgacgccaccctcgtcgggggccacacgccggccctgggcctgccgtggtcaaggtacctacttccacgtgatcgactgagcgggctggcaggcgcatagnnn

SEQ ID NO: 222086 - DNA, 522 bp, Homo sapiens
  misc_feature: GYAE6OF02GFJMA.38.4.A04.1.454.CMB.1.raw
  modified_base (517)..(517): a, c, t, g, unknown or other
  misc_feature (517)..(517): n is a, c, g, or t
  modified_base (520)..(522): a, c, t, g, unknown or other
  misc_feature (520)..(522): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactactggggccagggaaccctggtcaccgtctcctcagcctccaccaagggcccatcggtcttccccctggccaccctcctccaacgacgccaccctcgtcgggggccacgacgccggcccgtgggcctgcctggtcaaggactacttccacgtgatcgactgagcggctggcaggcgcanagnnn

SEQ ID NO: 222087 - DNA, 530 bp, Homo sapiens
  misc_feature: GYAE6OF02H78VD.38.4.A04.1.454.CMB.1.raw
  modified_base (529)..(530): a, c, t, g, unknown or other
  misc_feature (529)..(530): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagcctcaccaagggcccagtccggtcttcccactggcacccctcctccaagacgccaccctcgtcgggggcacacggcggccctgggcctcgcccttgggtccaaggactacttccacgtgactcgactgacggcggctggcgaaggcgcatagnn

SEQ ID NO: 222088 - DNA, 607 bp, Homo sapiens
  misc_feature: GYAE6OF02JEV24.38.4.A04.1.454.CMB.1.raw
  modified_base (603)..(603): a, c, t, g, unknown or other
  misc_feature (603)..(603): n is a, c, g, or t
tcagtcgatcacgtcacgaccggtgctcgatttagagtagtgatcgagggggggtccctgagactctcctgtgccagcctctgcatttcacctttagtaactatttaatgagctgggtccgccagcctccagggaagggctggagtggtgccagcattaaccagatggacgtgaaaaatactatgtggactctgtgaaggccgattcgcatctcagagacagccaagacgtcactgtggctgcacatgaacggcctgagaggcggaaccggactacggctgtcgtacttcgtggtgcgacgagccccgaagtgacggcgtacgagtcgggtacgacttacggactttagacgtaccgtgggggacccagggaaccctggtcaccgtctaccgtccacgacctacgacccgaaggtccctactcccgtcttccccctcgcctaccctacctaccgaacgacgcctaccggtcgacggggcaccgaccgcgggccctagggcctcgtacccgtaggaccaacggtacctacgttccgacgttcgaacttcggaacgttcggacggtccgggacgtagggaccgtaacggtccgacgtacgtacgntacg

SEQ ID NO: 222089 - DNA, 501 bp, Homo sapiens
  misc_feature: GYAE6OF02I55YZ.38.4.A04.1.454.CMB.1.raw
  modified_base (327)..(327): a, c, t, g, unknown or other
  misc_feature (327)..(327): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (494)..(494): a, c, t, g, unknown or other
  misc_feature (494)..(494): n is a, c, g, or t
  modified_base (499)..(501): a, c, t, g, unknown or other
  misc_feature (499)..(501): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtggganctacgactttgactactggggccagggaaccctggtcaccgtctctcagcctccacagggcccatccgtctcccctgccncctcctcagncnctctggggcncngcggcctggctgcctggcaagctacttccacgtgactcgacgtgagcgggctggcgaaggcgnagtgnnn

SEQ ID NO: 222090 - DNA, 506 bp, Homo sapiens
  misc_feature: GYAE6OF02GEWYD.38.4.A04.1.454.CMB.1.raw
  modified_base (416)..(416): a, c, t, g, unknown or other
  misc_feature (416)..(416): n is a, c, g, or t
  modified_base (504)..(506): a, c, t, g, unknown or other
  misc_feature (504)..(506): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacagtgggagctacgactttgactactgggggccagggaaccctggtcaccgtctcctcagcctccacaggccatcgtctcccctgcaccctcctccaagncacctcgtggggcacagccggcctgggctgccgtggtcaaggcctacttccacgtgactcgactggagcgggctggcaggcgcatagnnn

SEQ ID NO: 222091 - DNA, 583 bp, Homo sapiens
  misc_feature: GYAE6OF02ICY9L.38.4.A04.1.454.CMB.1.raw
  modified_base (580)..(580): a, c, t, g, unknown or other
  misc_feature (580)..(580): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactacgtggggccagggaccctggtcaccgtctcctcagcctccaccgaagggcccagtccggtccttccccctggccaccctcctccaacgacgccaccctcgtcgggggccacgacggccggcccgtggggcctcggcccgttcgggtccgaaacgggaccttaacgttcccgaacgttcgacgttccggaccgtggacggccggggccgttcgggaccgtaacgggccgaccgaacgtacggcngcg

SEQ ID NO: 222092 - DNA, 542 bp, Homo sapiens
  misc_feature: GYAE6OF02I3PUQ.38.4.A04.1.454.CMB.1.raw
  modified_base (344)..(344): a, c, t, g, unknown or other
  misc_feature (344)..(344): n is a, c, g, or t
  modified_base (540)..(542): a, c, t, g, unknown or other
  misc_feature (540)..(542): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactacgnggggccagggaaccctggtcaccgtctcctcagcctccaccaagggcccatccggtcttcccccgtggccaccctcctcccaacgacgccacctcgtcgggggccacgacggccggcccgtggggcctcgcccgtggtcaacggtactaccttccgacgtgactcgactggacgcgggctggcgaacggcgcatgnnn

SEQ ID NO: 222093 - DNA, 524 bp, Homo sapiens
  misc_feature: GYAE6OF02IV1CZ.38.4.A04.1.454.CMB.1.raw
  modified_base (522)..(524): a, c, t, g, unknown or other
  misc_feature (522)..(524): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccaggggaaccctggtcaccgtctcctcagccctccaccaagggcccatcggtccttccccctggccaccctcctccaagacgccacctcgtgggggccacgagccggccctgggctgcctggtcaaggactacttccacgtgatcgactgacgcgggctggcaacggcgcagtagnnn

SEQ ID NO: 222094 - DNA, 715 bp, Homo sapiens
  misc_feature: GYAE6OF02J0ANH.38.4.A04.1.454.CMB.1.raw
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagtcgatcacgtcacgaccggtgctcgatttagagtagtgatcagggggtccgtgagactctcctgtgcagcctctgcattcacctttagtaactatttaatgtagctggtccgtccgagcctcccgaggtaagggcgtgggacgtgggtggccgagcgattaaccagatggacgtgaaaatactangtggacnctgngaaggccgattcgcattctccagacganaaccgcgacgaaacgtaccacttggtaggctcggacacctacgacgacgacgtacgacgacgacgacgacgacgacgacgacgtacgaacttcgtcgtcgtcgtacgccgaccgacgtccggacgtaccgaacggcggtacggacgtacggaacgttacgactttacggaacggtttacctagggggtaccccttagggggaacccctacgggtacctacccggttcgtaacccgttccgtaccgacccgtacgggacccaacgggtccccgtaacgttccccggtacgttaccccgtccggttccctacccgtaccgtaccccgacgtacccgtccgtaaccggtcctaaccgggtccgtaccgggaccgtcgggacccgttcgggcccgttcgggcccgtacgtccggggtactccgtaacgttccgacgttcgacgtcggacgtcggacgtcgggctacgggccgtaagcgtacgcgtacgacg

SEQ ID NO: 222095 - DNA, 543 bp, Homo sapiens
  misc_feature: GYAE6OF02H9Z4L.38.4.A04.1.454.CMB.1.raw
  modified_base (541)..(543): a, c, t, g, unknown or other
  misc_feature (541)..(543): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcacgcctccaccaagggcccatccggtccttccccctggccacccctccctccaacgacgccaccctcgtgggggccacgaggccggcccgtcgggcctcgcccgtgggtccaagggaccttacttcccacgtgactcgactggacgcgggctggcgaaggcgcgatagnnn

SEQ ID NO: 222096 - DNA, 484 bp, Homo sapiens
  misc_feature: GYAE6OF02I0ULX.38.4.A04.1.454.CMB.1.raw
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (408)..(409): a, c, t, g, unknown or other
  misc_feature (408)..(409): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
  modified_base (482)..(484): a, c, t, g, unknown or other
  misc_feature (482)..(484): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagcctcacaggccatcgtctcccngcacctcncanncactcngggcanagcgccnggcngcctgcagctactccagtnatcgactgagcggctggcaggcgacagtagnnn

SEQ ID NO: 222097 - DNA, 509 bp, Homo sapiens
  misc_feature: GYAE6OF02I40YO.38.4.A04.1.454.CMB.1.raw
  modified_base (415)..(415): a, c, t, g, unknown or other
  misc_feature (415)..(415): n is a, c, g, or t
  modified_base (503)..(509): a, c, t, g, unknown or other
  misc_feature (503)..(509): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggccgccctgctccaggngcacctccgagagcacagcggccctgggctgcctggtcaaggactacttccacgtgactcgactgagcgggctggcaaggcgcatagnnnnnnn

SEQ ID NO: 222098 - DNA, 629 bp, Homo sapiens
  misc_feature: GYAE6OF02J05QU.38.4.A04.1.454.CMB.1.raw
  modified_base (291)..(291): a, c, t, g, unknown or other
  misc_feature (291)..(291): n is a, c, g, or t
  modified_base (447)..(447): a, c, t, g, unknown or other
  misc_feature (447)..(447): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
tcagtcgatcacgtcacgaccggtgctcgatttagagtagtgatcaggggggtcccgtgagactctcctgtgcagcctctgcattcacctttagtaactatttaatgagctgggtccgccagcctccagggaagggctggagtggtggccagcattaaccaagatggacgtgaaaaatactatgtggactctgtgaagggccattcgccatctccagagacaacgccaagaactcactgtggctgcacatgaacgcctgagaggcgacgacacggtctgtgtacttctggngcgagacgcccccatggacgggtctacgaggtcgggacgctacgactttgaccgttacgtcggggacccgaagggtaaccccgtggtaccaccggttctccctcacggccctaccgaaccgaacggggccccagtcccgggttccctttcccccgnggcccacccttcctaccaaggaccgcctaacctcggagggggtcccactacgggcccggtaccctggggccttccgcccgtggtaccaaacgggtcctaccgttccgaacggttgactccggtacgtcgggacggtcgggccgttacgggccgaaacggggtccaccgtaagtccggntcng

SEQ ID NO: 222099 - DNA, 534 bp, Homo sapiens
  misc_feature: GYAE6OF02G0M47.38.4.A04.1.454.CMB.1.raw
  modified_base (532)..(534): a, c, t, g, unknown or other
  misc_feature (532)..(534): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccaggggaaccctggtcaccgtctcctcagccctccaccaacgggcccatcggtccttccccctggccaccctcctccaacgacgccaccgtccgtcgggggccaccgaggccggcccgtggggcctcgccctggtccaaggcctactccgacgtgactcgacgtgagcggctggcacggcgcatagnnn

SEQ ID NO: 222100 - DNA, 536 bp, Homo sapiens
  misc_feature: GYAE6OF02JJ2RI.38.4.A04.1.454.CMB.1.raw
  modified_base (368)..(368): a, c, t, g, unknown or other
  misc_feature (368)..(368): n is a, c, g, or t
  modified_base (529)..(529): a, c, t, g, unknown or other
  misc_feature (529)..(529): n is a, c, g, or t
  modified_base (534)..(536): a, c, t, g, unknown or other
  misc_feature (534)..(536): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgccccatgagggctacgagtgggagctacgactttgactacgtggggccagggaaccctggtcaccgtcncctcagcctccaccaacgggcccactcggtccttccccctggccaccctcctccaacgagccacctcgtcggggccacacggccggcccgtgggcctcgcccgtggtccgaaacgggtacctacgttccacgtcgactcgactggagcgggctggcaggcnatagnnn

SEQ ID NO: 222101 - DNA, 584 bp, Homo sapiens
  misc_feature: GYAE6OF02HL884.38.4.A04.1.454.CMB.1.raw
  modified_base (581)..(584): a, c, t, g, unknown or other
  misc_feature (581)..(584): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccactataaaccacgatggaactgaaaaagactatgtggactctgtgaagggccgattcaccgtctccagagacaacgccaagaattcactgtatttgacaaatgaacagcctgagagtcgaagacacggccatatattattgtagtaaaagatcattcgatatggtgcgacgtacgggtggcatgttcttgactcctggggcctgggactccccggtctccgtctcctcacgcctccaccgaacgggcccatccggtccttcccccgtcggccacccctccctaccaacgacgccaccgtcgtcggggccaccgacggccggcccgtgggcctcgccgtcggtacgaacgggtaccttaccttccgacgtgtacgttcgacgtggaacgggccgggcgtcgggaccgtaacgggccgacgaacgtacggnnnn

SEQ ID NO: 222102 - DNA, 532 bp, Homo sapiens
  misc_feature: GYAE6OF02HW35E.38.4.A04.1.454.CMB.1.raw
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (530)..(532): a, c, t, g, unknown or other
  misc_feature (530)..(532): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagtaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagccctccaccaacgggcccatccggtccttccccctggccaccctccnccaagcnccacctcgtcggggcacgagccggccctgggcctcgcctggtaccaaggctaccgttccacgtgatcgacgtggaggcgggctggcaagggcgcagtagnnn

SEQ ID NO: 222103 - DNA, 578 bp, Homo sapiens
  misc_feature: GYAE6OF02G2I46.38.4.A04.1.454.CMB.1.raw
  modified_base (440)..(440): a, c, t, g, unknown or other
  misc_feature (440)..(440): n is a, c, g, or t
  modified_base (576)..(578): a, c, t, g, unknown or other
  misc_feature (576)..(578): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccagggaaccctggtcaccgtctcctcagccctccaaccgaacgggcccagtccggtccttcccccgtggcccaccctcctaccaacgacnccaccgtcgtcggggccacgacggcccggcccgtggggcctcggcccgttggtaccgaacggtaccttaccttccgacgtgactccggacgtggaacggccgggcgtcgggaccgaacgggccgacgaagtacggnnn

SEQ ID NO: 222104 - DNA, 581 bp, Homo sapiens
  misc_feature: GYAE6OF02GHFZD.38.4.A04.1.454.CMB.1.raw
  modified_base (324)..(324): a, c, t, g, unknown or other
  misc_feature (324)..(324): n is a, c, g, or t
  modified_base (581)..(581): a, c, t, g, unknown or other
  misc_feature (581)..(581): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccagggaagggctggagtgggtgccagcattaaccaagatggacgtgaaaaatctatgtggactctgtgaagggccgattcgccatctccagagacaacgccaagaactcactgtggctgcacatgaacggcctgagaggcgacgacacggctgtcgtacttctgtgcgagacgcccccatgagggctacagtggganctacgactttgactacgtggggccagggaaccctggtcaccgtctcctcacgcctccaccgaagggcccagtccggtccttcccccgtggcctacccgtcctccaacgacgccaccgtcgtcggggccacgacgccggcccgtgggcctcgcccgttggtaccaaacgggaccttaccgttcccgacgttcgacgtcgacgtggaacggtccggggacgttcgggaccgaacggggccgtaccgaagtacggtcagn

SEQ ID NO: 222105 - DNA, 533 bp, Homo sapiens
  misc_feature: GYAE6OF02FTROX.38.4.A04.1.454.CMB.1.raw
  modified_base (531)..(533): a, c, t, g, unknown or other
  misc_feature (531)..(533): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtgggagctacgactttgactacgtgggggccaggggaaccctggtcaccgtctcctcagcctccacaagggcccatcggtcttccccctggccaccctcctccaagacgccacctcgtcgggggccacgacgccgggcccgtggggcctcggcccttgggtccaaggacctacttccacgtgatcgactgagcgggctggcaggcgacatagnnn

SEQ ID NO: 222106 - DNA, 537 bp, Homo sapiens
  misc_feature: GYAE6OF02GD5DU.38.4.A04.1.454.CMB.1.raw
  modified_base (535)..(537): a, c, t, g, unknown or other
  misc_feature (535)..(537): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtgggagctacgactttgactactggggccagggaaccctggtcaccgtctcctcagccctccaccgaagggcccagtccggtccttccccctggccaccctcctcccaagacgccacctccgtcgggggccacgacgccggcccgtgggctcgccgtggtcaacggtacctacttccgacgtgatcgacgtggagcgggctggcaaggcgcatagnnn

SEQ ID NO: 222107 - DNA, 512 bp, Homo sapiens
  misc_feature: GYAE6OF02JBO5H.38.4.A04.1.454.CMB.1.raw
  modified_base (504)..(504): a, c, t, g, unknown or other
  misc_feature (504)..(504): n is a, c, g, or t
  modified_base (510)..(512): a, c, t, g, unknown or other
  misc_feature (510)..(512): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagccctccaccagggcccatcggtcttcccctggccaccctcctccaagacgccacctcgtggggcacacgccggccctgggcctgcctggtcaaggctacttccacgtgatcgactgagcggctggcaggcncatagnnn

SEQ ID NO: 222108 - DNA, 547 bp, Homo sapiens
  misc_feature: GYAE6OF02IDYRF.38.4.A04.1.454.CMB.1.raw
  modified_base (326)..(326): a, c, t, g, unknown or other
  misc_feature (326)..(326): n is a, c, g, or t
  modified_base (545)..(547): a, c, t, g, unknown or other
  misc_feature (545)..(547): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatactatgtggactctgtgaagggccgattcgccatctccagagacaacgccaagaactcactgtgctgcacatgaacggcctgagaggcgacgacacggctgtgtacttctgtgcgagacgcccccatgagggctacgagtggganctacgacttgactacgtggggccagggaaccctggtccaccgtctcctcacgccctaccaccgaacgggcccagtcccggtccctttcccccgtggccctacccctccctccaacgcgcctacccgtcgtcggggccacgacgccggcccgtgggctcgccgtggtcaaggcctactccgacgtgatcgacgtgacgcgggctggcaggcgacagtagnnn

SEQ ID NO: 222109 - DNA, 542 bp, Homo sapiens
  misc_feature: GYAE6OF02GE2IC.38.4.A04.1.454.CMB.1.raw
  modified_base (326)..(326): a, c, t, g, unknown or other
  misc_feature (326)..(326): n is a, c, g, or t
  modified_base (540)..(542): a, c, t, g, unknown or other
  misc_feature (540)..(542): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtggganctacgactttgactacgtggggccaggggaaccctggtcaccgtctcctcagcctccaccaagggcccatcggtccttccccctggccaccctcctccaacgacgccacctcgtcgggggccacgacggccggcccgtgggcctcgccgtcggtacgaaggtacctacttccgacgtgactcgacgtggagcgggctggcgaacggcgcatagnnn

SEQ ID NO: 222110 - DNA, 576 bp, Homo sapiens
  misc_feature: GYAE6OF02GYRRD.38.4.A04.1.454.CMB.1.raw
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
tcagtcgatcacgtcacgaccggtgctcgatttagagtagtgatcaggggggtcccgtgagactctcctgtcgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacagtgggagctacgactttgactagtggggccagggaaccctggtccaccgtctcctcagcctccacgacggcccatcggtccttccccctggccaccctccctccaacgacgccaccctcgtcgggggccacgacggccggcccgtcggggcctcgcccgttggtccgaaacgggtacctaccttcccgacgttcgacttccggaccgtcggtacggccggggtctcgggacgaacgggccgaccaagtacggngnc

SEQ ID NO: 222111 - DNA, 562 bp, Homo sapiens
  misc_feature: GYAE6OF02IW6EY.38.4.A04.1.454.CMB.1.raw
  modified_base (369)..(369): a, c, t, g, unknown or other
  misc_feature (369)..(369): n is a, c, g, or t
tcagtcgatcacgtcacgaccggtgctcgatttagagtagtgatcagggggaagaccgatgggcccttggtggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaaagaactcactgtggctgcacatgaacggcctggagaggcgacgacacggctgtgtacttctgtgcgagagcccccatggacgggctacaggtggganctacgactttgactacgtggggccagggaccctggtcaccgtctcctcacgcctccaccaacgggcccacgtccggtccttcccccgtcggccaccctccctacccaacgacgccacctcgtcggggccacgacgccggcccgtcgggctcggcctggtccaacggactaccttccgacgtgactcgactcgg

SEQ ID NO: 222112 - DNA, 532 bp, Homo sapiens
  misc_feature: GYAE6OF02JE09D.38.4.A04.1.454.CMB.1.raw
  modified_base (530)..(532): a, c, t, g, unknown or other
  misc_feature (530)..(532): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactacgtggggccagggaaccctggtcaccgtctcctcagcctccacacggcccatcgtctcccctcggccaccctcctccaagacgccacctcgtcggggccacgacgccggcccgtcgggcctcgcccgtggtcgaacggactacttccacgtgactcgacgtggagcgggcgtcggcgacggcgcatagnnn

SEQ ID NO: 222113 - DNA, 672 bp, Homo sapiens
  misc_feature: GYAE6OF02GAWJ6.38.4.A04.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagtcgatcacgtcacgaccggtgctcgatttagagtagtgatcagggggtccctgagactctcctgtgcagcctctgcattcacctttagtaactatttaatgagctggtccgccagcctccagggaagggctggagtggtgccagcattaaccagatggactgaaaaatctatgtggactctgtgaaggccattcgcatctccagngacacgccaagactcactgtgctgcacntgaacgctgagagcgacgacacggctgtcgtacttcgtggtgcgtagacgtccccctagtcggacggtctacgaggttcgggacgtccgtacggtacttttcgaccgttacgtcggggtaccagggtaaccctggtacctaccgttctacccgtcgacggtcccttaccgaaccgtaacgggtccctacgttccggttcccgtttacccccgtaggtaccctacccgttaccgtaccgtaacggtcgtaccgtaaccgttcggtacggggacctacggtacgtccgggtacccgttcgggaccttacggtccgttacggtaccgtaacgggttaccttaaccgttccgtacggttacgtacgttcggtaacgttcggtacggtccggtacgttacggaccgtaacggtccgtacgtaacgtacgtacgtagtacg

SEQ ID NO: 222114 - DNA, 506 bp, Homo sapiens
  misc_feature: GYAE6OF02FVVXQ.38.4.A04.1.454.CMB.1.raw
  modified_base (504)..(506): a, c, t, g, unknown or other
  misc_feature (504)..(506): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagcctccaccaaggcccatcggtctcccctggccaccctcctccaagagcacctctggggcacacgcggccctgggctgcctggtcaaggctacttccacgtgatcgactgagcgggctggcaggcgcatagnnn

SEQ ID NO: 222115 - DNA, 560 bp, Homo sapiens
  misc_feature: GYAE6OF02G4QGZ.38.4.A04.1.454.CMB.1.raw
  modified_base (414)..(414): a, c, t, g, unknown or other
  misc_feature (414)..(414): n is a, c, g, or t
  modified_base (558)..(559): a, c, t, g, unknown or other
  misc_feature (558)..(559): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggtctgagaggcgacgacacggctgtgtacttctgtgcgagacgcccccatgagggctacagtgggagctacgactttgactacgtggggccagggaaccctggtccaccgtctcctcacgccctccaccaacgggcccagtccggtccttcccccgnggccaccctcctcccaagcgccacctcgtcggggccacgacgccggcccgtgggcctcggcccgtgggtaccaaacgggtacctacgttcccgacgttgactccggacgtggacggcgggctggccgaagggccgacagtagcnnc

SEQ ID NO: 222116 - DNA, 575 bp, Homo sapiens
  misc_feature: GYAE6OF02IBMQ1.38.4.A04.1.454.CMB.1.raw
  modified_base (572)..(573): a, c, t, g, unknown or other
  misc_feature (572)..(573): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccaggggaaccctggtcaccgtctcctcagccctccaccaagggcccagtccggtccttccccctggccaccctccctccaacggacgccaccctcgtcgggggccacgacgccgggcccgtggggcctcggcccgtgggtccgaaagggtaccttaccttcccgacgtgacttccgacgtggaacggccgggggtcgtcggaccgaacgggccgacgaagtacggnncg

SEQ ID NO: 222117 - DNA, 528 bp, Homo sapiens
  misc_feature: GYAE6OF02H2WRF.38.4.A04.1.454.CMB.1.raw
  modified_base (325)..(325): a, c, t, g, unknown or other
  misc_feature (325)..(325): n is a, c, g, or t
  modified_base (526)..(528): a, c, t, g, unknown or other
  misc_feature (526)..(528): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacgagtggganctacgactttgactacgtggggccagggaccctggtcaccgtctcctcacgcctccaccaacgggcccagtccggtccttcccccgtggccaccctcctccaacgacgccacctcgtggggcacgacgccggcccgtgggcctgccctggtcaaggctacttccacgtgatcgactggacgcgggctggcaggcgcatagnnn

SEQ ID NO: 222118 - DNA, 527 bp, Homo sapiens
  misc_feature: GYAE6OF02JBE95.38.4.A04.1.454.CMB.1.raw
  modified_base (326)..(326): a, c, t, g, unknown or other
  misc_feature (326)..(326): n is a, c, g, or t
  modified_base (521)..(521): a, c, t, g, unknown or other
  misc_feature (521)..(521): n is a, c, g, or t
  modified_base (525)..(527): a, c, t, g, unknown or other
  misc_feature (525)..(527): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtggganctacgactttgactacgtggggccagggaaccctggtcaccgtctcctcacgcctccaccaagggcccatccggtccttccccctggccaccctcctaccaagacgcacctcgtcggggcacgacgccggccctgggcctgcctggtcaaggctacttccacgtgactcgacgtgacgcgggctggcaggcgcanacgnnn

SEQ ID NO: 222119 - DNA, 516 bp, Homo sapiens
  misc_feature: GYAE6OF02I81H1.38.4.A04.1.454.CMB.1.raw
  modified_base (510)..(516): a, c, t, g, unknown or other
  misc_feature (510)..(516): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggcaactatatcatatgatggaagttttaaagactatgcggactccgtgaagggccgattcaccatctccagagacaattccaagagcacactctatttgcaaatgaacagcctgggagctgaggacacggctgtctattactgtgcgaagaaccggccctctatgggtcggggagttatgtctggggccagggaaccctggccaccgtctcctcagcctccaccaagggcccatcggtcttccccctggccgcccctgcctcccgaggacgcaccctccgagagcacagcggccctgggcctgcctggtccaaggctacttccacgtgatcgactgagcgggctggcaagggcgcagtagnnnnnnn

SEQ ID NO: 222120 - DNA, 521 bp, Homo sapiens
  misc_feature: GYAE6OF02G8KN4.38.4.A04.1.454.CMB.1.raw
  modified_base (519)..(521): a, c, t, g, unknown or other
  misc_feature (519)..(521): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactactggggccaggggaaccctggtcaccgtctcctcagcctccaccagggcccatcggtcttccccctggccaccctcctccaacgacgccacctcgtggggccacgagccggccctgggcctgcctggtcaaggactacttccacgtgactcgactgagcgggctcggcaaggcgcatagnnn

SEQ ID NO: 222121 - DNA, 639 bp, Homo sapiens
  misc_feature: GYAE6OF02GE1IP.38.4.A04.1.454.CMB.1.raw
  modified_base (267)..(268): a, c, t, g, unknown or other
  misc_feature (267)..(268): n is a, c, g, or t
  modified_base (299)..(299): a, c, t, g, unknown or other
  misc_feature (299)..(299): n is a, c, g, or t
  modified_base (458)..(458): a, c, t, g, unknown or other
  misc_feature (458)..(458): n is a, c, g, or t
tcagtcgatcacgtcacgaccggtgctcgatttagagtagtgatcagggggggttccctgagactctcctgtgcagccctctgcattcctacctttagtaactattaatgagctgggtccgccagcctccgacgggaagggctgggagtggggtggccagcagtttaaccaagtatggaacgttagaaaaatctatgtggactcgtggtgaagggtccgattcgccagtcgtcgagagaccaacgccaagaactcactgtgctgcanncgacgcctgagagcgacgtacacggtctgtntactcgtgtggcgagacgcccctacgtggacgggcttacgaggttgggacgccgtaacgacgtttacgaacgtacgtggggacctaagggaaacccttggtcaccgtctcctcgacgaccgtccaaccgtacgggccctagtcccggtccttcccccgnggaccctaacccgtccgaaccgaacgaccgcctaccgtccgtcggggaccacgacggtcccggacccgtggggccctcggaccgttgggtaccgaacgggaccttacgtccgacgtcgacgtccggtacgtcggacggcgggtcgtacgggaccgtaacgggctaccgtagtacgtgatcg

SEQ ID NO: 222122 - DNA, 528 bp, Homo sapiens
  misc_feature: GYAE6OF02HZG67.38.4.A04.1.454.CMB.1.raw
  modified_base (430)..(430): a, c, t, g, unknown or other
  misc_feature (430)..(430): n is a, c, g, or t
  modified_base (528)..(528): a, c, t, g, unknown or other
  misc_feature (528)..(528): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagcgcccccatgaggctacagtgggagctacgactttgactacgtggggccagggaccctggtcaccgtctcctcacgccctccaccaagggcccagtccggtcttccccctggccgccctgcctccgaggacnccaccgtccgagacgcacaggccgcccgtgggctgcctggtcaaggacctactccacgtgactcggactggcggcggcgtggacgaaggcgacatagn

SEQ ID NO: 222123 - DNA, 545 bp, Homo sapiens
  misc_feature: GYAE6OF02GTQNZ.38.4.A04.1.454.CMB.1.raw
  modified_base (543)..(545): a, c, t, g, unknown or other
  misc_feature (543)..(545): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcacgccctccaccgaagggcccatccggtccttcccccgtggccaccctccctaccaacgacgccaccctcgtcgggggccacgacggccggcccgtgggcctcgccgtgggtccaacggaccttacttccacgtgactcgacgtggagcgggctggcaggcgcagtagnnn

SEQ ID NO: 222124 - DNA, 562 bp, Homo sapiens
  misc_feature: GYAE6OF02G0G14.38.4.A04.1.454.CMB.1.raw
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagccctccaccaagggcccatcggtccttcccccgtggccaccctcctccaacgacgccacccgtcgtcgggggccacgacggccggccctggggcctcggcccgttgggtaccaacgggtacctacgttcccgacgttgactcgacgtcggagcggggtctcgggacgaacgggccgacgagtagngnn

SEQ ID NO: 222125 - DNA, 497 bp, Homo sapiens
  misc_feature: GYAE6OF02GYVLW.38.4.A04.1.454.CMB.1.raw
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
  modified_base (495)..(497): a, c, t, g, unknown or other
  misc_feature (495)..(497): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactactggggccagggaaccctggtcaccgtctcctcagcctccacaggccatcgtctcccctgcacctcctcagncnctcgngggcacngcgcctggcngctggtcagtctactccacgtgatcgactgacggcgggctggacgacggcgcgatagnnn

SEQ ID NO: 222126 - DNA, 596 bp, Homo sapiens
  misc_feature: GYAE6OF02G1Y6Z.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtgggggccaggggaaccctggtcaccgtctcctcagccctccaccaacgggcccatccggtccttcccccgtggccaccctcctcccaacgacgccacccgtcgtcgggggccacgacggccgggcccgtggggcctcggcccgttgggtccaaacgggtaccttaccgttcccgacgttcgagttccggaccgttgggaacggccgggggtcctcggggaccgaacggggccgaccgaacgttacggcgagcg

SEQ ID NO: 222127 - DNA, 569 bp, Homo sapiens
  misc_feature: GYAE6OF02GZESM.38.4.A04.1.454.CMB.1.raw
  modified_base (566)..(566): a, c, t, g, unknown or other
  misc_feature (566)..(566): n is a, c, g, or t
  modified_base (568)..(569): a, c, t, g, unknown or other
  misc_feature (568)..(569): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccagggaaccctggtcaccgtctcctcagccctccaccgaacgggcccagtccggtccttcccccgtggcccacccgtcctaccaacgacgcctaccgtccgtcggggaccacgacgccggcccgtgggcctcggcccgtgggtaccaacgggtacctaccttccgacgtcgagttccggacgtcggacgtcgggcctggacaacggccgacagtacgngnn

SEQ ID NO: 222128 - DNA, 573 bp, Homo sapiens
  misc_feature: GYAE6OF02GYPD0.38.4.A04.1.454.CMB.1.raw
  modified_base (571)..(572): a, c, t, g, unknown or other
  misc_feature (571)..(572): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggagctacgactttgactacgtggggccagggaaccctggtcaccgtctcctcacgcctccacgaacgggcccagtccggtcccttcccccgtcggccctaccctcctaccaagcgccaccgtcggtcggggaccacgacggccggtcccgtgggcctcgccgtcggtacgaacggtaccttaccttaccgacgtgtactcggacgtcggacggcgggtctcgggacgaacgggcgactagtacgnnc

SEQ ID NO: 222129 - DNA, 552 bp, Homo sapiens
  misc_feature: GYAE6OF02IQFTH.38.4.A04.1.454.CMB.1.raw
  modified_base (327)..(327): a, c, t, g, unknown or other
  misc_feature (327)..(327): n is a, c, g, or t
  modified_base (550)..(552): a, c, t, g, unknown or other
  misc_feature (550)..(552): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacaggtggganctacgacttgactacgtggggccagggaaccctggtcaccgtctcctcacgccctccaaccgaacgggcccagtccggtccttcccccgtggcctaccctcctccaacgacgcaccctcgtcggggaccacgacgccgggcccgtcggggctcggcctggtaccaacggtactaccgttccacgtgactcgacgtgacggcgggctggcgaaggcgacatagnnn

SEQ ID NO: 222130 - DNA, 580 bp, Homo sapiens
  misc_feature: GYAE6OF02IEI1W.38.4.A04.1.454.CMB.1.raw
  modified_base (332)..(332): a, c, t, g, unknown or other
  misc_feature (332)..(332): n is a, c, g, or t
  modified_base (570)..(570): a, c, t, g, unknown or other
  misc_feature (570)..(570): n is a, c, g, or t
  modified_base (579)..(580): a, c, t, g, unknown or other
  misc_feature (579)..(580): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgccatctcagagacaacgccaagaactcactgtggctgcacatgaacggcctgagaggcgacgacacggctgtgtacttctgtgcgagacgcccccagtggagggctacgaggtggganctacgtactttgacgtacgtggggaccaacggggaaccctggtccaccgtctcctcgacgccctaccaccgaacgggcccagtcccggtccttcccccgtggccaccctccctaccgaagacgcctaccgtcgtcggggccacgacggccggcccgtgggccgtcgccgtggtaccaaaggtacctaccgttccacgttgactacggacgtggacggcgggcgtggaccgagggccgnaagtagcgnn

SEQ ID NO: 222131 - DNA, 531 bp, Homo sapiens
  misc_feature: GYAE6OF02IE72J.38.4.A04.1.454.CMB.1.raw
  modified_base (328)..(328): a, c, t, g, unknown or other
  misc_feature (328)..(328): n is a, c, g, or t
  modified_base (454)..(454): a, c, t, g, unknown or other
  misc_feature (454)..(454): n is a, c, g, or t
  modified_base (525)..(525): a, c, t, g, unknown or other
  misc_feature (525)..(525): n is a, c, g, or t
  modified_base (529)..(531): a, c, t, g, unknown or other
  misc_feature (529)..(531): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactacgtggggccagggaaccctggtcaccgtctctcagcctccaaccgaacgggcccatccggtccttcccccgtggccaccctcctaccaagacgccacctcgtggggcacgngccggcctgggctgcctggtcaagactacttccgacgtgatccgagtggacgcgggctcggacacgggcanatgnnn

SEQ ID NO: 222132 - DNA, 609 bp, Homo sapiens
  misc_feature: GYAE6OF02G9FJT.38.4.A04.1.454.CMB.1.raw
  modified_base (605)..(605): a, c, t, g, unknown or other
  misc_feature (605)..(605): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacaggtgggagctacgactttgactacgtggggccagggaaccctggtcaccgtctcctcacgccctccaccgaacggcccatccggtccttcccccgtggccaccctccctccaacgacgccacctcgtcggggccacgacgccggcccgtggggccttcggcccgttgggtaccgaaacgggtaccttaccgttcccgacggttcgacgttaccggacgttcgggaacgggtcccgggggtccgttacggggacccgtaaacgggggccggaccgtaaggtacggacngacg

SEQ ID NO: 222133 - DNA, 548 bp, Homo sapiens
  misc_feature: GYAE6OF02IWLK1.38.4.A04.1.454.CMB.1.raw
  modified_base (546)..(548): a, c, t, g, unknown or other
  misc_feature (546)..(548): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacaggtgggagctacgactttgactactgggggccaggggaaccctggtcaccgtctcctcagccctccaaccaaggggccccagtccggtccttcccccgtggcccaccctcctccaacgacgcaccctcgtcgggggcaccgacgccgggcctcgggcctcgccgtggtcaacggtactaccttccacgtgactcgacgtgacggcgggctggcgaacggcgcatgnnn

SEQ ID NO: 222134 - DNA, 602 bp, Homo sapiens
  misc_feature: GYAE6OF02I7LSJ.38.4.A04.1.454.CMB.1.raw
  modified_base (578)..(578): a, c, t, g, unknown or other
  misc_feature (578)..(578): n is a, c, g, or t
  modified_base (598)..(598): a, c, t, g, unknown or other
  misc_feature (598)..(598): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacgcctgagaggcgacgacacggctgtgtacttctgtgcgagcgcccccagtggaggctacgaggtgggagtctacgtactttgactacgtggggccagggaaccctggtacaccgtctcctacacgccctccaccgaacgggcccacgtccggtcccttcccccgtgccctacccctcctacccgaagaccgccacccgttcgcgggggacccacgtacggcccgggcccgttggggccctacggcccgtcgggtaccaagggtacccttaccgttcccgtacgtgtacgtcggtaaccgtggaacggccgggtcgtacggngaaccgggtcaccgagtagntagc

SEQ ID NO: 222135 - DNA, 558 bp, Homo sapiens
  misc_feature: GYAE6OF02HWJHD.38.4.A04.1.454.CMB.1.raw
  modified_base (290)..(290): a, c, t, g, unknown or other
  misc_feature (290)..(290): n is a, c, g, or t
  modified_base (556)..(557): a, c, t, g, unknown or other
  misc_feature (556)..(557): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttcngtgcgagacgcccccatgacgggctacaggtgggagctacgactttgactacgtggggccagggaccctggtcaccgtctccgtcacgcctccaccgaagggcccagtccggtccttcccccgtggccaccctccctccaacgacgccaccctcgtgggaccacgacgccgggcccgtgggcctcggccctgggtacaaacggtacctacgttaccacgttcgatccgactggacggcgggcgtcggacgaagggccgcaagtagnnc

SEQ ID NO: 222136 - DNA, 563 bp, Homo sapiens
  misc_feature: GYAE6OF02H5SLV.38.4.A04.1.454.CMB.1.raw
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (561)..(562): a, c, t, g, unknown or other
  misc_feature (561)..(562): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttcngtgcgagacgcccccatgagggctacgaggtggganctacgactttgactacgtggggccagggaaccctggtcaccgtctcctcacgcctcaccgaacgggcccagtccggtccttcccccgtcggccaccctcctaccaagacgccacctcgtcggggccacgacggccggcccgtcgggcctcggccgtggtaccgaacggtacctacgttcccgacgtgacgtccgacgtggacggcgggctcgggacgtacgggcgacgagtagnnc

SEQ ID NO: 222137 - DNA, 597 bp, Homo sapiens
  misc_feature: GYAE6OF02ID6JG.38.4.A04.1.454.CMB.1.raw
  modified_base (595)..(596): a, c, t, g, unknown or other
  misc_feature (595)..(596): n is a, c, g, or t
tcagtcgatcacgtcacgaccggtgctcgatttagagtagtgatcaggggggggtccctgagactctcctgtgcagcctctgcatttcaccttttagtaactatttaatgagctgggtccgccagcctccagggaaggggctggagtgggtggccagcattaacccaagatggacgtgaaaaatctatgtggactctgtgaagggccattcgcatctcagtagacaacgccaagaactcactgtggctgcacatgaacggcctgagaggccgacgacacggctgtgtacttctggtcgcggacgacgcccccaagtgacgggctacgaggtgggacgctacggtactttgacttacgtggggccacgggaaccctggtccaaccgtctcctcacgccctccgaacgaacgggccctagtccggtacctttccccgtcggacctacccgtaccctaccgaaacgtacgacctaccgttccgtcgggggccaccgaggcccgggccgtgggacctggcccgttggtacaaacggtactacgttccgacgtcgactcgacgtgacggcgggtctgggactacggccgacgacgtcgannc

SEQ ID NO: 222138 - DNA, 563 bp, Homo sapiens
  misc_feature: GYAE6OF02G8QFJ.38.4.A04.1.454.CMB.1.raw
  modified_base (324)..(324): a, c, t, g, unknown or other
  misc_feature (324)..(324): n is a, c, g, or t
  modified_base (562)..(562): a, c, t, g, unknown or other
  misc_feature (562)..(562): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgtcacggctgtgtacttctgtgcgagagctcccactgagggctacagtggganctacgactttgactacgtggggccagggaccctggtcaccgtctcctcacgccctccaccgaacggcccacgtccggtccttcccccgtcggccaccctccctccaacgacgccaccgtcgtcggggcacgacggccggcccgtcgggccgtcgccgtggtacgaacggtacctaccgttccgacgttcgacgtccggaacgtggacggcgggcgtgggacgaacgggcgcgagtagnc

SEQ ID NO: 222139 - DNA, 595 bp, Homo sapiens
  misc_feature: GYAE6OF02IRI1Q.38.4.A04.1.454.CMB.1.raw
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacaggtgggagctacgactttgacttacgtggggaccaggggaaccctggtccaccgtctcctcacgccctccaccgaacgggcccagtccggtccttcccccgtggcccaccctccctaccaacgacgcctaccctcgtcgggggccaccgacggccggcccgtgggcctcgcccgttgggtccaaacgggtacctaccgtttccgacgttcgacgtccggacgtcggaacggccggggtactcgggaccgaacgggccgaccgaagtacggnancg

SEQ ID NO: 222140 - DNA, 534 bp, Homo sapiens
  misc_feature: GYAE6OF02FFZIG.38.4.A04.1.454.CMB.1.raw
  modified_base (532)..(534): a, c, t, g, unknown or other
  misc_feature (532)..(534): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgacttttgactacgtggggccagggaaccctggtcaccgtctcctcagccctccaccaagggcccatccggtccttcccccgtggccaccccgtcctccaagacgccacctcgtcggggcacgagccggccctgggctcgccctggtcaaggcctacttccgacgtgatcgacgtggaggccgggctggcaacggcgacatcggnnn

SEQ ID NO: 222141 - DNA, 575 bp, Homo sapiens
  misc_feature: GYAE6OF02G4WMY.38.4.A04.1.454.CMB.1.raw
  modified_base (328)..(328): a, c, t, g, unknown or other
  misc_feature (328)..(328): n is a, c, g, or t
  modified_base (573)..(575): a, c, t, g, unknown or other
  misc_feature (573)..(575): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgagtggganctacgactttgactacgtggggccagggaaccctggtcaccgtctccctcacgccctccaaccgaacgggcccacgtccggtccttcccccgtcggcccacccctccctacccaacgacgccaccctcgtcgggggccaaccgacggcccgggcccgtcggggcctcggcccgtggtacgaacggtacctaccttccgacgtgactcgactggacggcgggcgtggacgagggccgacgagtagnnn

SEQ ID NO: 222142 - DNA, 552 bp, Homo sapiens
  misc_feature: GYAE6OF02IG6WB.38.4.A04.1.454.CMB.1.raw
  modified_base (550)..(552): a, c, t, g, unknown or other
  misc_feature (550)..(552): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaccctggtcaccgtctcctcagccctccaccaacgggcccatccggtcttcccccgtggccaccctcctccaagacgccaccgtcgtcgggggccacgacggccggccctggggcctcgcccgtgggtacaaacgggtccttacttcccgacgtgacgtcgtactggacggcgggctgggccaaggccgcagtcggnnn

SEQ ID NO: 222143 - DNA, 517 bp, Homo sapiens
  misc_feature: GYAE6OF02GIKCH.38.4.A04.1.454.CMB.1.raw
  modified_base (515)..(517): a, c, t, g, unknown or other
  misc_feature (515)..(517): n is a, c, g, or t
tcagtcgatcacgtcacgaccggtgctcgatttagagtagtgatcaggggggtcccgtgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccaggggaaccctggtcaccgtctcctcagcctccacaaggcccatcggtcttccccctggccaccctcctccaacgacgcacctcgtcgggggcacgagccggccctgggcctgcctggtcaaggactactccacgtgatcgacgtgagcggctggcaaggcgcatagnnn

SEQ ID NO: 222144 - DNA, 562 bp, Homo sapiens
  misc_feature: GYAE6OF02H7PKO.38.4.A04.1.454.CMB.1.raw
  modified_base (251)..(251): a, c, t, g, unknown or other
  misc_feature (251)..(251): n is a, c, g, or t
  modified_base (559)..(560): a, c, t, g, unknown or other
  misc_feature (559)..(560): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcanatgaacggctgagaggcgacgacacggctgtgtacttctgtgcgagacgcccccactgagggctacgaggtgggagctacgactttgactacgtggggccagggaaccctggtcaccgtctcctcacgccctcaccaagggcccatccggtcctttcccccgtggccctacccctccctacccgaagcgccacccgtcgtcggggccacgacgccggcccgttggggcctcgcccgtgggtaccaaggtcctacttccacgtgacgtcgtacgtggacgcgggccgtcggcgaacggccgacagtagnngc

SEQ ID NO: 222145 - DNA, 564 bp, Homo sapiens
  misc_feature: GYAE6OF02IC8BH.38.4.A04.1.454.CMB.1.raw
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccgattcgccatctccagagacaacgccaagaactcaactgtggctgcacatgaacggcctgagaggcgacgacacggctgtgtacttctgtgcgagacgcccccactgagggctacaggtgggagcgtaacgacttttgacctacgtggggccaaggggaaccctggtcaccgtctcctcacgcctccacgaacgggcccactccggggtccttccccgtcggcctaccctcctaccaacgacgacacccgtccgtcgggccgacgacgccggcccgtcgggcctcgcctcggtccgaacggtacctacttccacgtcgagtcgacgtgacgcgggcgtcggcgaggcgcgacgtagngnn

SEQ ID NO: 222146 - DNA, 579 bp, Homo sapiens
  misc_feature: GYAE6OF02J2FQB.38.4.A04.1.454.CMB.1.raw
  modified_base (576)..(576): a, c, t, g, unknown or other
  misc_feature (576)..(576): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgccccactgagggctacgagtgggagctacgactttgactacgtggggccagggaaccctggtcaccgtctcctcacgcctccaccaacgggcccatccggtccttcccccgtggccaccctcctaccaagacgccacctcgtcggggccacgacggccggcccgtgggcctgacccgttgggtaccgaaacggtaccttacgttacccacggtcgactccggtacgtcggacggtcggggccgttagggccgaacggggccgacgacgtacggcgngcg

SEQ ID NO: 222147 - DNA, 565 bp, Homo sapiens
  misc_feature: GYAE6OF02IG97E.38.4.A04.1.454.CMB.1.raw
  modified_base (327)..(327): a, c, t, g, unknown or other
  misc_feature (327)..(327): n is a, c, g, or t
  modified_base (562)..(563): a, c, t, g, unknown or other
  misc_feature (562)..(563): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccagggaaggggctggagtgggtggccagcattaaccaagatggacgtgaaaaatactatgtggactctgtgaagggccgattcgccatctccagagacaacgccaagaactcactgtggctgcacatgaacggctgagaggcgacgacacggctgtgtacttctgtgcgagacgcccccagtgagggctacaggtggganctacgactttgactacgtggggccaagggacccttggtccaccgtctcctcacgcctccaccgacggcccatccggtccttcccccgtcgccaccctcctaccaacgacgccaccgtcgtcggggaccacgacgccggccgtcgggctcgccgtggtccgaacgccgttacttcccgacgttcgacgttacgacgtcggacggcgggccgtcggaccgacggcgaccgagtacgnngc

SEQ ID NO: 222148 - DNA, 530 bp, Homo sapiens
  misc_feature: GYAE6OF02JGIMU.38.4.A04.1.454.CMB.1.raw
  modified_base (528)..(530): a, c, t, g, unknown or other
  misc_feature (528)..(530): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactactggggccagggaaccctggtcaccgtctcctcagccctcaccaagggcccatcggtcttccccctggccaccctcctccaacgacgccacctcgtcgggggccacgacgccggcccgtgggcctgcctggtcaaggactacttcccgacgtcgactcgactggacgcgggctggcgacggcgcagtagnnn

SEQ ID NO: 222149 - DNA, 597 bp, Homo sapiens
  misc_feature: GYAE6OF02IOC9E.38.4.A04.1.454.CMB.1.raw
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (436)..(436): a, c, t, g, unknown or other
  misc_feature (436)..(436): n is a, c, g, or t
tcagtcgatcacgtcacgaccggtgctcgatttagagtagtgatcagggggggggtccctgagactctcctggtgcagcctcgtgcatttcacctttagtaactatttaatgagcgtgggtccgccgaggccctccaggggaaggggctgggagtgggtggccagcattaacccagatggacgtgaaaaatctatgtggactctgtgaaggccattcgccatctccagagacaacgccaaagaactcactgtggctgcacntgaacggcctgagtaggcgacgacacggntgtgtacttctgtgcgagacgcccccatggagggctacagtgggagctacgacttgactacgtggggccagggaaccctggtcaccgtctcctcacgcctcccacaacggcccacgtccggtccttcccccgtggcctaccctccnccaacgcgacctaccgtcggtcggggccaccacggccggcccgtgggcctcggcccgttggtaccaacgggtacctaccgttccgacgtgtacctcgtaaccgtggaacggccgggaccgttcggggacccaacgggtcccggaccgtagttacgctgacg

SEQ ID NO: 222150 - DNA, 529 bp, Homo sapiens
  misc_feature: GYAE6OF02FJJI3.38.4.A04.1.454.CMB.1.raw
  modified_base (506)..(506): a, c, t, g, unknown or other
  misc_feature (506)..(506): n is a, c, g, or t
  modified_base (527)..(529): a, c, t, g, unknown or other
  misc_feature (527)..(529): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccactgagggctacagtgggagctacgactttgactactggggccaggggaaccctggtcaccgtctcctcagcctccaccaagggcccatccggtcttccccctggccaccctccctcccaagacgccaccctcgtcgggggccacgacgccggccctggggcctcgccttggtccaaggactacttccacgtgatcgactgngcgggctggcgaggcgcatgnnn

SEQ ID NO: 222151 - DNA, 587 bp, Homo sapiens
  misc_feature: GYAE6OF02IIEVK.38.4.A04.1.454.CMB.1.raw
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaaatactatgtggactctgtgaagggccgattcgccatctccagagacaacgccaagaactcactgtggctgcacatgaacggctgagaggcgacgacacggctgtgtacttctgtgcgagacgcccccatgagggctacagtggacgctaacgacttttgactacgtggggccagggaaccctggtcaccggtctccctcacgcctaccaccgaagggcccagtccggtccttcccccttgcctaccctcctaccaacgagccaccctcgtcgggggccaccgagcccgggtcccgtcggggctcggacccgttcgggtacaaacgggtaccttaaccttcccgaacggttgaactccggaccttggacgtccggggacttcgggactaaggccggcctaagtacgngnn

SEQ ID NO: 222152 - DNA, 581 bp, Homo sapiens
  misc_feature: GYAE6OF02H77P4.38.4.A04.1.454.CMB.1.raw
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagccctccaccaagggcccactcggtccttccccctggccaccctcctcccaagacgccacctcgtcgggggccacacgccgggccctggggacctcgccgtgggtacgaaacgggtacctaccgttacccgacggttgacttccggacttcggaacgggtccggggtccgtcgggaccgaacgggccgtaccgagtaacgngncg

SEQ ID NO: 222153 - DNA, 539 bp, Homo sapiens
  misc_feature: GYAE6OF02IZJXD.38.4.A04.1.454.CMB.1.raw
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (536)..(537): a, c, t, g, unknown or other
  misc_feature (536)..(537): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgccccccatggagggcctaacgaggtgggagctacgactttgactacgtggggccagggaaccctggtcaccgtctcctcacgccctccacgacggccacgtccgtccttccccgngccnccctcncagcncactcgcgggcacgcgcgccgnggctcgcgtcggcgaagtcctactccgacgtgactccgacgtcggacggccgggtcgtcgggacgaacgggccgacgagtacgnncg

SEQ ID NO: 222154 - DNA, 551 bp, Homo sapiens
  misc_feature: GYAE6OF02HX559.38.4.A04.1.454.CMB.1.raw
  modified_base (549)..(551): a, c, t, g, unknown or other
  misc_feature (549)..(551): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaagaactcactgtggctgcacatgaacggcctgagaggcgacgacacggctgtgtacttctgtgcgagacgcccccatgagggctacaggtgggagctacgactttgactacgtggggccagggaccctggcaccgtctcctcacgccctccaccgaacgggcccagtccggtccttcccccgtcggccaccctccctaccaacgacgccacccgtccgtcgggggccacgcggccggcccgtgggcctcgccgtggtccaaggtacctaccttccacgtgactcgacgtggacgcgggctggacgaggccgcgatagnnn

SEQ ID NO: 222155 - DNA, 548 bp, Homo sapiens
  misc_feature: GYAE6OF02IKEUC.38.4.A04.1.454.CMB.1.raw
  modified_base (292)..(292): a, c, t, g, unknown or other
  misc_feature (292)..(292): n is a, c, g, or t
  modified_base (547)..(548): a, c, t, g, unknown or other
  misc_feature (547)..(548): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttcngtgcgagcgcccccatgagggctacaggtgggagctacgactttgactacgtggggccagggaaccctggtcaccgtctcctcacgcctcccacgaacgggcccacgtccggtccttcccccgtggccctaccctccctaccgaacgcgccacctcgtcggggcacgacgccggcccgtgggcctcgccgtggtcaacggtactactccacgtgactccgactggacggcgggcgtgggacgaggcgacagtgcnn

SEQ ID NO: 222156 - DNA, 728 bp, Homo sapiens
  misc_feature: GYAE6OF02IEY9M.38.4.A04.1.454.CMB.1.raw
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
tcagtcgatcacgtcacgaccggtgctcgatttagagtagtgatcagggggggtccctagagacctctcctgtgcagcctctgcattcaccgtttacgtaactattaatgacgcgtggtcccgccacgtcctccagggaaggggtcctgggtagtgggtgccagcattaacccaagatggaccgtgaaaactctatggtcggactctgtgaaggccgattcggccatcctccagagacaactccaagactcacctgtgcttgcctactatcgaacggtcctgagaggcgaacgacgacggctagtcgtacttcgttgtgcgtagcgcccctanggagggctacgagtcggganccgtacggtactttggacctacgtggggcctagggaaccctgggtaccaccggtcttcctctacggcccctacccgaaccgaacgggaccccacgttcccggttcccgttccccccgtagggtccctaaccccgttacccgttacccgaaacggtaaccgtcccgttaaccctttccggtaccgggggaccaccgtaaccgggccgggtacccccgttggggtccccttaccggtcccgtttacgggtaccgaaacggggtaccttaaccggttcccgtaacggttacgaccgttaccggtaccgttagggtaccggtccgggtaccgtacgggtacgtaacgggccgttacccgtaggtacggtacctccgacg

SEQ ID NO: 222157 - DNA, 562 bp, Homo sapiens
  misc_feature: GYAE6OF02I0VHK.38.4.A04.1.454.CMB.1.raw
  modified_base (344)..(344): a, c, t, g, unknown or other
  misc_feature (344)..(344): n is a, c, g, or t
  modified_base (559)..(560): a, c, t, g, unknown or other
  misc_feature (559)..(560): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtgggagctacgactttgacttacgngggggccagggaaccctggtaccaccgtctccctcacgccctccaccgaacgggcccagtccggtccttcccccgtcggcccaccctccctccaacgacgccacctcgtggggccacgacgccggcccgtcgggctcgccgtggtaccacggaccttactccgacgtgactcgacgtggacggccgggcttcgggacgaacggcgtacagtacgnngc

SEQ ID NO: 222158 - DNA, 554 bp, Homo sapiens
  misc_feature: GYAE6OF02II7WC.38.4.A04.1.454.CMB.1.raw
  modified_base (325)..(325): a, c, t, g, unknown or other
  misc_feature (325)..(325): n is a, c, g, or t
  modified_base (552)..(553): a, c, t, g, unknown or other
  misc_feature (552)..(553): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtggganctacgactttgactacgtggggccagggaccctggtcaccgtctcctcacgccctccaccgaacgggcccagtccggtccttcccccgtcggcctaccctcctaccaacgacgccaccgtcgtggggccacgacgccggcccgtcgggctcgccgtggtaccgaacggtcctacgttccacgtcgactcgacgtggacggcgggctcggacgacggcgacagtacgnnc

SEQ ID NO: 222159 - DNA, 561 bp, Homo sapiens
  misc_feature: GYAE6OF02GD5MI.38.4.A04.1.454.CMB.1.raw
  modified_base (558)..(559): a, c, t, g, unknown or other
  misc_feature (558)..(559): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggagctacgactttgactacgtggggccagggaaccctggtccaccgtctcctcacgccctccaccgaacgggcccagtccggtccttcccccgtggcccaccctcctaccaagacgccacctcgtcggggccacgcgccggcccgtgggctcgccgtggtacgaacgggtaccttaccgttccgacgtgactcggacgtggacggcgggtcgtcggcgaacggcgcgagtgnncg

SEQ ID NO: 222160 - DNA, 524 bp, Homo sapiens
  misc_feature: GYAE6OF02JH0KN.38.4.A04.1.454.CMB.1.raw
  modified_base (522)..(524): a, c, t, g, unknown or other
  misc_feature (522)..(524): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagggctacgagtgggagctacgactttgactactggggccagggaaccctggtcaccgtctcctcacgcctccaccacggcccatcgtctcccctgcctacctcctccaacgcgccacctcgtcggggccacgacgccggcctgggctgcctggtcgaacgctactccacgtcgacgtcgacgtggacgcgggctcggcaacggcgacagtgnnn

SEQ ID NO: 222161 - DNA, 568 bp, Homo sapiens
  misc_feature: GYAE6OF02JUIWE.38.4.A04.1.454.CMB.1.raw
  modified_base (566)..(566): a, c, t, g, unknown or other
  misc_feature (566)..(566): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactgagtgctacagtgggagctacgactttgactacgtggggccagggaaccctggtcaccgtctcctcagcctccaccgacggcccatcgtccttccccgtggccaccctcctccaagacgccacctcgtcggggccacgacggccggccctcgggccgtcggcccgtcgggtaccgaacggacttaccgttcccaacgtgacgtccggacttaggacggtccgggacgttgggaccgtaagggccgacgacgtacggncg

SEQ ID NO: 222162 - DNA, 559 bp, Homo sapiens
  misc_feature: GYAE6OF02IIVBQ.38.4.A04.1.454.CMB.1.raw
  modified_base (268)..(268): a, c, t, g, unknown or other
  misc_feature (268)..(268): n is a, c, g, or t
  modified_base (381)..(381): a, c, t, g, unknown or other
  misc_feature (381)..(381): n is a, c, g, or t
  modified_base (555)..(555): a, c, t, g, unknown or other
  misc_feature (555)..(555): n is a, c, g, or t
  modified_base (558)..(559): a, c, t, g, unknown or other
  misc_feature (558)..(559): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccaggggaaggggctggagtgggtggccagcattaaccaagatggacgtagaaaaatactatgtggactctgtgaagggccgattcgccatctccagagacaacgccaagaactcactgtggctgcacatgaacggcctgagnggcgacgacacggctgtgtacttctgtgcgagacgcccccatggagggctacaggtgggagctacgtactttgactacgtcggggccagggaaccctggtcaccgtctcctcncgccctccaccgaacggcccagtccggtccttccccctggccaccctccaccacgacgcctaccgtcgtggggccacgcggccggccgtgggcctcggcccgtggtacgaacggaccttacttcccgacgtcgacgtccggacgtggacggcgggctcggacgacggcgcagtncgnn

SEQ ID NO: 222163 - DNA, 575 bp, Homo sapiens
  misc_feature: GYAE6OF02I9JEP.38.4.A04.1.454.CMB.1.raw
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccagtgagggctacgagtgggagctacgactttgactacgtggggccagggaaccctggtcaccgtctcctcacgtccctccacgaacgggcccagttccggtccttcccccgtggccaacccgttcctaccgaagcgacctaccgtcgtggggccacgacggccggccgtgggcctcggtccctgggttaccaaagggtccctacgttcccgacggtgacgtccgtaacgtggacgcgggtactgggaccgaaggtccgacaagtacggcngn

SEQ ID NO: 222164 - DNA, 563 bp, Homo sapiens
  misc_feature: GYAE6OF02I7M3I.38.4.A04.1.454.CMB.1.raw
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacaggtgggagctacgactttgactacgtggggccagggaaccctggtcaccgtctcctcacgccctccaccgacgggcccagtccggtccttcccccgtcggccaccctcctaccaacgacgccaccctcgtcgggggccacgacgccggcccgtggggcctcggccgtggtccgaacggtacctaccttccgacgttcgactcgacgtcggacggcgggcgtgggcgaacgggcgcataggnngn

SEQ ID NO: 222165 - DNA, 550 bp, Homo sapiens
  misc_feature: GYAE6OF02JCJXC.38.4.A04.1.454.CMB.1.raw
  modified_base (327)..(327): a, c, t, g, unknown or other
  misc_feature (327)..(327): n is a, c, g, or t
  modified_base (548)..(549): a, c, t, g, unknown or other
  misc_feature (548)..(549): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgcccccatggagggctacagtgggganctacgactttgactacgtggggccagggaaccctggtcaccgtctcctcagcctccacgacggcccatcgtccttcccctggccaccctcctccaacgacgccacctcgtcgggggccacgacgccggcccgtgggcctgcccgtgggtaccaacggtcctaccgttccgacgtgactcgacgtcggacggcggggctcgggacgaaggccgacagtacgnnc

SEQ ID NO: 222166 - DNA, 540 bp, Homo sapiens
  misc_feature: GYAE6OF02G2LKI.38.4.A04.1.454.CMB.1.raw
  modified_base (538)..(540): a, c, t, g, unknown or other
  misc_feature (538)..(540): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactacgtggggccagggaaccctggtcaccgtctcctcacgcctccaccagggcccatccggtccttccccctggccaccctcctccaacgacgccaccctcgtcgggggccacgacgccggcccgtgggcctcggcccttgggtccaacggacctacttccacgtgactcgactggacggcgggctggcagggcgcagtagnnn

SEQ ID NO: 222167 - DNA, 640 bp, Homo sapiens
  misc_feature: GYAE6OF02II9FA.38.4.A04.1.454.CMB.1.raw
  modified_base (329)..(329): a, c, t, g, unknown or other
  misc_feature (329)..(329): n is a, c, g, or t
  modified_base (637)..(638): a, c, t, g, unknown or other
  misc_feature (637)..(638): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccattcgccatctccagagacaacgccaagaactcactgtggctgcacatgaacggctgagaggcgacgacacggctgtgtacttctgtgcgagacgcccccatgagggctacgaggtggganctacgactttgactacgtggggaccagggaaccctggtacacccgttctcctacacggcccctacccgaacccgaacgggcccctacgttcccggtccctttccccccgtcgggccctacccctccctacccgaaacggacgacctacccgtccgtacggggggccaaccgacggcccgggtccccgtcggggtaccgttcggcccgtcgggtaccgaaacgggtaccttacgttacccgtacgtcgtacgttacggaccgtcggacggccggggtcgttacgggaccgaacgggcgacgagtacgcnncg

SEQ ID NO: 222168 - DNA, 521 bp, Homo sapiens
  misc_feature: GYAE6OF02IIBOW.38.4.A04.1.454.CMB.1.raw
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtgctgcacatgaacggcctgagaggcgacgacacggctgtgtacttctgtgcgagagcccccatgagggctacagtggganctagacttttggactacnggggccagggaaccctggtcaaccgtctcctcagcctccacaggccatcggtctcccctggcacctcctccaagacgcacctcgtcgggggcacgagccggccgtcgggctcgacctggtcgaaacggactactccaacgtcgatcgactggagcgggctggcgaaggcgcaacgtnagngn

SEQ ID NO: 222169 - DNA, 563 bp, Homo sapiens
  misc_feature: GYAE6OF02IPZ9N.38.4.A04.1.454.CMB.1.raw
  modified_base (560)..(561): a, c, t, g, unknown or other
  misc_feature (560)..(561): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgaggtgggagctacgtactttgactacgtggggccagggaaccctggtcaccgtctcctcacgccctccaaccgaacgggcccactccggtccttcccccgtcggcccaccctcctaccaacgacgccacctcgtcggggcacgacgccggcccgtgggcctcgccgtggtacaacggtactaccgttccacgtgactcggacgtggacggcgggctgggacgaacgggcgcgagtaggcnncg

SEQ ID NO: 222170 - DNA, 571 bp, Homo sapiens
  misc_feature: GYAE6OF02IS1DT.38.4.A04.1.454.CMB.1.raw
  modified_base (301)..(301): a, c, t, g, unknown or other
  misc_feature (301)..(301): n is a, c, g, or t
  modified_base (412)..(412): a, c, t, g, unknown or other
  misc_feature (412)..(412): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacncccccatgagggctacgagtgggagctacgactttgactacgtggggccagggaaccctggccaccgtctctcacgcctccaccgaggcccatccggtcctccccctgccnccctcctccaacgagccaccgttcgtcggggccacgacgccggccctgggcctcggcccgtgggtaccaaacgggtccctacgttcccacgtcgacttccggaaccttgggacggcgggtacctgggaccgaagggccgtacgacgtaacggntacgng

SEQ ID NO: 222171 - DNA, 566 bp, Homo sapiens
  misc_feature: GYAE6OF02FJDGJ.38.4.A04.1.454.CMB.1.raw
  modified_base (564)..(566): a, c, t, g, unknown or other
  misc_feature (564)..(566): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagagccccactgagggctacgagtgggagctacgacttttgactactgggggccaggggaacccctggtccaccgtctcctcagccctccaccaacgggcccatcggtccttccccctcggccacccctccctcccaacgacgccaccctccgtcgggggccacgacgccgggcccgtggggcctcggcccgttcgggtccgaaacgggacctaacttccacgtcgactcgacgtggacggccggggtcgtcggcgaagggccgacagtagnnn

SEQ ID NO: 222172 - DNA, 598 bp, Homo sapiens
  misc_feature: GYAE6OF02GA1ZZ.38.4.A04.1.454.CMB.1.raw
  modified_base (333)..(333): a, c, t, g, unknown or other
  misc_feature (333)..(333): n is a, c, g, or t
  modified_base (597)..(598): a, c, t, g, unknown or other
  misc_feature (597)..(598): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaaatactatgtggactctgtgaagggccgattcgccatctccagagacaacgccaagaactcactgtggctgcacatgaacggcctgagaggcgacgacacggctggtgtacttctgtgcgagacgcccccatggacgggctacgaggtgggganctacgtactttgactacgtcgggggaccacggggaaccctgggtacctacccggtcctcctcacgccctcccaaccgacgggcccagtccggttcccttcccccgtcggccacccctcctacccaacgacgcctaccgtcgtcggggccacgacggccggcccgtcgggctccggccgtcggtaccgaacgggtacctacgttcccgacgtgactccgacgtcggacggtccgggcgttcggacgaacggccggacagtagcgnn

SEQ ID NO: 222173 - DNA, 647 bp, Homo sapiens
  misc_feature: GYAE6OF02IC1R4.38.4.A04.1.454.CMB.1.raw
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccaggcattaacccaagatggacgtcgaaaaaatactatgtggactctggtgaagggccgattcgccatctccagagacaacgccaagaactcactgtggctgcacatgaacggcctgagaggcgacgacacggctgtgtactctgtgcgagacggcccccatggacgggctaaccgaggtggggagcgtacgtacttttggaacctcggttaggggccaacggggaaacccgtgggtacctaccggtccttcctccgacggtccctccccgaaccgaacgggccccgtagtcccggtccttccccccgtcggccctaccccgtcctacccaacggacgcctacccgtcgtcggggccacgacgccggccccggtgggcctcggcccgttgggtccgaaacgggttaccttacccgttcccgacgtccggtataccggtacctgggacggtcccggggacttccggggacgtaacgggccgcgtaagtaggccgntn

SEQ ID NO: 222174 - DNA, 559 bp, Homo sapiens
  misc_feature: GYAE6OF02JMS7Z.38.4.A04.1.454.CMB.1.raw
  modified_base (194)..(194): a, c, t, g, unknown or other
  misc_feature (194)..(194): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
tcagtcgatcacgtcacgaccggtgctcgatttagagtagtgatcaggggggtcccgtgagactctcctgtgcagcctctgcattcacctttagtaactatttaatgagctggtccgccagcctccagggaaggggctgggagtgggtggccaggcattaaccaagatggacgtgaaaaatactatgtggactntgtgaagggccattcgccatctccagagacaacgccaagaactcactgtggctgcacatgaacggctagagaggcgacgacacggctgtgtacttctgtgcgagcgcccccacgtggagggctacgagtgggagctagactttgactctaggggccagggaaccctggacctaccggtctcctcacggcccttaccacgaacgggcccagtccgtccttcccccnggaccnccctcnccaaggcnccacctgcgggnacngccggcctgggctcggcctgggtacaacgtccgtaacttcccgagtcgaccgtcgaccgtggacggccgggtacttcgggcaacgggtcaccgtaagcggacngn

SEQ ID NO: 222175 - DNA, 575 bp, Homo sapiens
  misc_feature: GYAE6OF02HL3CZ.38.4.A04.1.454.CMB.1.raw
  modified_base (573)..(573): a, c, t, g, unknown or other
  misc_feature (573)..(573): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgcccccatggagggctacgagtgggagctacgactttgactacgtgggccacgggaaccctggtcaccgtctcctcacgccctaccgaccgaacgggcccagtccggtccttccccccgtggtcccacccctccctaccgaacgacgcctacccgtcggtcggggccacgacggccggcccgtggggcctggccgtggtaccaacgggtacctaccgttccgacgtgactcgacgtggacggcgggtctgggaccgaagggccgactagtagcngc

SEQ ID NO: 222176 - DNA, 696 bp, Homo sapiens
  misc_feature: GYAE6OF02J0ZAU.38.4.A04.1.454.CMB.1.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
tcagtcgatcacgtcacgaccggtgctcgatttagagtagtgatcaggggggtcccgtgagactctcctgtgcagcctctgcattcacctttagtaactatttaatgagctgggtccgccagcctccagggaagggctggagtgggtggccagcattaaccagatggacgtagaaaaatctatgtggactctgtgaaggccattcgcatcncagagacacgcaagactcactgtgctgcacntgaacgctgagaggcgacgacacggctggtagtacttcgtggtagcgagacgcccccgacgtggagggtcctacgagggttcgggacgcgttaacggtacttttggaaccttacggtcggggggacccaaggggtaaccccttgggtccaaccgttccgtcctcgaccggtccctaccgaccgaaacgggcccctaaggtcccggtttccctttcccccgacggaccctaccccgttacccgtaccgaaacgtccgaccctacccgttcggtcgggggaccctaaccgacgggcccgggtacccgtccgggtccttccggacccgttcgggtaaccaaacgggtccctttaaccggttaccccgtaccggtagcccgttacggtaccgtcgggaacggtcccgggtcgttacggggacctaacggggtccgaaccttaacggcggtactgaccg

SEQ ID NO: 222177 - DNA, 563 bp, Homo sapiens
  misc_feature: GYAE6OF02H6J4Y.38.4.A04.1.454.CMB.1.raw
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
  modified_base (554)..(554): a, c, t, g, unknown or other
  misc_feature (554)..(554): n is a, c, g, or t
  modified_base (563)..(563): a, c, t, g, unknown or other
  misc_feature (563)..(563): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtgccagcattaaccaagatggacgtgaaaaatctatgtggactctgtgaaggccgattcgccatctcagagacaacgccaagactcactgtggctgcacatgaacggctgagaggcgacgacacggtctgtgtaccttctgtgcgagacnccccctatgagggctacaggtggganctacgactttgactacgnggggccagggaaccctggtcaccgtctcctcacgccctaccaccgaacgggcccagtccggtcctttcccccgnggcctaccccgtcctaccgaaggacncctaacccgtcgtacgggggccaacgacgcccggacccgtcggggcctacggcccgttggaccgaaacggtaccttactcccgagtcgactcgtactggacgcggctggcaggcncagtagcan

SEQ ID NO: 222178 - DNA, 539 bp, Homo sapiens
  misc_feature: GYAE6OF02FVW7Z.38.4.A04.1.454.CMB.1.raw
  modified_base (323)..(323): a, c, t, g, unknown or other
  misc_feature (323)..(323): n is a, c, g, or t
  modified_base (537)..(539): a, c, t, g, unknown or other
  misc_feature (537)..(539): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagactcactgtggctgcacatgaacggcctgagaggcgacgacacggctgtgtacttctgtgcgagacgcccccatgagggctacagtggganctacgactttgactacgtggggccagggaaccctggtcaccgtctcctcacgcctccaccgacgggcccacgtccggtccttccccctggccaccctcctaccaagcgccacctccgtggggccacgagccggcccgtgggcctcgcctgggtaccaacggacctacttccacgttgacgtcgacgtgacgcgggctggacaggcgacatacgnnn

SEQ ID NO: 222179 - DNA, 600 bp, Homo sapiens
  misc_feature: GYAE6OF02FTTGK.38.4.A04.1.454.CMB.1.raw
  modified_base (599)..(600): a, c, t, g, unknown or other
  misc_feature (599)..(600): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccaggggaaccctggtccaccgtctcctcacgccctcccaaccgaacgggcccacgtccggtcccttcccccgtggccacccctcctacccaacgacgccaccgtcgtcggggccagtacgccggtcccgtgggcctcggcccgttgggtaccgaaacggtaccttaaccgttcccgaacggttcgacgttccggacgtcgggacggccggggtaccgtcgggaccgaacgggccggtacgaagtaggann

SEQ ID NO: 222180 - DNA, 575 bp, Homo sapiens
  misc_feature: GYAE6OF02II48I.38.4.A04.1.454.CMB.1.raw
  modified_base (573)..(575): a, c, t, g, unknown or other
  misc_feature (573)..(575): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctggtgtacttctgtgcgagagcccccactgagggctacagtgggagctacgactttgactacgtggggccagggaccctggcaccgtctcctcagccctccaccaagggcccagtccggtccttcccccgtggcctaccctccctaccaacgacgccaaccctcgtcgggggccacgacgccgggcccctggggccttgcccgtgggtaccaaacgggtacctaccgttcccaacgttcgacttccggacctcggaacggccggggacttcgggccaacgggccgacagtagnnn

SEQ ID NO: 222181 - DNA, 531 bp, Homo sapiens
  misc_feature: GYAE6OF02GY1G6.38.4.A04.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (316)..(316): a, c, t, g, unknown or other
  misc_feature (316)..(316): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
  modified_base (528)..(530): a, c, t, g, unknown or other
  misc_feature (528)..(530): n is a, c, g, or t
tcagtcgatcacgtcacgaccggtgctcgatttagagtagtgatcagggggggtccctgagactctcctgtgcagcctctgcatttcacctttagtaactatttaatgagctgggtccgccagcctccagggaaggggctggagtgggtggccagcattaaccaagattggacgtgaaaaatctatgtggactntgtgaagggccattcgccatctccaganacaacgccaagactcactgtgctgcacatgaacggcctgagaggcgacgacacggctgtgtacttctgtgcgagacgccccatgagggctacgngtgggagctacgctttgactacgtgggccagggaccctggtcaccgtctcctnacgcctccaccgaacgggcccatccggtccttccccctggcccacccgtccccaagacnccacctcgtacggggcaccgacgccggcccgtgggccgtgccgtggtcgaacggactacctccgacgtgatcgactgagcgggcnggacaggcncgatgnnnc

SEQ ID NO: 222182 - DNA, 588 bp, Homo sapiens
  misc_feature: GYAE6OF02ING04.38.4.A04.1.454.CMB.1.raw
  modified_base (586)..(587): a, c, t, g, unknown or other
  misc_feature (586)..(587): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaaccaagatggacgtgaaaaatactatgtggactctgtgaagggccattcgccatctccagagacaacgccaagaactcactgtggctgcacatgaacggcctgagaggcgacgacacggctgtgtacttctgtgcgagacgcccccatggagggctacaggtgggagctacgactttgactacgtggggccagggaaccctggtcaccgtctcctcacgccctccaaccgaacggggcccacgtccggtcccttccccccgtggccctacccctccctccaaacgacgcctaccctcgtcgggggccacgacggccggcccgtgggcctcggccctgggtaccaaacgggtaccttaccgttcccgaacgttcgacttccggacgttggacggccggggctcggaccgaagggccgacgagtggnnc

SEQ ID NO: 222183 - DNA, 600 bp, Homo sapiens
  misc_feature: GYAE6OF02HEKGC.38.4.A04.1.454.CMB.1.raw
  modified_base (318)..(318): a, c, t, g, unknown or other
  misc_feature (318)..(318): n is a, c, g, or t
  modified_base (598)..(598): a, c, t, g, unknown or other
  misc_feature (598)..(598): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtgctgcacatgaacggcctgagaggcgacgacacggctgtgtacttctgtgcgagacgcccccatgagggctacgngtgggagctacgactttgactacgtggggccacgggaaccctggtccaccgtctcctcacgcctccaccgaacgggcccacgtccggtccttcccccgtggcccaccctcctcccaagacgccaccgtcgtcgggggcacgacggccgggcccgtcggggccttcggcccgttcgggtaccgaaacgggtaccttaaccgttcccgaaccggttcgacgttccggaccgtggacggtccgggggcgttacgggaccgtaacgggccgtacgacgtagcgncg

SEQ ID NO: 222184 - DNA, 587 bp, Homo sapiens
  misc_feature: GYAE6OF02I1H6N.38.4.A04.1.454.CMB.1.raw
  modified_base (328)..(328): a, c, t, g, unknown or other
  misc_feature (328)..(328): n is a, c, g, or t
  modified_base (380)..(380): a, c, t, g, unknown or other
  misc_feature (380)..(380): n is a, c, g, or t
  modified_base (563)..(563): a, c, t, g, unknown or other
  misc_feature (563)..(563): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctcagagacaacgccaagactcactgtggctgcacatgaacggcctgagaggcgacgacacggctgtgtacttctgtgcgagacgcccccatggacgggctacgaggtggganctacgacttgactacgtggggccaacgggacctggtccaccgtctcctcacncctccaccgaacgggcccacgtccggtccttcccccgtcggccctacccctcctaccaacgacgccctaaccgtccggtcgggggaccaccgacggcccgggtacccgtggggcctcggcccgttgggtaccgaacggtacctaccgttccgacgtcgactcggacgtcggacggcgggtcgnggaccgacggcgtacaggtcngnn

SEQ ID NO: 222185 - DNA, 602 bp, Homo sapiens
  misc_feature: GYAE6OF02F3UTC.38.4.A04.1.454.CMB.1.raw
  modified_base (598)..(599): a, c, t, g, unknown or other
  misc_feature (598)..(599): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggagcgtacgactttgactacgtggggccagggaaccctggtcaccgtctcctcacgcctccaccgaacgggcccagtccggtccttcccccgtcggccctacccctccctacccgaacgacgcctaccgtcgtcgggggccacgacggccggcccgtcgggcctcggcccgttcgggtaccgaacgggtacccttaccgttcccgacggtcgtacgtccggacgttcgggacggccggggtccgtacgggacgaacgggccgacgagtacgnngcg

SEQ ID NO: 222186 - DNA, 599 bp, Homo sapiens
  misc_feature: GYAE6OF02IR2DC.38.4.A04.1.454.CMB.1.raw
  modified_base (357)..(357): a, c, t, g, unknown or other
  misc_feature (357)..(357): n is a, c, g, or t
  modified_base (384)..(384): a, c, t, g, unknown or other
  misc_feature (384)..(384): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
  modified_base (597)..(597): a, c, t, g, unknown or other
  misc_feature (597)..(597): n is a, c, g, or t
tcagtcgatcacgtcacgaccggtgctcgatttagagtagtgatcaggggggtccctgagactctcctgtgcagcctctgcattcaccgtttagtaactatttaatgagcgtgggtccgccgtaggcctcgagggaaggggctggacgtgggtggccaggcattaaccgagatggacgtgaaaaatctatcgtggactctgtgaacgggccgattcgccatctccgagagacaacgccaagtactcactgtggctagcatatgaacggcctgagaggcgacgacacggtctgtgtacttctgtgacgagacgcccccatgagggctacaggtcgggagcgtacgactttgaactcgnggggccagggaacctggcacgtctctnacgtccctcgaaccaaggggcccacgttcgggtcctttcccccgaggcccaacccgtctacccgaaagcgtccaacctcggtaggggccacgacgccgggccgttagggcctgaccgtcggtacgaacgtcctacgttaccgacgtactntacccggtancggacggtccggggtcctagggaccgtaacgggccggaccgttaagtacggcngc

SEQ ID NO: 222187 - DNA, 551 bp, Homo sapiens
  misc_feature: GYAE6OF02HEXWW.38.4.A04.1.454.CMB.1.raw
  modified_base (313)..(313): a, c, t, g, unknown or other
  misc_feature (313)..(313): n is a, c, g, or t
  modified_base (548)..(551): a, c, t, g, unknown or other
  misc_feature (548)..(551): n is a, c, g, or t
tcagtcgatcacgtcacgaccggtgctcgatttagagtagtgatcagggggggtccctgagactctcctgtgcagcctctgcatttacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccataaggngggctacaggtgggagctacgactttgactactggggccagggaccctggtcaccgtctcctcacgccctaccaccgaagggccccacgtccggtccttccccctcgggcctacccctcctccaacgacgccacctcgtcgggggccacgagccggcccgtcgggctcgcccgtggtcaacggactaccgttccacgtgactcgactggacgcgggctggacaggcgcgagtagnnnn

SEQ ID NO: 222188 - DNA, 591 bp, Homo sapiens
  misc_feature: GYAE6OF02FF86E.38.4.A04.1.454.CMB.1.raw
  modified_base (589)..(590): a, c, t, g, unknown or other
  misc_feature (589)..(590): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacgaggtgggagctacgacttttgactacgtggggcaggggaaccctggtccaccgtctccctcacgccctccaccgaacggggcccagtccggtccttcccccgtcggccacccctccctacccaacgacgccgtacctcgtcgggggccacgacgccgggcccgtcgggcctcggccgttggtacgaaacgggtaccttaaccgttccgacggttcgacgtcgacgtggacggccggggccgtagggaccgaacgggcgacgtacgtaggcnnc

SEQ ID NO: 222189 - DNA, 567 bp, Homo sapiens
  misc_feature: GYAE6OF02GADTF.38.4.A04.1.454.CMB.1.raw
  modified_base (565)..(566): a, c, t, g, unknown or other
  misc_feature (565)..(566): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagcgcccccatggagggctacgagtgggagctacgactttgactacgtggggccacgggaccctggtcaccgtctcctcacgccctccaccgaacgggcccacgtccggtccttcccccgtcggccctacccctcctacccgaacgacgccaccgtcgtcgggggccacgacgccggcccgtcgggctcgccgtgggtccgaaacggtacctacttccgacgtgactcgacgtcggacggcgggcgtcggcgaacggcggaccatagnnc

SEQ ID NO: 222190 - DNA, 509 bp, Homo sapiens
  misc_feature: GYAE6OF02HV4VE.38.4.A04.1.454.CMB.1.raw
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (506)..(507): a, c, t, g, unknown or other
  misc_feature (506)..(507): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgccccatgagggctacagtgggagctacgctttgactacgtggggccagggaacctggtcaccgtctcctcagccctcaccaggccatcgtctcccngcncctcncagncncctcgtgggcacgacgccgcctggctgcctggtacaacgcctacttccgagtgatcgacgtgacggcgggctcggacgaacggcgaccgataggnncg

SEQ ID NO: 222191 - DNA, 597 bp, Homo sapiens
  misc_feature: GYAE6OF02IONMB.38.4.A04.1.454.CMB.1.raw
  modified_base (331)..(331): a, c, t, g, unknown or other
  misc_feature (331)..(331): n is a, c, g, or t
  modified_base (595)..(595): a, c, t, g, unknown or other
  misc_feature (595)..(595): n is a, c, g, or t
tcagtcgatcacgtcacgaccggtgctcgatttagagtagtgatcagggggggtcccgtgagactctcctgtgcagcctctgcattcacctttagtaactatttaatgagctgggtccgccagcctccgagggaaggggctggagtgggtggccagcattaaccagatggacgtagaaaaatctatgtggactctgtgaagggcctattcgccatctccagagacaacgccaagactcactgtgctgcacatgaacggcctgagacggcgacgacacggctgtgtaccttctgtgcgagacgcccccagtggagggctacgaggtgggacnctacggtactttggaacctacgtggggcccagggaaccctgggtccaccgtctccgtccacgtccctccaccacgggcccagtccgtccttcccccgtggccacccgtccctaccgaacgtacgcctaaccgtccgtcggggacctacgacgcccggaccctgggccttcggacccgttcgggtaccaacgggtaccttaccgtccgacgtgacgttccgacgtcggacggcgggtactcggacgacggccgacacgtagtcancg

SEQ ID NO: 222192 - DNA, 579 bp, Homo sapiens
  misc_feature: GYAE6OF02H67GU.38.4.A04.1.454.CMB.1.raw
  modified_base (578)..(579): a, c, t, g, unknown or other
  misc_feature (578)..(579): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtgctgcacatgaacggcctgagaggcgacgacacggctgtgtacttctgtgcggagacgccccccatgagggctacgaggtgggagtctacgactttgactacgtggggccagggacccgtggtcaccgtctcctcacgccctccaccaacgggccccagtccggttcccttcccccgtcggccctaccctccctacccaagacgccacctccgtcgggggccacgacggccggcccgtcggggcctcggcccgtgggtaccaaacggtacctacgttcccgacgtgtacgtccgtacgtcgacggcgggcgttacgggcgagggccgcagtagcnn

SEQ ID NO: 222193 - DNA, 550 bp, Homo sapiens
  misc_feature: GYAE6OF02ISDSV.38.4.A04.1.454.CMB.1.raw
  modified_base (378)..(378): a, c, t, g, unknown or other
  misc_feature (378)..(378): n is a, c, g, or t
  modified_base (548)..(550): a, c, t, g, unknown or other
  misc_feature (548)..(550): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctggtgcgagacgcccccatggagggctacgaggtgggagctacgactttgactacgtggggccagggaccctggtcaccgtctccncacgcctccaaccaacgggcccacgttccggtcccttcccccgtgggcccaccctccctccaacgcgccacctcgtcggggcacgacgccggccctgggctcgcctggtcaaggtactacttaccgacgtgactcgacgtggacgcgggctggacgaaggcgacagtagnnn

SEQ ID NO: 222194 - DNA, 523 bp, Homo sapiens
  misc_feature: GYAE6OF02JES76.38.4.A04.1.454.CMB.1.raw
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (520)..(521): a, c, t, g, unknown or other
  misc_feature (520)..(521): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctcagagacaacgccaagactcactgtgctgcacatgaacggcctgagaggcgacgacacggctgtgtacttctggtgcgagacgcccccatcggaggctacagtgggagctacgactttgactacgtggggccagggaaccctggtccaccgtctcctnacgcctccacacggccatcgtctcccctgccncctctcacngcactcgtgggcacgacgcggcccgtggctcgtccgtggcgaacgctacttccacgtcgactcgacgtcggacgcgggtacgtcggtcgaacggcgccgagacgtnncg

SEQ ID NO: 222195 - DNA, 647 bp, Homo sapiens
  misc_feature: GYAE6OF02HZMUV.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgaggtgggagctacgactttgactacgtggggccagggaaccctggtccaccgtctcctcacgccctccgaccgaacgggccctacgtcccggttccctttccccccgtcggtccctaccccttccctacccgtaaacggacgaccgtacccgttccggtcgggggaccaaccgacggcccgggtccccggtcggggtccttccggtccccgttcgggtacccgtaaacgggtacccgttaaccgttccccgtaacggtacgtacgttaccggtaaccgtgggtaaccggtccggggctacgggacgaacgggccgacgtacgtagctgcg

SEQ ID NO: 222196 - DNA, 603 bp, Homo sapiens
  misc_feature: GYAE6OF02G2Y5T.38.4.A04.1.454.CMB.1.raw
  modified_base (603)..(603): a, c, t, g, unknown or other
  misc_feature (603)..(603): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcaattaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagacgcccccagtgagggctacgaggtgggagctaacgactttgaactacgtggggccagggaaccctggtccaccggtctcctcacgccctccaaccgaacgggcccacgtccggttccttccccccgtggccctaccccgtcctaccgaaagacgaccaccgtcggtcggggaccaacgacggccggcccgtgggcctcggccgttcggtaccaaacggtacctaccgttacccgacgtacgacgtccgaacgtcggacggccgggtcgtacgggaccgaacgggccgacgagtacgcgagn

SEQ ID NO: 222197 - DNA, 573 bp, Homo sapiens
  misc_feature: GYAE6OF02HAVSA.38.4.A04.1.454.CMB.1.raw
  modified_base (378)..(378): a, c, t, g, unknown or other
  misc_feature (378)..(378): n is a, c, g, or t
  modified_base (564)..(564): a, c, t, g, unknown or other
  misc_feature (564)..(564): n is a, c, g, or t
  modified_base (570)..(571): a, c, t, g, unknown or other
  misc_feature (570)..(571): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggagctacgactttgactacgtggggccagggaaccctggtccaccgtctccncacgcctccacgacgggcccagtccggtcccttcccccgtggccctaccctccctaccgaacgcgccacccgtcgtcggggcacgacggccggcccgtgggcctcggccgtcgggtaccaacgggtaccttaccgttccgacgtgactccgacgtggacggtcgggcgtgggaccgaagggccganagtagnncg

SEQ ID NO: 222198 - DNA, 584 bp, Homo sapiens
  misc_feature: GYAE6OF02ITD08.38.4.A04.1.454.CMB.1.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (583)..(584): a, c, t, g, unknown or other
  misc_feature (583)..(584): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgacgagacgcccccatgagggctacgagtggganctacgacttttgacttacgnggggccagggaccctgggtcaccggtctccctcacgtccctaccgaccgaacgggcccagtccggtccttcccccctaggccctacccgtccctccaagacgcctaccctcggtcggggaccacgacggcccgggtccctgggccttcggtcgtaacgggttcaacgggtacccttacgttcccgagttcgattcggactcggagccgggtctggcgaacggcgtacagtacggcnn

SEQ ID NO: 222199 - DNA, 665 bp, Homo sapiens
  misc_feature: GYAE6OF02GYVKG.38.4.A04.1.454.CMB.1.raw
  modified_base (662)..(662): a, c, t, g, unknown or other
  misc_feature (662)..(662): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaaggccgattcgcatctcagagacaacgccaagaactcactgtgctgcacatgaacgctgagaggcgacgacacggctgtgtacttctgtgcgagacgcccccagtggacgggctacgaggtgggagtccgtaacggtacttttggaaccttacggtcgggggaccaacggggtaaccctggtaccacccggttcctccctcacgccctaccaaccgaacgggccctacgttccggtccctttcccccgcggccctaccccgtccctacccgaaacgccgaccctaacccgtcggtcgggggacctaacggacggtcccgggcccgttgggcccgttcggtcccgtagggtacccgaacgggtaacccttaccttacccgacgttagaccgttcggaacgttcgggaacggtccggggtacgttacgggaccgtaaacggggccgtaacgtacgtaaggtcgngac

SEQ ID NO: 222200 - DNA, 554 bp, Homo sapiens
  misc_feature: GYAE6OF02IH2NE.38.4.A04.1.454.CMB.1.raw
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgtactttgactacgtggggccagggaaccctggtcaccgtctcctcacgccctccaccgaacgggcccagtccggtccttcccccgtggccctaccctcctccaagcgccacctccgtggggccacgcggccggcccgtgggctcgccgtggaccgaacggtcctacgtccgacgtgactccgacgtggacggcggtctcggacgaggccgacagtagnang

SEQ ID NO: 222201 - DNA, 559 bp, Homo sapiens
  misc_feature: GYAE6OF02GVM9U.38.4.A04.1.454.CMB.1.raw
  modified_base (556)..(558): a, c, t, g, unknown or other
  misc_feature (556)..(558): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacaggtgggagctacgactttgactacgtggggccagggaaccctggtcaccgtctcctcacgccctccaccgacgggcccagtccggtccttcccccgtggcccaccctcctccaacggacgccaccgtcgtcggggcacgacggccgcccgtgggcctcggccgtggtaccaagggtactaccgttccgacgtgactcgactggacggcgggcgttcggacgaacggcgacgagtacgnnng

SEQ ID NO: 222202 - DNA, 569 bp, Homo sapiens
  misc_feature: GYAE6OF02HZGKO.38.4.A04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (447)..(447): a, c, t, g, unknown or other
  misc_feature (447)..(447): n is a, c, g, or t
  modified_base (567)..(569): a, c, t, g, unknown or other
  misc_feature (567)..(569): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtggtgccagcaattaaccaagatggacgtagaaaaaatctatgtggactctgngaaggccattcgccatctcagagacaacgccaagaactnactgtggctgcanatgaacggctgagaggcgacgacacggctgtgtacttctgtgcgagacgcccccatggaggctacaggtgggagctacgactttgactacgtggggaccagggaaccctggtcaaccgtctcctcacgccctcaccgaacgggcccagtccggtcccttccccctcggcctaccctcctaccgaagacgccaaccttcgnggggccacgagccggtccgtcgggctcgccgtggtaccaaacgggtaccttacgtccctacgtacgactccggtacgtggaacggccgggtacctagggccaagggcccgagtaagacgnnn

SEQ ID NO: 222203 - DNA, 563 bp, Homo sapiens
  misc_feature: GYAE6OF02H9OLB.38.4.A04.1.454.CMB.1.raw
  modified_base (327)..(327): a, c, t, g, unknown or other
  misc_feature (327)..(327): n is a, c, g, or t
  modified_base (555)..(557): a, c, t, g, unknown or other
  misc_feature (555)..(557): n is a, c, g, or t
  modified_base (559)..(563): a, c, t, g, unknown or other
  misc_feature (559)..(563): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctcngactactggggccacggaaccctggtcaccgtctcctcagcctccaccaagggcccagtcggtccttcccctggccaccctcctccaacgacgccacctcgtcggggcaaccgacgccggcccgtgggcctcggcccgttgggtaccaacgggtacctaccgtttcccgaacggttcgaagtccgtaacgttgacggcgggccgttcgggcaacgggcgacacgtagnnngnnnnn

SEQ ID NO: 222204 - DNA, 557 bp, Homo sapiens
  misc_feature: GYAE6OF02HULUC.38.4.A04.1.454.CMB.1.raw
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (452)..(452): a, c, t, g, unknown or other
  misc_feature (452)..(452): n is a, c, g, or t
  modified_base (556)..(557): a, c, t, g, unknown or other
  misc_feature (556)..(557): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaaatactatgtggactctgtgaagggccgattcgccatctccagagacaacgccaagaactcactgtgctgcacatgaacggcctgagaggcgacgacacggctgtgtacttcgtgtgcggagacgcccccactgagggctacgngtgggancgtacgactttgactacgtggggccagggtaccctggtcaccgtctcctcagcctccaccgaacgggcccacgtccggtcctttcccccgcggtccaccctccctacccaagacgccacctcgnggggccacgacgccggcccgtgggcctgcctgggtcaacggactacttccgacgtgagttccgacgtggacggcgggcctggcgaacggcgaccgtagtagcgnn

SEQ ID NO: 222205 - DNA, 528 bp, Homo sapiens
  misc_feature: GYAE6OF02GPEHR.38.4.A04.1.454.CMB.1.raw
  modified_base (526)..(528): a, c, t, g, unknown or other
  misc_feature (526)..(528): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactactggggccagggaaccctggtcaccgtctcctcagcctccaccaaggcccatcggtcttcccctcggccaccctcctccaagacgcacctcgtcggggcacgacggcggcccgtgggctcggcctggtcaacggactaccttccgacgtgactcgactggaggcgggcgtggcgaacggcgcatagnnn

SEQ ID NO: 222206 - DNA, 579 bp, Homo sapiens
  misc_feature: GYAE6OF02HG12D.38.4.A04.1.454.CMB.1.raw
  modified_base (577)..(579): a, c, t, g, unknown or other
  misc_feature (577)..(579): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggagctacgtacttgactacgtggggccacgggaaccctggtccaccgtctcctcacgccctccaccgacggccctacgtccggtcccttcccccgtcggcccaccctccctaccaacgaccgcctaccgtcggtcggggaccacgacggccgggcccgtcgggcctcgccgttacggtaccgaacggtacctaccgtccgacgtcgacgtcgacgtggacggccgggctcgggacgacggcacgagtaggnnn

SEQ ID NO: 222207 - DNA, 574 bp, Homo sapiens
  misc_feature: GYAE6OF02HANHO.38.4.A04.1.454.CMB.1.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (569)..(570): a, c, t, g, unknown or other
  misc_feature (569)..(570): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttcngtgcgagacgcccccactgacgggctacagtggganctacgactttgactacgtggggcagggaccctggtccaccgtctcctcacgccctaccgaccgaacgggccccagtccggtccttcccccgtgggcccaccctccgtccaacgacgccacccgttcgtggggccacgacgccgggccctgggcctcgccgtggtacaacgggtaccttacgttcccgacgtgacttcggacgtcggacggcgggtcgtacggacggaaggccgagtagtacgnngacg

SEQ ID NO: 222208 - DNA, 584 bp, Homo sapiens
  misc_feature: GYAE6OF02F1A5A.38.4.A04.1.454.CMB.1.raw
  modified_base (325)..(325): a, c, t, g, unknown or other
  misc_feature (325)..(325): n is a, c, g, or t
  modified_base (581)..(582): a, c, t, g, unknown or other
  misc_feature (581)..(582): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtgctgcacatgaacggcctgagaggcgacgacacggctgtgtacttctgtgcgagacgcccccatgaggctacaggtggganctacgactttgactacgtggggccagggaaccctggtcaccgtctcctcgacgccctaccaaccgaacgggcccagtccgggtaccttcccccgtggcccacccctcctccaagacgccaccgtcgtcggggccacgacgccggcccgtgggcctcggccgttggtaccgaacgggtaccttacgttccgacgttcgacgttaccgaccgttggacgggccgggtcgtacggaccgaagggtccgacgtagtacgnncg

SEQ ID NO: 222209 - DNA, 839 bp, Homo sapiens
  misc_feature: GYAE6OF02JXDDV.38.4.A04.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (359)..(359): a, c, t, g, unknown or other
  misc_feature (359)..(359): n is a, c, g, or t
  modified_base (593)..(593): a, c, t, g, unknown or other
  misc_feature (593)..(593): n is a, c, g, or t
tcagtcgatcacgtcacgaccggtgctcgatttagagtagtgatcaggggggtcccgtggagacgtctcctgtgcagcctctgcattcacctttagtaactatttaatgtagctggtccgccagcctccagggaaggggctgggagtgggtggccagcattaaccagatggacgtgaaaatctatgtggactntgngtaagggccgattcgccatcnccagagacaacgccaagaactcacngtgctgcacatnaacggcctgganacggcacgacgtacggctggtacggtacttctaggtgacgacggacgccccccgtatacgggacgggccgttaacaacgggtggggggtaacnccggttaaccgtagttttaccgggaactttaaccggtcgggggggtacccaacgggggtttaaacccccggtcggggttaacccgtaaccgggttccttcccccgttacgaaccgggtcccctaccccgtaaccgggaaccggggtaccccaaccggttacccgggttaccccgtttcccccggtccgggtaaccccgttaccccgttacccgttaccccaacgggttaacccnccgtaaacccccgttccgggtaacccgggggtcccgaaaccggtacccggaccccgggtcccgtccgggggtaccccgtacccgggttcccgtaccggggtaccccgtaaacgggtacccgttaacccgttacccgggtaacccggtaacgttcccggtacgggtacccgtcggggtaaccggtccgggggtccgtacggtacccgggaccgggtaccgtacccgaagggttacgccggtaatcgg

SEQ ID NO: 222210 - DNA, 496 bp, Homo sapiens
  misc_feature: GYAE6OF02F6YI1.38.4.A04.1.454.CMB.1.raw
  modified_base (323)..(323): a, c, t, g, unknown or other
  misc_feature (323)..(323): n is a, c, g, or t
  modified_base (398)..(398): a, c, t, g, unknown or other
  misc_feature (398)..(398): n is a, c, g, or t
  modified_base (490)..(490): a, c, t, g, unknown or other
  misc_feature (490)..(490): n is a, c, g, or t
  modified_base (494)..(496): a, c, t, g, unknown or other
  misc_feature (494)..(496): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagagcccccatgagggctacagtggganctacgactttgactactggggccagggaaccctggtcaccgtctcctcagcctccacaggcccatcgtctccccngcaccctctccagcgcactcgtggggcacgagccggcctgggctgcctggcaaggctacttccacgtgatcgactgagcgggctggcaggcnatgnnn

SEQ ID NO: 222211 - DNA, 571 bp, Homo sapiens
  misc_feature: GYAE6OF02I2TMI.38.4.A04.1.454.CMB.1.raw
  modified_base (327)..(327): a, c, t, g, unknown or other
  misc_feature (327)..(327): n is a, c, g, or t
  modified_base (569)..(571): a, c, t, g, unknown or other
  misc_feature (569)..(571): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatggagggctacaggtggganctacgactttgactacgtggggccacgggaaccctggtcaccgtctcctcagtcctccgacgacgggcccatccggttccttcccccgtggccctaccctcctacccaacgacgccaaccgtcgtcgggggccaccgacggtcccgggccctgggcctcggcccgttcggtaccgaacggtacctaccttccacgtgacgtcgacctggacggcggggctcggaccgaacgggcacgatagnnn

SEQ ID NO: 222212 - DNA, 582 bp, Homo sapiens
  misc_feature: GYAE6OF02HQ774.38.4.A04.1.454.CMB.1.raw
  modified_base (580)..(582): a, c, t, g, unknown or other
  misc_feature (580)..(582): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagacgcccccatggagggctacgaggtgggagctacgactttgacttacgtggggaccaggggaaccctggtcaccgtctcctcacgccctccaaccgaacgggcccacgtccggtcccttcccccgtcggccctaccctccctaccaacgacgccaccgtcgtcggggccacgacggccggcccgtcgggcctcggccgtcggtaccgaacggtacctaccttccgacgtgacgttccgacgtcggacggcgggcgtacgggacgaacggccgacgagtagnnn

SEQ ID NO: 222213 - DNA, 629 bp, Homo sapiens
  misc_feature: GYAE6OF02HEHBU.38.4.A04.1.454.CMB.1.raw
  modified_base (467)..(467): a, c, t, g, unknown or other
  misc_feature (467)..(467): n is a, c, g, or t
  modified_base (626)..(627): a, c, t, g, unknown or other
  misc_feature (626)..(627): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggccgattcgccatctccagagacaacgccaaagaactcactgtgctgcacatgaacggcctgagaggcgacgacacggctgtgtacttctgtgcgagacgcccccatggacggctacgaggtgggagctacgactttgacttacgcggggaccacgggaaccctggtacctaccgtctaccctcacgtccctacccaccgaacgggccctacgttccggttccccttcccccgtcggccctaccccgtcctacccgaaacggaccncctacccgttccggtcgggggccaacgacggcccgggtcccgtcggggcctcggtcccgttcgggtaaccaacgggtaaccttaccgttaccgacggttcgacgtcggtaccgtggacgggcccgggtcgtacgggaccgaacgggccgactagtacgnngc

SEQ ID NO: 222214 - DNA, 591 bp, Homo sapiens
  misc_feature: GYAE6OF02GZTE9.38.4.A04.1.454.CMB.1.raw
  modified_base (588)..(589): a, c, t, g, unknown or other
  misc_feature (588)..(589): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagaccgcccccagtggacgggctacgaggtgggagtcgtaacgtactttgaccgttacggtcggggaccaacggggtaaccctggtccaccggtctcccgtcacgccctccaaccgacggcccacgtccggtcccttcccccgtcggcccaccctccctaccgaaacgtcgacctacccgtcggtcggggaccacgcggccggccgtggcctcgccgtggtacgaacgtcctacctccgacgtcgtacgtccgacgtggacggcgggtcgtcggacgtaacgggcgaccagtcgnncg

SEQ ID NO: 222215 - DNA, 502 bp, Homo sapiens
  misc_feature: GYAE6OF02I5D48.38.4.A04.1.454.CMB.1.raw
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (466)..(466): a, c, t, g, unknown or other
  misc_feature (466)..(466): n is a, c, g, or t
  modified_base (501)..(502): a, c, t, g, unknown or other
  misc_feature (501)..(502): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggactgaaaaatactatgtggactctgtgaagggccattcgccatctcagagacacgccaagaactcactgtggctgcacatgaacggcctgagaggcgacgacacggctgtgtacttctgtgcgagacgccccatgagggctacagtgggagctacgactttgactacgtggggccagggacctggtcaccgtcncctcacgcctcaccaagggcccatccgtcttccccngcaccctctccaagngccnctcgtggggcacacgcgcctgggctgcctggtcaaggctctcagtgntcgacgtgagcggctggcaacgggcaccagtagcnn

SEQ ID NO: 222216 - DNA, 531 bp, Homo sapiens
  misc_feature: GYAE6OF02GBM0Y.38.4.A04.1.454.CMB.1.raw
  modified_base (529)..(531): a, c, t, g, unknown or other
  misc_feature (529)..(531): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatgagggctacagtgggagctacgactttgactactggggccagggaaccctggtcaccgtctcctcagcctccaccgaagggcccagtcggtccttccccctggccaccctcctccaagacgccacctcgtcgggggcacgacgccggcccgtgggcctgcccgtggtccgaaggtactacttccacgtgatcgacgtgagcgggctggcgaaggcgacatagnnn

SEQ ID NO: 222217 - DNA, 619 bp, Homo sapiens
  misc_feature: GYAE6OF02ILK52.38.4.A04.1.454.CMB.1.raw
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacaggtgggagctacgactttgactacgtggggccagggaaccctggtccaccgtctcctcacgccctccaccgaacgggcccagtccggtccttcccccgtggccaccctcctaccaacgacgcctaccgtcgtcggggccacgacggcccggcccgtgggcctcggcccttgggtacctaaacgggtacccttaccgttcccgaacggttcgacgttccggtaccgtcgggaacggtccggggtaccgttacggggacccgtaaacgggggcccgtaccgtaaggttacggcgagtacg

SEQ ID NO: 222218 - DNA, 630 bp, Homo sapiens
  misc_feature: GYAE6OF02G6TEE.38.4.A04.1.454.CMB.1.raw
  modified_base (627)..(627): a, c, t, g, unknown or other
  misc_feature (627)..(627): n is a, c, g, or t
tcagtcgatcacgtcacgaccggtgctcgatttagagtagtgatcagggggggggtccctgagactctcctgtgcagcctctgcattcacctttagtaactatttaatgacgctgggtccgccagcctccagggaaggggctggagtgggtgccagcattaaccaagatggacgtgaaaaatctatgtggacctctgtgaagggccgattcgccatctccagagacaacgccaagactcactgtggctgcacatgaacgcctgagaggcgacgcacggctgtgtacttctgtgcgagacgccccagtggacgggctacgaggtgggagctacgtacttttgaccttacgtcggggacccaggggaacccctgggtccaccgttctccctcacgccctccgaaccgacgggcccacgtccggtccttcccccgtcggcccacccctccctaccaacgcgtcctacctcggtcggggccaccgacggcccgggcccgtggggcctcggtcccgttagggtacctaacgggtaccttaccgttacccgaccggtacggtacgttaccggaccggtcggaacgggtccgggggaccgtcgggaccgaaccgggccgaccgtacgtacggcngtc

SEQ ID NO: 222219 - DNA, 573 bp, Homo sapiens
  misc_feature: GYAE6OF02GHB90.38.4.A04.1.454.CMB.1.raw
  modified_base (571)..(573): a, c, t, g, unknown or other
  misc_feature (571)..(573): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgcatctccagagacaacgccaagaactcactgtggctgcacatgaacggcctgagaggcgacgacacggctgtgtacttctgtgcgagacgcccccagtggagggctacgaggtgggagcgtacgactttgactacgcggggccacgggacctggtcaccgtctcctcacgccctccaaccgacggcccacgtccggtccttcccccgtcggcccaccctccctaccaacgacgcctaccgtcggtcgggggccacgacggcccgggccgtcgggctcgccgttggtacaacggaccttaccgttccgacgtcgacgtccgacgtggacggcgggctgggacgaagggccgacagtacgnnn

SEQ ID NO: 222220 - DNA, 642 bp, Homo sapiens
  misc_feature: GYAE6OF02GMUL3.38.4.A04.1.454.CMB.1.raw
  modified_base (638)..(638): a, c, t, g, unknown or other
  misc_feature (638)..(638): n is a, c, g, or t
  modified_base (640)..(641): a, c, t, g, unknown or other
  misc_feature (640)..(641): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaaatactatgtggactctgtgaagggccgattcgccatctccagagacaacgccaagaactcactgtggctgcacatgacggcctgagaggcgacgacacggctgtgtacttctggtgcgagaccgcccccagtggacgggctacgaggtgggagtcgtacgtactttgacgttacggtcgggggaccgaacgggaaccctggtccaccgtcctccctcgacgccctacccgaaccgaacggacccgtaccgttccggttccccgttcccccgtccggtccctacccctccctacccgaacgacgccgtaccgtccggtcggggccgacgacggccggcccgtcgggtccgtcgtccgtcggtacgaacggtaccgtaccgttaccgtacgtacgtacgtccgtacgtcggacggcgggcggtcggacggaacggccgacgtttttttttttacgagngnng

SEQ ID NO: 222221 - DNA, 571 bp, Homo sapiens
  misc_feature: GYAE6OF02GV4XM.38.4.A04.1.454.CMB.1.raw
  modified_base (569)..(571): a, c, t, g, unknown or other
  misc_feature (569)..(571): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccagtgagggctacgaggtgggagctacgtactttgactacgtggggccagggaaccctggtcaccgtctcctcacgccctccacgaacgggcccacgtccggtccttccccctggccctaccctcctaccgaacgacgccaccctcgtcggggccacgacggccggcccgtggggcctcggcccttgggtccaagggaccttaccttccgacgtgacgtccggaacgtggacggcgggctcgggcgaacgggccgacagtagnnn

SEQ ID NO: 222222 - DNA, 611 bp, Homo sapiens
  misc_feature: GYAE6OF02G4ZWP.38.4.A04.1.454.CMB.1.raw
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccacgtgagggctacgaggtgggagctacgactttgactacgtggggccagggaaccctggtcaccgtctcctcacgccctccaccgaacgggcccagtccggtccttcccccgtggccaccctcctccaagacgccaccgtcgtcggggaccacgacggccggcccgtggggcctcggtcccgttgggtacccgaaacgggtaccttaccgttacccgacgttcggacgttccggtacgttcgggaacgggtccggggtccttacggggaccgtaacggggcccggtacgaacgttacgggcngng

SEQ ID NO: 222223 - DNA, 591 bp, Homo sapiens
  misc_feature: GYAE6OF02I2G8A.38.4.A04.1.454.CMB.1.raw
  modified_base (329)..(329): a, c, t, g, unknown or other
  misc_feature (329)..(329): n is a, c, g, or t
  modified_base (589)..(591): a, c, t, g, unknown or other
  misc_feature (589)..(591): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagtgacaacgccaagaactcactgtggctgcacatgaacggcctgagaggcgacgacacggctgtgtacttctgtgcgagacgcccccagtggagggctacgaggtgggancgtacgactttgactacgtggggaccagggaaccctggtcaccgtctcctcacgccctcccaaccgaacgggccctagtcccggtccttcccccgtggccctacccctccctaccaacgcgccaccgtccggtcgggggaccacgcggcccgggcccgtggggccttcggcccgttggtaccgaacgggtaccttacccgttccgacgttcgatccggacgtggacggccgggcgtgggaccgaacgggccgacagtagnnn

SEQ ID NO: 222224 - DNA, 553 bp, Homo sapiens
  misc_feature: GYAE6OF02HAT4Z.38.4.A04.1.454.CMB.1.raw
  modified_base (551)..(552): a, c, t, g, unknown or other
  misc_feature (551)..(552): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacagtgggagctacgactttgactacgtggggccaggggaaccctggtcaccgtctcctcacgccctccaccgaacgggcccacgtccgggtccttcccccgtggcccaccctcctccaacgacgccacctcgtcggggcacgacgccggcccgtgggcctcgccgtggtacaacgggtacctacgttccacgtgactcgacgtggacggcgggctcggacaacggcgacagtagnnc

SEQ ID NO: 222225 - DNA, 581 bp, Homo sapiens
  misc_feature: GYAE6OF02G1R56.38.4.A04.1.454.CMB.1.raw
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggagctacgtactttgactacgtggggccagggaccctggtcaccgtctcctcacgccctccaaccgacgggcccacgtccggtccttcccccgtcggtccctaccctccctacccaacgacgccaccgtcgtcggggccacgacggccggcccgtcgggccgtcgtccgtcggtacgaacggtaccttaccgttaccgacgtcgtactccggtacgtggacggcgggcgtcggacgacggcgacgagtgngnn

SEQ ID NO: 222226 - DNA, 823 bp, Homo sapiens
  misc_feature: GYAE6OF02JFROL.38.4.A04.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctggagtgggtggcctagtctaattaaccaagatggacgtagaaaaatctatgtggactntgtgagggcgagttcgcatcgtcgagagaacncgtccaaagactcactgtcgctgcacatgacgctgagacggcgacngggacctacggcgtacgttcgtacgttacgtcggtaggacggtaccggaagtccccgaacgtcgtaacgggtcgttacggtaagtcggggtaacggacgttaacgggaaccgttttacggacgggttacccttaggggggtaacccctaggggggtaacccccttacggggttcctaacccgggttacggtacccgttacccgtaccgacccgtaccggtaacccctaaacggggtcccccgtaaacgttacccccgggttacggttaccccccctaaccgggtacccgtaacccccgttaacccgtacccgtaaaccggtaacccgtaccgtaacccgggtacccgttacggggggaacctaacccggtaaccggcggggaccccttacggggcccgttacgggacccgtacgggttacctaaaccgggttaccttaaccgttaccgtaaccggttccggaacgttaccgggaaccgttagggaaccgtaccgggggacctaacggggtaccgaacgggtacggtaccgtaacggtacgcgtacg

SEQ ID NO: 222227 - DNA, 594 bp, Homo sapiens
  misc_feature: GYAE6OF02G202G.38.4.A04.1.454.CMB.1.raw
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
  modified_base (590)..(591): a, c, t, g, unknown or other
  misc_feature (590)..(591): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccagtggagggctacgaggtggggagcgtacgactttgactacgtggggccacggggaaccctggtcaccgttcnccctgacgccctccaccgaacgggcccagtccggtccttcccccgnggccctccctcctccaagacgcaccgtcggtcggggccacgacggccggcccgtggggcctcgccgttggtaccgaacggtaccttaccttcccgaacgttcgacgttccggacgttcgggacggccgggtacgtcgggaccgaaggggcccgacgacgtaggnngtc

SEQ ID NO: 222228 - DNA, 616 bp, Homo sapiens
  misc_feature: GYAE6OF02FGFZI.38.4.A04.1.454.CMB.1.raw
  modified_base (614)..(616): a, c, t, g, unknown or other
  misc_feature (614)..(616): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaaagaactcactgtggctgcacatgaacggcctgagaggcgacgacgacggctgtgtacttcgtgtgcgagaccgcccccagtggagggtctaacgagggtgggacgtccttaacgtacttttgaccttacggtcggggccaacggggtaaccctggtacccaccgtcctccctcgacgtccctacccgaaccgaacgggccctagtcccggttcccttcccccgtcggcccaccctccctaccgaacgacgccgtaccgtcggtcgggggccacgacggcccggtcccgtcgggccgtcgccgtggtaccgtaacggtaccttaccttccgacgtgactcgacgtggacggccgggtcgtcggacgtaacggcgacgtagtacgnnn

SEQ ID NO: 222229 - DNA, 568 bp, Homo sapiens
  misc_feature: GYAE6OF02HD7LG.38.4.A04.1.454.CMB.1.raw
  modified_base (326)..(326): a, c, t, g, unknown or other
  misc_feature (326)..(326): n is a, c, g, or t
  modified_base (566)..(568): a, c, t, g, unknown or other
  misc_feature (566)..(568): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatactatgtggactctgtgaagggccgattcgccatctccagagacaacgccaagaactcactgtggctgcacatgaacggctgagaggcgacgacacggctgtgtacttctgtgcgagacgcccccagtgaggctacgagtggganctacgactttgactactggggccaagggaaccctggtcaccgtctcctcagcctccaccaaggccatcgtcttccccctgcaccctctccaagagcacctcgtcggggccacgaggccggcccgtcgggcctcggcccgttgggtaccaaagggaccttaaccgttacccgacgttcgacttccggaacgttcggaacggtcggggccgtgggacctaacgggccggaccaagtaacggnnn

SEQ ID NO: 222230 - DNA, 648 bp, Homo sapiens
  misc_feature: GYAE6OF02IEAYS.38.4.A04.1.454.CMB.1.raw
  modified_base (646)..(646): a, c, t, g, unknown or other
  misc_feature (646)..(646): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaaccgaccaagaactacactgtggctgcacatgaaccggctgagaggcgaccgacgacggctgttgtacttctgtgcgacgacgcccccactggagggcctacgaggtgggagctacgtactttgacgtacgtcggggaccgacgggaccctggtccacccgtccgtcctccgacgccctacccacccgtaaaccggggccctaacttcccggttcccctttcccccgtacggtccctaccccgtcccttaccgaaacgtaccgaccctacccgttccggtcgggggaccacgacggcccgggcccgtcggggtcctccggtccgttacggtaccgaaacggtaccgttaccgttcccacggttagacgtaccgtacgtcggacggccgggtaccgtcggaccgaacgggtccgctaagtagcngc

SEQ ID NO: 222231 - DNA, 673 bp, Homo sapiens
  misc_feature: GYAE6OF02JSRTC.38.4.A04.1.454.CMB.1.raw
  modified_base (191)..(191): a, c, t, g, unknown or other
  misc_feature (191)..(191): n is a, c, g, or t
  modified_base (320)..(320): a, c, t, g, unknown or other
  misc_feature (320)..(320): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtggtggccagcattaaccaagatggacgtagaaaaatctatgtggactntgtgagggccattcgccatctccagagacaacgccaagaactcactgtggctgcacatgaacggcctgagaggcgacgacacggctgtgtacttctgtcgacgagacgccccacgtcggagggctacgnggtgggacgctacggtactttagacttacgtcgggggaccaacggggaacccttgggtaccacccggtctacctacgaccgtccctaccgaccgtaacggggcccctacgtccggtcccgtttcccccaggacccaccctccgtacccaaacggaccgccgtaacccgttccggtacgggggacctaaccgtacgggcccggtcccggtcgggccttccggtcccgttcgggtaacgtaaaccgggtaccttaccgtttacccgacggttacggacgttaccgtaacggtccggtaacggtcggggtaccgtcgggaccgtaacgggtaccgacgtaacggtccgtgtgtacg

SEQ ID NO: 222232 - DNA, 256 bp, Homo sapiens
  misc_feature: GYAE6OF02I688P.38.4.A04.1.454.CMB.1.raw
tcagtcgatcacgtcacgaccggtgctcgatttagagtagtgatcaggggggtccctgagactctcctgtgcagcctctgcattcacctttagtaactatttaatgagctgggtccgccagcctccagggaggggctggagtgggtggccagcattaaccaagatggacgtagaaaaatctatgtggactctgtgaaggccgattcgccatctcagagacaacgccaagaactcactgtgctgcacattggaaccc

SEQ ID NO: 222233 - DNA, 598 bp, Homo sapiens
  misc_feature: GYAE6OF02G3QAQ.38.4.A04.1.454.CMB.1.raw
  modified_base (376)..(376): a, c, t, g, unknown or other
  misc_feature (376)..(376): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacaggtgggagctacgactttgactacgtggggccagggaaccctggtcaccgtctccncacgcctccaccgaacgggcccagtccggtccctttccccccgtcggccctaccccttccctacccgaacgacgaccacccgtcggtcgggggacaccgacggccggcccgtggggcctcggcccgtgggtaccaaacgggtaccttacccgttcccgacgtcgactccggacgtggaacggccggggcgtcgggaccgaacgggccgacgtagtacgngnn

SEQ ID NO: 222234 - DNA, 549 bp, Homo sapiens
  misc_feature: GYAE6OF02GU7W5.38.4.A04.1.454.CMB.1.raw
  modified_base (547)..(549): a, c, t, g, unknown or other
  misc_feature (547)..(549): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacaggtgggagctacgactttgactacgtggggccaggggaaccctggtcaccgtctcctcacgccctccaaccgaacgggcccacgtccggtccttcccccgtcggccaccctccctaccaacgcgccacctcgtcggggcacgacgccggccctgggcctcgccgtggtacaacggtactactccgacgtgacgtcgacgtggacgcgggctcggcgaggcgcagtgnnn

SEQ ID NO: 222235 - DNA, 559 bp, Homo sapiens
  misc_feature: GYAE6OF02GVHO9.38.4.A04.1.454.CMB.1.raw
  modified_base (557)..(558): a, c, t, g, unknown or other
  misc_feature (557)..(558): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccactggagggctacgagtgggagctacgactttgactacgtggggccaggggaccctggtccaccgtctcctcacgccctccaccgacgggcccagtccggtccttcccccgtcggcccaccctccctccaacgacgccaccgtcgtcggggcacgacgccggcccgtgggctcgccgtcggtacaacggtactacttccgacgtgacgtcgacgtggacggcgggcgtcggcgaacgggccgacgagtagnnc

SEQ ID NO: 222236 - DNA, 596 bp, Homo sapiens
  misc_feature: GYAE6OF02IE561.38.4.A04.1.454.CMB.1.raw
  modified_base (326)..(326): a, c, t, g, unknown or other
  misc_feature (326)..(326): n is a, c, g, or t
  modified_base (594)..(594): a, c, t, g, unknown or other
  misc_feature (594)..(594): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggctgagaggcgacgacacggctgtgtacttctgtgcgagacgcccccatgaggctacgaggtggganctacgactttgactacgtggggccagggaaccctggtccaccgtctcctcacgccctaccaccgaacgggccctatccggtccctttcccccgtcggacctacccctccgtacccgaagacgcctaacccgtcggtcgggggaccacgacggccggcccgtcggggcctcggcccgtcgggtaccaacggtacccttacttcccgaagttcgacgtccggacgtcggacggccgggtcgtcggaccgacgggccgacgtaagtacgcngc

SEQ ID NO: 222237 - DNA, 579 bp, Homo sapiens
  misc_feature: GYAE6OF02F0R4K.38.4.A04.1.454.CMB.1.raw
  modified_base (328)..(328): a, c, t, g, unknown or other
  misc_feature (328)..(328): n is a, c, g, or t
  modified_base (577)..(579): a, c, t, g, unknown or other
  misc_feature (577)..(579): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaaagaactcactgtggctgcacatgaacgcctgagaggcgacgacacggctgtgtacttctgtgcgagacgcccccagtggagggctacgaggtgggancgtacgactttgactacgtggggccagggaaccctggtcaccgtctcctcacgtccctccaaccgaacgggccctacgtccggttcccttcccccgtcggccctaccctcctaccaacgcgccaccgtcgtcggggccacgacggccggcccgtcgggcctcggccgttgggtaccgaacggtacctaccgttaccgacgttcgactccgacgtcggacgcgggtcgtcggacgacggcgacgagtagnnn

SEQ ID NO: 222238 - DNA, 609 bp, Homo sapiens
  misc_feature: GYAE6OF02G0CNV.38.4.A04.1.454.CMB.1.raw
  modified_base (244)..(244): a, c, t, g, unknown or other
  misc_feature (244)..(244): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgnggctgcacatgaacggcctgagaggcgacgacacggctgtgtacttctgtgcgagacgcccccagtgagggctacgaggtgggagctacgactttgactacgtcggggccacgggaccctggtccaccgttctcctcacgccctccaccgaacggggcccacgtccggttcccttcccccgtcggccctaccctccctaccgaacgaccgcctacccgtcggtcgggggaccacgacggccggcccgtcgggccgtcggtccgtcggtaccgaacggtaccttaccgttcccgacgttcgacgtaccggacgtcggacggtccggggtcgtcgggaccgaacgggccggtacgagtacgngnacg

SEQ ID NO: 222239 - DNA, 550 bp, Homo sapiens
  misc_feature: GYAE6OF02GH1J9.38.4.A04.1.454.CMB.1.raw
  modified_base (547)..(549): a, c, t, g, unknown or other
  misc_feature (547)..(549): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacgggctgtgtacttctgtgcgagacgcccccatggagggctacagtgggagctacgactttgactacgtggggccagggaccctggtcaccgtctcctcgacgccctccaccgaacgggcccagtccggtccttcccccgtggcccaccctcctacccaacgacgccaccgtcgtcgggggccacgacgccggccctgggcctcggcctggtcgaaggacctacgttccacgtgactcgacgtgacgcgggcgtggacgaaggcgcaagtgnnng

SEQ ID NO: 222240 - DNA, 589 bp, Homo sapiens
  misc_feature: GYAE6OF02GM29N.38.4.A04.1.454.CMB.1.raw
  modified_base (586)..(587): a, c, t, g, unknown or other
  misc_feature (586)..(587): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacaggtgggagctacgactttgactacgtggggccagggaccctggtcaccgtctcctcacgccctccacgaacgggcccacgtccggtccttcccccgtggcccaccctcctccaacgacgccacctcgtcggggccacgacggccgggcccgtggggccttcggcccgttgggtaccgaaacgggtaccttaaccgttccgacgttcgacgttccggacgtcggacggtccggggccgtacgggccgaacgggccgtacgagtacgnncg

SEQ ID NO: 222241 - DNA, 593 bp, Homo sapiens
  misc_feature: GYAE6OF02G8BTA.38.4.A04.1.454.CMB.1.raw
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaaggccgattcgcatctcagagacaacgccaagaactcactgtggctgcacatgaacggctgagaggcgacgacacggctgtgtacttctgtgcgagacgcccccatgagggctacaggtggacgctacgtactttgacctagtggggccacgggaccctggtccaccgtctcctcacgccctaccaccgagggccctacgtccggtccttccccctcggccaccctcctaccaacgacgccaccgtcgtcggggcaccgacggccgcccgtcgggcctcggcccgttgggtaccgaaacggtacccttaaccttcccgtaacgttcgaacgtccgtacgtgggtacggccggggtccgtggggaccaacgggtccgacgtaacgtacggtacngn

SEQ ID NO: 222242 - DNA, 575 bp, Homo sapiens
  misc_feature: GYAE6OF02I91TJ.38.4.A04.1.454.CMB.1.raw
  modified_base (327)..(327): a, c, t, g, unknown or other
  misc_feature (327)..(327): n is a, c, g, or t
  modified_base (438)..(438): a, c, t, g, unknown or other
  misc_feature (438)..(438): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
tcagtcgatcacgtcacgaccggtgctcgatttagagtagtgatcaggggggtcccgtgagactctcctgtgcagcctctgcattcacctttagtaactatttaatgagctgggtccgccagcctccagggaagggctggagtgggtggccagcattaaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacgagtggganctacgactttgactactggggccagggaaccctggtcaccgtctcctcagccctcaccaacgggcccagtccggtcttcccccgtgccctaccctcctaccagacgcaccncgtcggggcacacggccggccgtcgggctcggccgtcggtacgaacggtaccttacttcccgacgttcgacgttaccgacgtcggacggtcggggtaccgtcgggaccgtaacgggccgaccgaaggtacggngcnc

SEQ ID NO: 222243 - DNA, 625 bp, Homo sapiens
  misc_feature: GYAE6OF02FOOM0.38.4.A04.1.454.CMB.1.raw
  modified_base (623)..(623): a, c, t, g, unknown or other
  misc_feature (623)..(623): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagagcccccatggagggctacgagtgggagctacgactttggactacgtggggccaggggaaccctggtccacgtctcctcacgcctaccaccgaagggcccaagtccggtcctttccccccgtgggacctaccctccctcccaaacggacgccaccctcgttacgggggccaacgacggtccgggcccgttggggaccttggccccgttagggtaccgaaacgggtaccttaaccgtttcccgaacggttcggtacttccggaacgttcggaacggccgggggaccttccgggaccgaacgggtccggaccaaggttacggcgtancg

SEQ ID NO: 222244 - DNA, 553 bp, Homo sapiens
  misc_feature: GYAE6OF02F0BNW.38.4.A04.1.454.CMB.1.raw
  modified_base (551)..(553): a, c, t, g, unknown or other
  misc_feature (551)..(553): n is a, c, g, or t
tcagtcgatcacgtcacgaccggtgctcgatttagagtagtgatcagggggggtcccgtgagactactcctgtgcagcctctgcattcacctttagtaactatttaatgagctgggtccgccagcctccagggaaggggctgggagtgggtggccagcattaaccaagatggacgtgaaaaaatctatgtggactctgtgaagggccgattcgccatctccagagacaacgccaaagaactcactgtggctgcacatgaacggcctgagaggcgacgacacggctgtgtacttctgtgcgagacgcccccatgagggctacagtgggagctacgacttttgacttacgtggggccaggggaaccctggtcacgtctcctcacgcctccaccgaacgggccctagtccggttccttcccccgtcggccaccctcctacccaacgacgccaccgtcgtgggggccacacggccggcccgtgggctcggcctggtcaacggactaccttccacgtgatcgacgtgaggcgggcgtggacgacggcgacgatcgnnn

SEQ ID NO: 222245 - DNA, 588 bp, Homo sapiens
  misc_feature: GYAE6OF02HI5ZU.38.4.A04.1.454.CMB.1.raw
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (586)..(586): a, c, t, g, unknown or other
  misc_feature (586)..(586): n is a, c, g, or t
tcagtcgatcacgtcacgaccggtgctcgatttagagtagtgatcaggggggtccctgagactctcctgttgcgagccgtctgcattcaccgtttagtaactatttaatgaagctggtccgccagcctccagggaagggctggagtgggtggccagcattaaccgaagatggacgtgaaaaatctatgtggactctgtgaaggccgattcgcatcgtccagagacacgccaagaactcactgtggcctgcactctgaaccgcctgagaggcgacgacacggcgtgtgtacttctggtgcgagcgccccagtggacggtctacgaggtgggagctacttacgtttggaccgtacgtcggggaccgacgggacccgtggtccaccgtctccncncgccctccaccgaacgggcccagtcccggtcccttcccccgtggccctaccctcctccaagcgcctaccgtcggtcgggaccacgacggccgtcccgtggctcgccgttggcgaacggtaccttccgttccgacgtgacgtaccgtccgtaggacggtcgggcgtacggaccgacgggtccacgtagtacgcgncg

SEQ ID NO: 222246 - DNA, 559 bp, Homo sapiens
  misc_feature: GYAE6OF02HNEPG.38.4.A04.1.454.CMB.1.raw
  modified_base (325)..(325): a, c, t, g, unknown or other
  misc_feature (325)..(325): n is a, c, g, or t
  modified_base (412)..(412): a, c, t, g, unknown or other
  misc_feature (412)..(412): n is a, c, g, or t
  modified_base (462)..(462): a, c, t, g, unknown or other
  misc_feature (462)..(462): n is a, c, g, or t
  modified_base (548)..(548): a, c, t, g, unknown or other
  misc_feature (548)..(548): n is a, c, g, or t
  modified_base (557)..(559): a, c, t, g, unknown or other
  misc_feature (557)..(559): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtgctgcacatgaacggcctgagaggcgacgacacggctgtgtacttctgtgcgagacgcccccatggagggctacgagtggganctacgactttgactacgtggggccagggaccctggtacaccgtctcctcagccctccaccgaagggcccacgtcggtccttcccccnggcccaccctcctccaagacgccacctcgcggggcacgacgccggtcccnggggcctcgcctggtaccaaacgggacttaccgttccaacgttgactccggactggacggcgggccttgggaccgaacgggccganacgtaacgnnn

SEQ ID NO: 222247 - DNA, 602 bp, Homo sapiens
  misc_feature: GYAE6OF02FLJ3P.38.4.A04.1.454.CMB.1.raw
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccagtgagggctacgaggtgggagctacgactttgactacgtggggccagggaaccctggtcaccgtctcctcacgccctccaccgaacgggcccagtccggtccttccccctggcccaccctcctccaacgacgccacccgtcgtcgggggccacgacggccgggcccgtggggcctcggcccgttgggtaccgaaacgggtaccttaaccgtttcccgaaccgttcgtacgtccggtaccgttcgggacggtccggggtccgttcgggaccgaacgggccgacgtaatacggntncg

SEQ ID NO: 222248 - DNA, 586 bp, Homo sapiens
  misc_feature: GYAE6OF02GTOR2.38.4.A04.1.454.CMB.1.raw
  modified_base (584)..(584): a, c, t, g, unknown or other
  misc_feature (584)..(584): n is a, c, g, or t
tcagtcgatcacgtcacgaccggtgctcgatttagagtagtgatcaggggggggtccctgagactctcctgtgcagtctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgccccagtgagggctacgaggtgggagctacgtactttgactacgtcggggccaaggggaacccctggtccacccgtctccctcacgccctccgaccgaacgggcccacgtccggtcccttcccccgtcggccaccctccctccaacgcgcctacctcgtcggggaccacgacggccggcccgtgggcctcggcccgttcggtaccgaacgggtaccttaccgttaccacggtcgtacgtccgacgtggacggcgggcgtcggacgaacggccgacagtagcngc

SEQ ID NO: 222249 - DNA, 688 bp, Homo sapiens
  misc_feature: GYAE6OF02IEICV.38.4.A04.1.454.CMB.1.raw
  modified_base (270)..(270): a, c, t, g, unknown or other
  misc_feature (270)..(270): n is a, c, g, or t
tcagtcgatcacgtcacgaccggtgctcgatttagagtagtgatcagggggggtccctgagacctctcctgtgcagcctcttgctatttcacctttagtaactatttaatgagctgggtccgccagcctccagggaaggggtctggagtgggtggtccagcatttaacctaagatggacgtagaaaaatactatgtggactcgtgtgaaggcggattcgcatctccagagacaacgcaagaactcactgtgctgcacatgaacgctgagnggcgacgacacggctgtgtaccttctagtcgcggaagacgccccctagtggagggctacgaggttgggtagcttacgtacgtttaggacttacggtcggggtaccaacgggtaacccgttggtacgaacccggttcgtcccgtacgacggtaccccgtaccctaacccgtaacggggacccctaacggtttcccggttacccctttacccccgtagggacccctaaccccttcccgtacccgaaacgacgaccgtacccttacggtcgggggtaccacgacggcccggtacccgtacgggtccgtcgccgtacggtacgtaaacggtaccttaaccgttccgacggtacgaacgtccggaacgtcggaagggtccgggcgttacggacgtacgggcgtaccgtaaggtcgcgagtacg

SEQ ID NO: 222250 - DNA, 526 bp, Homo sapiens
  misc_feature: GYAE6OF02HVF1I.38.4.A04.1.454.CMB.1.raw
  modified_base (251)..(251): a, c, t, g, unknown or other
  misc_feature (251)..(251): n is a, c, g, or t
  modified_base (372)..(372): a, c, t, g, unknown or other
  misc_feature (372)..(372): n is a, c, g, or t
  modified_base (517)..(517): a, c, t, g, unknown or other
  misc_feature (517)..(517): n is a, c, g, or t
  modified_base (524)..(526): a, c, t, g, unknown or other
  misc_feature (524)..(526): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcanatgaacggcctgagaggcgacgacacggctgtgtacttctgtgcgagagcccccatgagggctacagtgggagctacgactttgactacgtggggccagggaaccctggtcaccgtctccncagcctccacaacgggcccatcggtccttcccctggccaccctcctccaagacgccacctcgtcggggcacgacgccggccctgggcctgccctggtcaagccttactccgacgtgactcgactggacgcgggctggcgaaggcncagtagnnn

SEQ ID NO: 222251 - DNA, 604 bp, Homo sapiens
  misc_feature: GYAE6OF02GX47I.38.4.A04.1.454.CMB.1.raw
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccagatggacgtagaaaaatactatgtggactctgtggaagggccgattcgccatctcagagacaacgccaagaactcactgtggctgcacatgaacggcctgagaggcgacgacacggctgtgtacttctgtgcgagaccgcccccagtggagggctacgaggtgggagctacgtactttgaacttacggtggggacccgacgggtaacccgtggtaccaccggtccttcccgtcgaccgccctacccaaccgaccgggccctacgttccggttccccttcccccgtcggccctacccctccctaccgaacgccgcctaccgtccggtcggggaccacgcggcccggcccgttcgggcctcggccgtcggtaccgaacggtccttactccgagtcgactcgacgtggacggcggtcgtcggacgaacggccacgagtagcngn

SEQ ID NO: 222252 - DNA, 692 bp, Homo sapiens
  misc_feature: GYAE6OF02H7CN3.38.4.A04.1.454.CMB.1.raw
  modified_base (161)..(161): a, c, t, g, unknown or other
  misc_feature (161)..(161): n is a, c, g, or t
tcagtcgatcacgtcacgaccggtgctcgatttagagtagtgatcagggggaagaccgatgggcccttggtggaggcttggtccagccgggggggtcccgtgagactctcctgtgcagcctctgcattcacctttagtaactatttaatgagctgggtccnccagcctccagggaggggctggagtgggtggccaggcattaaccaaggatggaacgtagaaaaaatactaatggtaggaacttcgtggttggaaaggggccaagtttcggacccaattcctaccgagaagaacaaccgaccgtaaagaactacactgtggctgcacatgaacggcctggagacggcgacgacacggtcctagtgtacttcgtcgttgacggagacgccccccgtaagtcgggaacgggtcctaacgacgggtacgggggtaagtcccgttaacgtaccgttttagaaccgttaaccggtcggggggaacccgtaacggggaaccgttcgggtaccgtacccgtccttccgtccgtacgccctccgaacccgaacggtcccgaacgttcggtacccttccccgtcgcccgtacccgtccacccgtacgaccgcacccgttcgcggggcaaccgcggccgccctacgggcctggcccgtcggacgtaaccgccgttacgtccgaccggtcacgtccgatcggg

SEQ ID NO: 222253 - DNA, 591 bp, Homo sapiens
  misc_feature: GYAE6OF02HAGIQ.38.4.A04.1.454.CMB.1.raw
  modified_base (443)..(443): a, c, t, g, unknown or other
  misc_feature (443)..(443): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggctgagaggcgacgacacggctgtgtacttctgtgcgagacgcccccagtggagggctacgaggtgggagctacgactttgactacgtggggccagggaccctggtcaccgtctcctcacgcctccaccgacgggccctagtccggtccttcccccgtggccctaccctccctaccgaacgacnccaccgtcgtcggggccacgacggccggcccgtgggcctcggcccgtcgggtaccgaaacggtaccttaccttcccgacggttcgacgttccgacgtcggacggtccggggcgttacgggaccgaacggccggacgtagtacgnancg

SEQ ID NO: 222254 - DNA, 580 bp, Homo sapiens
  misc_feature: GYAE6OF02HAYS9.38.4.A04.1.454.CMB.1.raw
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccaggggaaggggctggagtgggtggccagcattaaccaagatggacgtgaaaaaatctatgtggactctgtgaaggccgattcgccatctccagagacaacgccaagaactcactgtggctgcanatgaacggcctgagaggcgacgacacggctgtgtacttcgtgtgcgagacgcccccagtgagggctacgagtggganctacgtattttgacttacgtggggccgacgggaaccctggtccaccgtcctcctcacgccctcccaccgaacgggccctacgtccggtccttcccccgtggcccaccccttccctaccaacgacgcctacccgtcgtcggggcacgacgccggcccgtggctcggccgtcggtacgaacgaccgtaccttccgacgtcgactcgactcgg

SEQ ID NO: 222255 - DNA, 577 bp, Homo sapiens
  misc_feature: GYAE6OF02HMWVJ.38.4.A04.1.454.CMB.1.raw
  modified_base (377)..(378): a, c, t, g, unknown or other
  misc_feature (377)..(378): n is a, c, g, or t
  modified_base (413)..(413): a, c, t, g, unknown or other
  misc_feature (413)..(413): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggacgctacgtactttgactacgtggggccacgggacctggcacgtctccnncgcctccacgacggcccagtccggtccttccccgnggcccaccctcctaccaagcgcctaccgtcgtcggggccacgacggccggcccgtgggcctcggccgtggtaccgaacggtaccttacctaccgtacgtgacgtccggacgtcggacggtccgggtccgtcgggaccgtaacgggccgtagtacgtaggcagcg

SEQ ID NO: 222256 - DNA, 531 bp, Homo sapiens
  misc_feature: GYAE6OF02IBU19.38.4.A04.1.454.CMB.1.raw
  modified_base (107)..(107): a, c, t, g, unknown or other
  misc_feature (107)..(107): n is a, c, g, or t
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (527)..(527): a, c, t, g, unknown or other
  misc_feature (527)..(527): n is a, c, g, or t
  modified_base (529)..(531): a, c, t, g, unknown or other
  misc_feature (529)..(531): n is a, c, g, or t
tcagtcgatcacgtcacgaccggtgctcgattttagagtagtgatcagggggggtccctgagactctcctgtgcagcctctgcattcacctttagtaactatttaangagctgggtccgcagcctccagggaaggggctggagtgggtggccagcattaaccaagatggacgtagaaaaaatactatgtggactctgtgaagggccgatttcgccatctccagagacaaccgccaagaactcactgtggctgcanatgaacggcctgagaggcgacgacacggctgtgtacttntgtgcgaggacgcccccatggagggctaacgaggtgggacgctacgactttgaactacgtggggccagggaccctggtcaccgtctcncncgccctcaccgaggccatccgtcctcccngccacctccacagacnccactcgngggcacgcgccggccgtggctcgccgtggcgaagtcctactccgagtcgacgtcgtcgtggacggcggcgtggcgaacggcgacgtacgngnnn

SEQ ID NO: 222257 - DNA, 664 bp, Homo sapiens
  misc_feature: GYAE6OF02JMEI7.38.4.A04.1.454.CMB.1.raw
  modified_base (335)..(335): a, c, t, g, unknown or other
  misc_feature (335)..(335): n is a, c, g, or t
  modified_base (382)..(382): a, c, t, g, unknown or other
  misc_feature (382)..(382): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
  modified_base (654)..(654): a, c, t, g, unknown or other
  misc_feature (654)..(654): n is a, c, g, or t
tcagtcgatcacgtcacgaccggtgctcgatttagagtagtgatcaggggggtcccgtgagacgtctcctgtgcagcctctgcattcacctttagtactatttaatgtagctgggtccgccagcctccagggaaggggctgggatgggtggccagcattaaccagatggacgtgaaaatctatagtggactctgtgaagggccattcgcctagtctccagagaccaacgccaaagactcactgtggctgcacatgaacggcctagagaggcgacgacacggctggtcgtacttcgtgtgcgtagacgccccgactcggacggctacgagtgggancgtacgctttgactcgtcgggcacgggaccctggcgaccgtctaccncacggcctccgaccgtaggggccccagtccgggtaccttcccccgnggccctaccctcctcccgaaacgtcncccgacctttccgcggggcctacgaccggccggtaccctcgggggcctccgggtacccgttcgggttaccgaaacggggtacccttttaacccggtccgtaacccggttacggtacccgttacccggaccggtttgggaacccgggttccgggggtacttcggggaacccgttaacgggcccggtactaaaggtcccggnggtacctcgg

SEQ ID NO: 222258 - DNA, 595 bp, Homo sapiens
  misc_feature: GYAE6OF02HVCIB.38.4.A04.1.454.CMB.1.raw
  modified_base (219)..(219): a, c, t, g, unknown or other
  misc_feature (219)..(219): n is a, c, g, or t
  modified_base (594)..(594): a, c, t, g, unknown or other
  misc_feature (594)..(594): n is a, c, g, or t
tcagtcgatcacgtcacgaccggtgctcgatttagagtagtgatcaggggggggtccctgagactctcctgtgcagcctctggattcagcctcagtagttattggatgagctgggtccgccaggctcagggaagggctgcagtgggtgccaacataaagccagatgtaagtgaaatatactatgtggactctgtggaggggccattcaccatctccagnacaacgccaagaactcactgtctctgacaaatgaacagcctgacatccgaggacacggctgtgtattactgtgtgagagagtgggagagggcgggtgctagtttgactcgtggggccagggaccctggtcaccgtctctcacgtccctaccgaccgaacggccctacgtccggtcccttcccccgtcggcccgtccctcgccctaccgacggaccgtacccgaaccccgaggaccgaccgacgaccggccggcccgtcggggcctcggtcccgtacggtaccgaacggtacccttaccgttccgacggtacgtacgtaccggtacgtccggacgggcccgggtcgtacgggacgaacgggccgaccgagtcggcng

SEQ ID NO: 222259 - DNA, 581 bp, Homo sapiens
  misc_feature: GYAE6OF02F9XBB.38.4.A04.1.454.CMB.1.raw
  modified_base (579)..(580): a, c, t, g, unknown or other
  misc_feature (579)..(580): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaagaactcactgtggctgcacatgaacggcctgagaggcgacgacacggctgtgtacttctgtgcgagacgcccccagtggagggctacgaggtgggacgctacgtctttgactacgtggggccacggggaaccctggtccaccgtctcctcacgcctccaccgacgggcccagtccggtccttcccccgtggcccaccctcctaccaacgacgccaccgtcgtcggggccacgacgccggcccgtgggctcgccgtcggtaccgaacggtaccttaccgttccgtacgtcgtacgtccggaacgtcggacggccgggtcgtacgggcgaacgggcgaccgtagtacgnnc

SEQ ID NO: 222260 - DNA, 580 bp, Homo sapiens
  misc_feature: GYAE6OF02HCV9L.38.4.A04.1.454.CMB.1.raw
  modified_base (577)..(578): a, c, t, g, unknown or other
  misc_feature (577)..(578): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaaggccattcgccatctccagagacaacgccaagaactcactgtggctgcacatgaacggctgagaggcgacgacacggctgtgtacttctgtgcgagacgcccccacgtgacgggctacgaggtgggagctacgtactttagactacggtcggggaccgaacgggaaccctggtcaccgtcctcctcacgccctccaccgaacggcccacgtccggtcccttcccccgtcgcccaccctcctaccaacgcgtaccgacctcggtcggggccacgacggccgccgtggcctcgcccgtgtaccgaacggaccttacgtccgacgtcgactccggtacgtcggacggccgggtcgtcgggaccgacggccgacgtagtacgnngc

SEQ ID NO: 222261 - DNA, 732 bp, Homo sapiens
  misc_feature: GYAE6OF02JNOFB.38.4.A04.1.454.CMB.1.raw
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacgacggctgtgtacttctggtgcgagacgcccccagtggacgggctacgaggtgggcgtcgtacggtactttcgaacttacggtcggggaccgacggggtaaccctcgggtaccaccggttcctcccgtcgtaccgaccccttaccgaacccgaacggggcccctaacgttcccggtttacccctttccccccggtcgggtcccctaacccccgttcccgtaaccgtaaaccggaccgtcccgtaaccccgttccgggttccggggggacccaaccgtaaccgggtcccggggccccggttcggggtacccttcgggtaccccgttacgggtaacccgaaaccgggttaccctttaacccgttcccgaccggttacggtacgttacccggtacggtacggtaccggggcgggttaccgaccgggtacggaacggggtccgacgtaacgtacggctgcg

SEQ ID NO: 222262 - DNA, 575 bp, Homo sapiens
  misc_feature: GYAE6OF02JPJM3.38.4.A04.1.454.CMB.1.raw
  modified_base (190)..(190): a, c, t, g, unknown or other
  misc_feature (190)..(190): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (542)..(542): a, c, t, g, unknown or other
  misc_feature (542)..(542): n is a, c, g, or t
  modified_base (572)..(572): a, c, t, g, unknown or other
  misc_feature (572)..(572): n is a, c, g, or t
tcagtcgatcacgtcacgaccggtgctcgatttagagtagtgatcaggggggtccctgagactctcctgtgcagcctctgcattcacctttagtaactatttaatgagctggtccgccagcctccagggaaggggctggagtgggtgccagcattaaccaagatggactgaaaaatctatgtgactctgngaaggcctatcgcatctcagagacaacgccaagactcactgtggctgcacatgaacggcctgagaggcacgacacggctggtntacttcgtgtgcgagacncccccatggacggtctaacgagtgggacgtcctacggtactttgaaccttacggtcgggggccaacggggaacccttgggaccaccggttcctccgtacgacgtccctaccaccgaaggccctacgtccggtcccttaccccgcggtacccaccgtccctaccgaacgtacgccaccgtcgtcggggccacgccgccggcccgtaggcctcgcgtcggtacgaacgctactccgacgtcgatcgacgtcgngcggcgtggacgtacggcgcgacgtagtcntcg

SEQ ID NO: 222263 - DNA, 711 bp, Homo sapiens
  misc_feature: GYAE6OF02ISLIX.38.4.A04.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctgggagtgggtggccagcaattaaccaagatggacgtagaaaaatctatgtgactctgngaagggccattcgcatctcaganacacgccaaagactcacgtgtggctgcacatgaacggctagagaggcgacgacacggctgtgtacttcgngtgcgagaccgccccagtggacgggcctaacgtagggtcgggacnccgttagtaaccgtttgacgtacggtcggggaccaacggggtaaccctgggtacctaccggtctacccgcgaccgcctacccaaccggaacgggccctacgtaccggttcccttcccccgtcggccctaacccgttccctaaccgaagccgtacccgtaccgtcggtcggggaccctacgaccggtacccgggtccccggtcggggtcccttccggtacccgttacgggttaaccgtaaaccggggtaaccctttaacccggttaccccgtaacgggttccggtaacgttacccggtaaccggttccgggaacggggtccgggtccggtacgggaccggtaacgggccggtaacgtacgttacgggactcgacg

SEQ ID NO: 222264 - DNA, 580 bp, Homo sapiens
  misc_feature: GYAE6OF02GXDHD.38.4.A04.1.454.CMB.1.raw
  modified_base (323)..(323): a, c, t, g, unknown or other
  misc_feature (323)..(323): n is a, c, g, or t
  modified_base (437)..(437): a, c, t, g, unknown or other
  misc_feature (437)..(437): n is a, c, g, or t
  modified_base (578)..(578): a, c, t, g, unknown or other
  misc_feature (578)..(578): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtcggacgggctacgnggtgggagctacgtacttgactacgtggggaccacggggaaccctggtccaccgttctccctcgacgtccctcccaaccgaaccgggcccacgttccggtcccctttcccccgnggtcccaccctcctaccgaacgcgcctacctcggtcgggcacgacgcgcccgtgggctcgccgtcgtacgaacgtctacctccacgtgactccgtacgtcggacggcgggcgtcggaccgtaacggccgactagtagctancg

SEQ ID NO: 222265 - DNA, 555 bp, Homo sapiens
  misc_feature: GYAE6OF02F3SM6.38.4.A04.1.454.CMB.1.raw
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
tcagtcgatcacgtcacgaccggtgctcgatttagagtagtgatcagggggggtccctgagaccctcctgtgcagcctctgcattcacctttagtaactatttaaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacagtggganctacgactttgactacgtggggccagggaccctggtcaccgtcncctcacgcctcaccaagggcccatcggtcttccccctggccaccctcctaccaagacgcacctcgtcggggcacgacgccggcccgtgggcctcgcccgtggtaccgaacggtaccttacttcccgacgtcgacgttcgacgtggacggcggtccgtcgggacgacgggcgacgagtaggcngncg

SEQ ID NO: 222266 - DNA, 600 bp, Homo sapiens
  misc_feature: GYAE6OF02ITB4B.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatactatgtggactctgtgaaggccgattcgccatctccagagacaacgccaagaactcactgtggctgcacatgaacggctgagaggcgacgacacgggctggtgtactttcgtgtcgcgagacgcccccactggagggctacgaggtgggagctacgactttgacctactggggccacggggaaccctggtccaccgtctcctcacgccctacccaccgaagggccccaagtccggtcccttcccccgtccggccctaccctccctcccgaaacgcgccacccgtcggtcggggaccaccgacggccggccctgggccttcggcccttggtaccaacgggtacctaccgttcccagttacgacttccggaccgtggaccggtcgggccgttggaccgaacgggccgcaagtacggcagc

SEQ ID NO: 222267 - DNA, 577 bp, Homo sapiens
  misc_feature: GYAE6OF02HRODA.38.4.A04.1.454.CMB.1.raw
  modified_base (367)..(367): a, c, t, g, unknown or other
  misc_feature (367)..(367): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaaggggctggagtgggtggccagcaattaaccaagatggacgtagaaaaatactatgtggactctgtgaaggccgattcgcatctcagagacaacgccaagaactcactgtgctgcacatgaacggcctgagaggcgacgacacggctgtgtacttctgtgcgagcgcccccagtgagggctacgaggtggganctacgactttgactacgtcggggaccgacgggtaaccctgggtaccaccgtcctccctcgacgccctaccaacccgaacggtcccacgtccggttcccttccccgtgccctaccctccctaccgaacgcgcacctcggtcggggcacgcgccggcccgtggccgtcgccgtggcgaacggacctacgttccacgtcgactacgacgtcgg

SEQ ID NO: 222268 - DNA, 664 bp, Homo sapiens
  misc_feature: GYAE6OF02I65XM.38.4.A04.1.454.CMB.1.raw
  modified_base (220)..(220): a, c, t, g, unknown or other
  misc_feature (220)..(220): n is a, c, g, or t
  modified_base (616)..(617): a, c, t, g, unknown or other
  misc_feature (616)..(617): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatctagtgtggactctgtgaaggccattcgcatctcaganacaacgcaagactcactgtaggctgacacatgaacggcctgagacgggacgacgacgacggctgtagttacttcgtggtgacggacgaccgaccccagtcggaggtactaacgaggtagggacgtacgtacgtacgttagacgtacggtcgggaccgaacgggtacccgtacggtacctaccgtacctaccgtacgacgtcccgtaccgaaccgaacggccctacgtccggttacccttccccgtacgtaccctacccgtacctaaccgaacgacgtaccgtacccgtcgggtacggggacaaccgaccggtaccggtccggtacggtaccgtaccggtaccgttacggtaaccgtaaacggtaccttaaccgttaccgtacggtacgacgtacgnngacgtacggacggtacggacgtacggaccgacggacgtacgagtacg

SEQ ID NO: 222269 - DNA, 597 bp, Homo sapiens
  misc_feature: GYAE6OF02G1XXL.38.4.A04.1.454.CMB.1.raw
  modified_base (594)..(596): a, c, t, g, unknown or other
  misc_feature (594)..(596): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaaagaactcactgtggctgcacatgaacggcctgagaggcgacgacacggctgtgtacttctgtgcgagacgcccccatggagggctacgaggtgggagctacgtactttgactacgtggggccaggggaaccctggtccaccggttctcctcacgccctccaccgaacgggcccacgtcccggttcccttcccccgtggtcccaccccttcctacccaacgaccgcctacccgtcggtcgggggccacgacgccggcccgtcgggcctcggccgtcggtaccgaacggtaccttaccgttccgacgttcgacgtccgacgtcggacggccgggtcgtacgggacgaacgggccgacgagtacgnnng

SEQ ID NO: 222270 - DNA, 683 bp, Homo sapiens
  misc_feature: GYAE6OF02I3D90.38.4.A04.1.454.CMB.1.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (681)..(681): a, c, t, g, unknown or other
  misc_feature (681)..(681): n is a, c, g, or t
tcagtcgatcacgtcacgaccggtgctcgatttagagtagtgatcgaggggggggtccctgagactctcctgtgcagcctctgcattcacctttagtaactatttaatgagctcgggtccgccagcctccagggaaggggctggagtgggtggccagcattaaccaagatggacgtagaaaaatctatgtggactctgtgaagggccattcgcatctccagagacaacgccaaagaactcactagtggctgcanagtgaacggctgaggaggcgacgacgacggctggtagtacttcgngtcgcgagaccgaccccagtcgagggtctacgaggtgggacgtctacgtacgtttaggaaccttacggtcggggaccacgggtaaccctgggtccaccgtcttacccgtcgaccggcctaccgaacgtaacgggcccaagttccggttccttcccccgacggtaccctaccctcccgtacccaaaggtccaccgtacccgtacggtccggggaccctacggtaccggcccgggtcccggtcgggtccgttccgggtcccgttcgggaacgtaaaccgggttaccctaaccggtttcccgacggttacgtaccgttccggaacggtcggaccgtcggggtacccgtcgggtacgaacgggtccgaagtaccgggtactcgacncg

SEQ ID NO: 222271 - DNA, 662 bp, Homo sapiens
  misc_feature: GYAE6OF02IO60B.38.4.A04.1.454.CMB.1.raw
  modified_base (305)..(305): a, c, t, g, unknown or other
  misc_feature (305)..(305): n is a, c, g, or t
  modified_base (657)..(658): a, c, t, g, unknown or other
  misc_feature (657)..(658): n is a, c, g, or t
tcagtcgatcacgtcacgaccggtgctcgatttagagtagtgatctaggggggggttcccggtgagactcctaccctgtgcagcctctgcattcaccgtttacgtaactatttaatgagcctggggtccgccagcctccagggaaggggctggagtgggtggccagcattaaccaagatcggacgtagaaaaatacctatgtggactctgtgaaggcgattcgcatcgtcagagacaacgccaagactcactgtggctgcacatgaacggctgagaggtacgacgacacggctgtgtaacttcgngtcgcgagaccgccccatcgacggactacgaggtcgggagctacggtacgttaggacgtacgtacggggaccaaggggtaaccctcggtacgtaaccggtccttaccgtcgacgcccgtaccgaaccgtaacgggtacccttaacgttacccggtaccctttacccccggtcggtaccctaaccccgtaccgtaacccgaaagtacgtaccgtaccgttccggtcggggacctaacgtacggccggtcccgtggacctcgtccgtaggtacaacggtcctaccgttccgacgtcgtacgtaccggacgtacggaaggccgggtcgtacggacgaacgggcgacgtagtacgnntacg

SEQ ID NO: 222272 - DNA, 551 bp, Homo sapiens
  misc_feature: GYAE6OF02GZDDS.38.4.A04.1.454.CMB.1.raw
  modified_base (326)..(326): a, c, t, g, unknown or other
  misc_feature (326)..(326): n is a, c, g, or t
  modified_base (542)..(542): a, c, t, g, unknown or other
  misc_feature (542)..(542): n is a, c, g, or t
  modified_base (548)..(549): a, c, t, g, unknown or other
  misc_feature (548)..(549): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtggganctacgacttgactacgtggggcagggaccctggtcaccgtctcctcagccctccaaccgaacgggcccacgtccggtcccttcccccgtcggccacccctcctacccaacgacgccacctcgtcggggccacgacgccgggccctgggcctcgccgtcggacaacggcctacttccacgtgacgtcgacgtggacggcgggctggacgaggccganagtagnncg

SEQ ID NO: 222273 - DNA, 639 bp, Homo sapiens
  misc_feature: GYAE6OF02I3W8M.38.4.A04.1.454.CMB.1.raw
  modified_base (221)..(221): a, c, t, g, unknown or other
  misc_feature (221)..(221): n is a, c, g, or t
  modified_base (289)..(289): a, c, t, g, unknown or other
  misc_feature (289)..(289): n is a, c, g, or t
  modified_base (481)..(481): a, c, t, g, unknown or other
  misc_feature (481)..(481): n is a, c, g, or t
  modified_base (638)..(638): a, c, t, g, unknown or other
  misc_feature (638)..(638): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatctatgtggactctgtgaagggccgattcgccatctcaganacaacgccaagactcactgtggctgcacatgaacgcctgagacggcgacgacacggctgtgtacttcngtgcgagacgccccacgtgacgggctacgaggtcgggagccttacgtactttggaacttaccggtggggacccaaggggtaaccctgggtaccaccggtctaccctacgacgtacccctccgaacccgaacgggccctaacgttcccgggtcctttccccccgtggccctacccctccctaccgaacggccnccaccgttcggcgggggtccaacgacggcccgggtcccggtcgggtaccgtcgcccgttcgggtaccggtaaacggtaccttaccgttaccgacggttacgagttaccggacgttcggaacggtcgggcgtcggacgtacgggcgactagtacggcng

SEQ ID NO: 222274 - DNA, 692 bp, Homo sapiens
  misc_feature: GYAE6OF02JVE6H.38.4.A04.1.454.CMB.1.raw
  modified_base (266)..(266): a, c, t, g, unknown or other
  misc_feature (266)..(266): n is a, c, g, or t
tcagtcgatcacgtcacgaccggtgctcgatttagagtagtgatcaggggcgtctcagagaggagccttagccctggactccaaggcctttccacttggtgatcagcactgagcacagaggactcaccatggaattgggctgagctgggttttccttgttgtctattttagaaggtgtccagtgtgaggtgcaactggtggagtcgtgggggaggcttgggtccaggccggggggtccctggagactctcctgtgcagcctctgcnttcacctttagtaactatttaatgacgtcgtgggtcccgccgacgccttccgaggggtaacggggctggggacggtggggtggccaggctaagttaaaccgaaggtctaggtacgtaaggaaaaaattccgttaagttaggtacggtaacttcgtagttacgggaaacggggtccgtaacgtttcggaccctaattccgtacccaaggtacgaactaaaccggccaaaaggaacctccaacgttcggtcgacctacggacaaccgtacgtaacggtaccgaccgttacggaggaacggggtcccgaaccgtaaccgcccggggacttcgggtacgttaccttcgttaggtcgggaacctacggaccggtacccccctaagtgggaacgggtcctaaccggtgggtacgggaccggtccttaaccgg

SEQ ID NO: 222275 - DNA, 555 bp, Homo sapiens
  misc_feature: GYAE6OF02FHRS3.38.4.A04.1.454.CMB.1.raw
  modified_base (553)..(555): a, c, t, g, unknown or other
  misc_feature (553)..(555): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtgggagctacgactttgactacgtggggccaggggaaccctggtcaccgtctcctcacgccctccaccaagggcccatcggtccttccccgtggccaccctccctaccaagacgccacctcgtcggggccacgacgccggcccgtgggctgccctcggtcgaaacggacctaccttccgaccgttcgactccggactggacggccggggccgttgggccgaacggcgcgatagnnn

SEQ ID NO: 222276 - DNA, 699 bp, Homo sapiens
  misc_feature: GYAE6OF02I5QYT.38.4.A04.1.454.CMB.1.raw
  modified_base (304)..(304): a, c, t, g, unknown or other
  misc_feature (304)..(304): n is a, c, g, or t
tcagtcgatcacgtcacgaccggtgctcgatttagagtagtgatcagggggggggtccctgagactctcctgtgcagcctctgcattcacctttagtaactatttaatgagctgggtcccgccagcctccgaggggaaggggctgggaggtggggtggccagcattaaaccaagatggacgtagaaaaatactatgtggactctggtgaacggggccgattcgccatctccagagacaacgccaaagaactcactgtggctgcacatgaacggcctgagaggcgacgacacggctgtgtacttntggtgcgagacgccccacgtggagggctacgaggtggggacgtcgtacgactttgacctacggtggggccacggggaacccttgggtaccctaccggtcctcccgtacacggtcccgttaccaaccggaacggggaccctacgtcccgggttaccctttccccccgtcggtaccctcccctcccgtacccgaacgacgccaccgtcggtacggggaccgtacaaccgggcccggtccccggtcggggacccgttccggtacccgttcgggttccgaaaaccgggttaccgttaaacccgtttcccgtacggttaccggacgtaccgtaccggttcgggacggtacccgggggtcgtaccgggcgaacggggtccgacgtaagacggtacgcgacg

SEQ ID NO: 222277 - DNA, 591 bp, Homo sapiens
  misc_feature: GYAE6OF02GN102.38.4.A04.1.454.CMB.1.raw
  modified_base (588)..(589): a, c, t, g, unknown or other
  misc_feature (588)..(589): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctgggagtgggtggccagcattaaccaagatggacgtgaaaaaatactatgtggactctgtgaagggccgattcgccatctccagagacaacgccaagaactcactgtggctgcacatgaacggcctgagaggcgacgacacggctgtgtacttctgtgcgagacgcccccagtggacgggctacgaggtgggagctacgacttttgactacgtggggccagggaaccctggtcaccgtctcctcacgccctcccaccgaacgggcccagtccggtccttccccctggcccaccctcctccaagcgccacctcgcggggccacgcggccggcccgtgggcctcggcccgtcgggtaccaaacgggtccttaccttcccgacggttgtacgttaccggtacgtcggacgggccgggacgtcgggaccgaacgggccggacctaagtacggcnncg

SEQ ID NO: 222278 - DNA, 801 bp, Homo sapiens
  misc_feature: GYAE6OF02HIOJY.38.4.A04.1.454.CMB.1.raw
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagtcgatcacgtcacgaccggtgctcgatttagagtagtgatcaggggggtcccgtgagactctcctgtgcagcctctgcattcacctttagtaactatttaatgagctggtccgccagcctccgagggaaggggctggagtcgggtggaccgagcaattaaccaagagtggacgtagaaaaaatactagtagtcggaactcgtgtaggaaacgggccgtagtttccgccgatccgtccaagagaacaaccgaccaagaaactcaaccgtgtacggctgccacgatgaacggcctaggagaggcgacgacgtacggctagtggtacttntcggtncggtacggaccgtccccaagtcggacgggtctacgacgtgggactcgtacgtactttaggacttcgtacgggggccaggggtaaccctcggtaccgtacccggtcttacccgtacgaccggtccctacccgtaaccggaaccggtacccgtacgtacccggttaccccggttacccccgttccgggtacccgacccgtttaccccgttcccggtaaaccggtaccgtacccgtaaccccgtttccgggtaccggggtaaccggacccgttaaacccggcccgggtacccgtccggggtcccgtccgggtacccgttacgggtacccgtaaacgggtaacccgttaacccggttacccgaccgttacggtaccgttaaccggtacccggttacgggtaccggtaccgggccggttaacccgggacgggttaccggacccggtaccgttacggtaacgcgtagcgg

SEQ ID NO: 222279 - DNA, 597 bp, Homo sapiens
  misc_feature: GYAE6OF02ICIL8.38.4.A04.1.454.CMB.1.raw
  modified_base (594)..(595): a, c, t, g, unknown or other
  misc_feature (594)..(595): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctgggagtgggtggccagcattaaccaagatggacgtagaaaaatactatgtggactctgtgaagggccattcgccatctcagagacacgcaagactcactgtggctgcacatgaacggcctgagaggcgacgacacggctgtgtacttctgtgcgagcgccccatgaggctacgagtgggagctacgtacttgactacgtggggaccacgggacctggtcaccgtctcctcacgccctccgaccacgggcccagtccggtccttccccctggccctaccctccctaccgaacgaccgccacccgtacggtcggggccacgacggcccggacccgtgggcctcggtccgtcgggtaccaaaggtacccttaccgttacccgacggttacgacgttaccgaccgttggaccgggtcgggccgttacgggaccgaacgggcgaccgtaagtacggtnncg

SEQ ID NO: 222280 - DNA, 628 bp, Homo sapiens
  misc_feature: GYAE6OF02HFXX9.38.4.A04.1.454.CMB.1.raw
  modified_base (625)..(625): a, c, t, g, unknown or other
  misc_feature (625)..(625): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaagggctggagtgggtggccagcattaaccaagatggacgtagaaaaatctaatgtggactctgtgaaggccattcgccatctcagagacaacgccaaagaactcactgtaggctgcacatggaacggctagagaggcaacgacacggctgtgtacttcgtgtgacgagaccgcccctaagtcggacgggcttaacgaggtcgggagtctaacgtaccttttggaacttacggtcgggggccaacgggtaaccctgggtaccaccgtcgtcctacacgccctacgaaccgaacgggccctacgtccggtccttcccccgtggccctacccgtacctaccaacgacgacctaccgtcgtacggggaccacgacggcccggccctgggtacctcgcctggtacaacgggtacctacgttccgacgttacgtagtaccgtcgtacggtacggccgggtcgtacgggaccgtaacgggacgaccgttaacgacggangag

SEQ ID NO: 222281 - DNA, 635 bp, Homo sapiens
  misc_feature: GYAE6OF02JGKXO.38.4.A04.1.454.CMB.1.raw
  modified_base (207)..(207): a, c, t, g, unknown or other
  misc_feature (207)..(207): n is a, c, g, or t
  modified_base (436)..(436): a, c, t, g, unknown or other
  misc_feature (436)..(436): n is a, c, g, or t
tcagtcgatcacgtcacgaccggtgctcgatttagagtagtgatcaggggggtccctgagactctcctgtgcagcctctgcattcacctttagtaactatttaatgagctggtccgccagcctccaggaaggggctggagtgggtggccagcattaacaagatggacgtgaaaatctatgtggactctgtgaaggcattcgccatcncagagacaacgccaagactcactgtggctgcacatgaacgcctgagacggcgacgactacggctggtacgtacttctggtgcgagcgcccccagtggacgggcttaccgagttggggacgctaacggcttttgacgtagtacgggggccaggggaaccctggtaccgaccgtcttccgacgacgccctacccgaacgacgggccccaagtcccggtcctttccccccgnggtccctaccctccgtaccaaacgcgcccaaccgttcgccggggtacaccgacgccggtacccgttggggccttaccgggccttgggtaccaacggggtacccttaacgttcccgaacggttcacgtttcggaccgtacgggtacgccgggggtaaccttgggaacccgtaagggccgtacaacgggtgccggatccgg

SEQ ID NO: 222282 - DNA, 598 bp, Homo sapiens
  misc_feature: GYAE6OF02GELW2.38.4.A04.1.454.CMB.1.raw
  modified_base (596)..(598): a, c, t, g, unknown or other
  misc_feature (596)..(598): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtagaaaaaatactatgtggactctgtgaagggccattcgccatctccagagacaacgccaaagaactcactgtggctgcacatgaacggcctgagaggcgacgacacggctgtgtacttctgtgcgagacgcccccagtggacgggctacgaggtgggagctacgactttgactacgtcggggccacgggaccctggtcaccgtctcctcacgccctccaccgaacgggcccacgtccggttcccttcccccgtcggccctaccctccctaccgaacgaccgccacccgtcggtcgggggccaccgacggcccgggtcccgtcgggccgtcggtcccgttcgggtaccgaacggtaccttaccgttccgacgtcgtacgtcgacgtggacggccggggtcgtcggacgacgggccgcgagtacggnnn

SEQ ID NO: 222283 - DNA, 557 bp, Homo sapiens
  misc_feature: GYAE6OF02F233E.38.4.A04.1.454.CMB.1.raw
  modified_base (119)..(119): a, c, t, g, unknown or other
  misc_feature (119)..(119): n is a, c, g, or t
  modified_base (218)..(218): a, c, t, g, unknown or other
  misc_feature (218)..(218): n is a, c, g, or t
  modified_base (326)..(326): a, c, t, g, unknown or other
  misc_feature (326)..(326): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagtcgatcacgtcacgaccggtgctcgatttagagtagtgatcagggggggtccctggagactctcctgtgcagcctctgcattcacctttagtaactatttaatgagctgggtccnccagcctccagggaagggctggagtgggtggccagcattaaccaagatggacgtgaaaaatctatgtgactctgtgagggccattcgccatcctccagngacaacgccaagactcactgtggctgcacatgaacggcctagagaggcgacgacacggctgtcgtacttctgtgcgagacgccccagtggagggcctagagtgggacnctacgtactttgactacgtgggggaccacggggaaccctggtccaccgtctcctcacgcctaccacgacggccatcgtcctcccgngccncctcctacacgacgtcaccgtcgtcggggcacgacgccggccgtgggctcgtccgtcggtacgacggtaccgttacttccgacgtagacgtcgacgtggacggcgggtcgtgggaccgtaacggcgacgtacgcgtgactg

SEQ ID NO: 222284 - DNA, 591 bp, Homo sapiens
  misc_feature: GYAE6OF02F3IAS.38.4.A04.1.454.CMB.1.raw
  modified_base (295)..(295): a, c, t, g, unknown or other
  misc_feature (295)..(295): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgngcgagacgcccccagtggagggctacgaggtgggagctacgtactttgactacgtcgggggccacgggtaacccgtggtccaccgtctcctcacgccctccaaccgacggccctacgtccggtcccttcccccgtcggccctaccctccctacccgaacgaccgccgtaccctcggttcgggggccacgacggccgggcccgtgggcctgccgtggtaccgaacggtaccttaccttccacgtcgacgttacgacgtggacggcggtcgtcggacgacggcgacgagtacgngnng

SEQ ID NO: 222285 - DNA, 756 bp, Homo sapiens
  misc_feature: GYAE6OF02JEL55.38.4.A04.1.454.CMB.1.raw
  modified_base (216)..(216): a, c, t, g, unknown or other
  misc_feature (216)..(216): n is a, c, g, or t
tcagtcgatcacgtcacgaccggtgctcgatttagagtagtgatcaggggggtcccgtgagactctcctgtgcagcctctgcattcacctttagtaactatttaatgagactggtccacagcctccagggaagggctggagtgggtggccagtcattaaccaagatggactgaaaaatctatgtggactctgtgaaggccattcgcatctccaganacaacgcaagactcactgtgctgcacatgaacgcctgacgaggcacgacacggcttaggtcgtactttcgtggtcgcgagtacgcccccgtagtgacgggcttacgaggtgggagcctaacgatttcgacgttactcgggggaccacggggtaaaccctggtactaaccccgttcttaccccgttagaaccggtcccctttacccggaaacccgtaacggggtaccccaacggtttacccgggtccccgttttaccccccggttacgggtaccctaccccgttacccgttaacccgtaaccggtaccggtaccctaacccgttcccggttacggggggacccttaaccgaccggtcccggtaccccggttcggggcccgttaccggtacccgttcgggtaaccggtaaaccgggttaaccctttaccggttaccccgtaggttaccggtaccgttccggtaacgttcggggaaccgtccggggttaccggtacgggtacccgtaaacggggccggtaccgtaacggtacggacgtgaccg

SEQ ID NO: 222286 - DNA, 567 bp, Homo sapiens
  misc_feature: GYAE6OF02I8YTN.38.4.A04.1.454.CMB.1.raw
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggactggagtgggtggccagcattaaccaagatggacgtgaaaaatctatgtggactctgtgaagggccattcgccatctccagagacaacgccaagaactcactgtggctgcacatgaacggtctgagaggccgacgacacggctgtgtacttctgtgcgagacgcccccagtgagggctacgagtgggagctacgactttgactacgtggggccaggggaaccctggtccaccggtcctcctcacgtccctccaccgaacgggcccagttccgggtcctttccccccgtggtcccacccttcctccgaacgacgcctacctcgtcggggccacgacgccggccgtgggctcgccgtggtcaacgggtactaccttccgacgttcgactcggactggacggcggcgtaggacgaggccgcacgtagntancg

SEQ ID NO: 222287 - DNA, 575 bp, Homo sapiens
  misc_feature: GYAE6OF02GSHHS.38.4.A04.1.454.CMB.1.raw
  modified_base (320)..(320): a, c, t, g, unknown or other
  misc_feature (320)..(320): n is a, c, g, or t
  modified_base (571)..(571): a, c, t, g, unknown or other
  misc_feature (571)..(571): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccagatggactgaaaaatctatgtggactctgtgaagggcccgattcgccatctccagagacacgccagactcactgtggctgcacatgaacggcctggagaggcgacgacacggctgtgtacttctgtagcgagacgccccactgagggctacagtggganctacgacttttgacttacgtggggccaggggaaccctggtcaccggtctccgtcagtccctccacgaacgggcccacgtcggtccttacccccgtcggccctacctcccgtccagacgtcacccgttcgcggggtccacaggccggccgttcgggcgtcggccttggtaccgtaacgaccttacttcccgagttcgacgtcgtacgcggtacggcgggccgttcggacgaaggtccgggacctaaggagtnagtc

SEQ ID NO: 222288 - DNA, 680 bp, Homo sapiens
  misc_feature: GYAE6OF02ICVF9.38.4.A04.1.454.CMB.1.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
tcagtcgatcacgtcacgaccggtgctcgatttagagtagtgatcagggggtccctgagactctcctgtgcagcctctgcattcacctttagtaactatttaatgagctggtccgccagcctccagggaagggctggagtgggtgccagcattaaccaagatggacgtgaaaaatctatgtggactctgtagaagggccattcgccatctccagngacaagccaaagactcacgtgtggctgcacatgaacggcctgagaggcgacganacgctggtgtacttcgtgtgcgagaccgcccccagttgaggggcttacgagtgggacgcttaccggacttttcgacttacgtcggggaccacgggaaacccttgggtccacgtctacccntaacgccctccaaccgaacgggcccacgtccggtcctttccccccgtgggtcccacccttcccgttcccgaaacgtacgccgtaacccgtccgttccgggggaccgaccgacgggcccgggtccccgttggggacccgttcgggccccgttagggtacccgtaaacggggaaccctttaacccgtttcccgaaccgggttaccgacgttaccggaaccgtttcgggaacggtccgggggtcccgtttaacgggcccgttaaggggcccgaccgtaaggttaccgcgctacg

SEQ ID NO: 222289 - DNA, 605 bp, Homo sapiens
  misc_feature: GYAE6OF02I7S17.38.4.A04.1.454.CMB.1.raw
  modified_base (244)..(244): a, c, t, g, unknown or other
  misc_feature (244)..(244): n is a, c, g, or t
  modified_base (600)..(601): a, c, t, g, unknown or other
  misc_feature (600)..(601): n is a, c, g, or t
tcagtcgatcacgtcacgaccggtgctcgatttagagtagtgatcagggggggtccctgagactctcctgtgcagcctctgcattcacctttagtaactatttaatgagcgtgggtccgccagcctccgagggaaggggctggagtgggtggccagcattaaccaagatggacgtgaaaaatactatgtggactctgtgaagggccattcgccatctccagagacaacgccaaagactcactgngctgcacatgaacggcctggagaggcgacgacacggctgtgtacttctgtgcgagacgccccagtgagggcctacgaggtgggagtctacgtactttcgactacgtggggaccagggtaaccctggtacaccgttcctcctacgtacgcctacccgaacgaacgggccctacgttccggtcccttcccccgtgtacccgacccttccctaccgaacgacgccgtacccgtcggtcgggggaccaccgacggccgggcccgtcggctcgccgtcggtacgaacggtacctacgttccgacgttacgacttcggacgtggaccggcgggtcgtaggccgaagggccgacgaagtaggnngtcg

SEQ ID NO: 222290 - DNA, 580 bp, Homo sapiens
  misc_feature: GYAE6OF02GN1IF.38.4.A04.1.454.CMB.1.raw
  modified_base (578)..(578): a, c, t, g, unknown or other
  misc_feature (578)..(578): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccgattcgccatctccagagacacgccaagaactcactgtgctgcacatgaacgcctgagaggcgacgacacggctgtgtacttctgtgcgagacgcccccatgagggctacgagtgggagctaacgtactttgacttacgtcggggcacgggaacccctggtacaccggtctcctcgacgtccctaccaaccgtaacgggccctacgtccggtccttcccccgtgcccaccctccctaccaacgacgcctacctcggtcggggccacgagcccggccgtcggcgtcgcctcggtaccacgggtacctaccgttccaacgttcgactcgacgtcggacggccgggcgtcggacgaacggtccgacgtaagcgtgancg

SEQ ID NO: 222291 - DNA, 588 bp, Homo sapiens
  misc_feature: GYAE6OF02FRM9A.38.4.A04.1.454.CMB.1.raw
  modified_base (584)..(584): a, c, t, g, unknown or other
  misc_feature (584)..(584): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtgaccagcattaaccaagatggacgtgaaaaatctatgtggactctgtgaagggccattcgccatctccagagacaacgccaaagaactcactgtggctgcacatgaacggcctgagaggcgacgacacggctgtgtacttctgtgcgagacgcccccatgagggctacgagtgggagctacgactttgactacgtggggccagggaaccctggtcaccgtctcctcacgccctccaaccgacggcccagtccggtccttcccccgtggccaccctcctaccaacgacgccaccgtcgtcggggccacgacggccggcccgtgggcctcggtccgtcggtaccgaaacggtaccttaaccttcccgaccgttgacgttccggacgttggacggccggggtccgtacgggaccgtaacgggccgtacgacgtacggncgag

SEQ ID NO: 222292 - DNA, 575 bp, Homo sapiens
  misc_feature: GYAE6OF02FU0ZJ.38.4.A04.1.454.CMB.1.raw
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccgattcgccatctccagagacaacgccaaagaactcactgtggctgcacatgaacggcctgagaggcgacgacacggctgtgtacttctgtgcgagacgcccccatgagggctacaggtgggagctacgactttgactacgtggggccacgggaaccctggtccaccgtcctcctcacgccctccaaccgaacgggcccactccggtcccttcccccgtcggccctacccctccctacccaacgacgccacctcgtcgggggcacgacgccggcccgtgggctcgccgtcggtcgaacggactaccgttccgacgtcgactacgacgtcggacggccgggtcgtcgggacgaacgggcgccgagtacgngnc

SEQ ID NO: 222293 - DNA, 644 bp, Homo sapiens
  misc_feature: GYAE6OF02GY1DY.38.4.A04.1.454.CMB.1.raw
  modified_base (193)..(193): a, c, t, g, unknown or other
  misc_feature (193)..(193): n is a, c, g, or t
  modified_base (271)..(271): a, c, t, g, unknown or other
  misc_feature (271)..(271): n is a, c, g, or t
  modified_base (643)..(643): a, c, t, g, unknown or other
  misc_feature (643)..(643): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactntgtgaagggccattcgcatctcagagacaacgccaagaactcactgtgctgcacatgaacggctgagaggcgacgacncggctgtcgtacttcgtgtgcgagaccgccccagtggacggctaacgaggtgggacgcgtaacgtactttcggaaccttacggtcggggaccaacggggtaacccgttcggtaccaccgttctaccctcgacgccctaccacccgaacgggcccacgttcccggtccccttcccccgtccggtacccctaccccttccctacccgaacgaccgaccctacccgtccggttcggggaccaccgaccggcccgggtcccgtcgggcctcggtccgtcggtacgaacggtacctaccgttaccgacgtacgacgtaccgacgtcggacggaccgggtcgtacggaccggaacgggccgtacgtaacgtacgagtng

SEQ ID NO: 222294 - DNA, 478 bp, Homo sapiens
  misc_feature: GYAE6OF02ILDQF.38.4.A04.1.454.CMB.1.raw
  modified_base (338)..(338): a, c, t, g, unknown or other
  misc_feature (338)..(338): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (458)..(458): a, c, t, g, unknown or other
  misc_feature (458)..(458): n is a, c, g, or t
  modified_base (477)..(478): a, c, t, g, unknown or other
  misc_feature (477)..(478): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccatgaggctacagtgggagctacgtactttgactagngggccaggaacctggcacgtctctcagcctccacacggccatcgtctcccctgccacctcncagncactcgangncagcgccnggctgctgcaggctactcacgtgatcgactgagcggntggcaaggtcgacagtagnn

SEQ ID NO: 222295 - DNA, 820 bp, Homo sapiens
  misc_feature: GYAE6OF02HVAO9.38.4.A04.1.454.CMB.1.raw
  modified_base (816)..(816): a, c, t, g, unknown or other
  misc_feature (816)..(816): n is a, c, g, or t
  modified_base (819)..(819): a, c, t, g, unknown or other
  misc_feature (819)..(819): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccaggggaaggggctgggagtgggtggccagcaattaaccaagatggacgtagaaaaatactatgtggactctgtgaagggccattcgccatctccagagacaacgccaagaactcactgtggctgacacatgaacggcctagagaggcgacgacgacggtctgtgtacttcgtgtgcgagaccgacccccagtacggacgggctaacgagggtggggagtaccgtaaccggttaacgttttacgaaccgttacggtcggggggacccgtaacgggggtaaaccccgttgggtacccgtaccccggtccttaccccgtacccgaccggtacccccttacccgaacccggaaccggggtacccctaaccggttaccccgggtttccccgttttacccccccgtccgggtacccctacccccgtttacccctaaccccggaaaccggaccggtacccctaacccccggttccgggtacccggggggaccctaaccggaccgggtcccccggggtaccccggttcggggaccgttcccggtacccgggttacgggttacccgtaaaccggggttaaccctttaaccccggttaaccccgttaaccggttaccggacgtttacccggtaaccggttcgggaaccggggccgggtacggttccgggaacgtacggggaccgtaccgaagttacggnagng

SEQ ID NO: 222296 - DNA, 549 bp, Homo sapiens
  misc_feature: GYAE6OF02FFJ7D.38.4.A04.1.454.CMB.1.raw
  modified_base (521)..(521): a, c, t, g, unknown or other
  misc_feature (521)..(521): n is a, c, g, or t
  modified_base (547)..(549): a, c, t, g, unknown or other
  misc_feature (547)..(549): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcagagccccatgagggctacagtgggagctacgacttttgactacgtggggccaggggaaccctggtcaccgtctcctcagccctccaccaacgggcccagtccggtcttcccccgtggccaccctccctacccaacgacgccaaccgtccgtcgggggccacgacggccggcccgtgggcctcggccgtggtcaaacgggacctacgttccacgtcgatcgacgtcgngccgggctcggcacggcgcagtacgnnn

SEQ ID NO: 222297 - DNA, 620 bp, Homo sapiens
  misc_feature: GYAE6OF02GZ9Y4.38.4.A04.1.454.CMB.1.raw
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
  modified_base (343)..(343): a, c, t, g, unknown or other
  misc_feature (343)..(343): n is a, c, g, or t
  modified_base (618)..(618): a, c, t, g, unknown or other
  misc_feature (618)..(618): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaaggccgattcgcatctcaganacaacgccaagaactcactgtggctgcanatgaacgctgagaggcacgacacggctgtgtacttctgtgcgagacgcccccatggaggctacgaggtgggacgcctacgtactttcgaacttacgnggggccaacgggaacccttggtccaccgttctcctcgacgtccctccaaccgaacggacccacgtccggttcccttccccgtcggccctaccctccctaccgaacgcgccgtacctccggtcggggacacgacgcccggccgttcgggaccgtcggccgttcggtacgtaacggacctttaacccgtaccgtacggtacgtacgttaccggacgtacgggtaccggcgggtccgttaccgggaccgtaacgggccggaccgttaacgttaggcancg

SEQ ID NO: 222298 - DNA, 671 bp, Homo sapiens
  misc_feature: GYAE6OF02FXBYT.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtgccagcattaaccaagatggacgtagaaaaatctatgtgactctgtgaaggcctattcgccatctcagagacaacgccaaagactcactgtcggctgccacagtagaacggtcctagaggaggacgacgacgacggtctgtcgtacttcgtgtcgacgacgaccgccccagtcggacggtcgtacgaggtggacgtcgtacgtacgtttagaccgtacggtcgggaccgtacgggtaaccgtcggtacctaccgttccgtaccgtacgtaccgtcccgtacccgaccgaacgggtccctagttcccggttccccttcccccgtacggtaccctacccgtacccgtaccgaacgacgacctacccgtacggtacgggaccacgtacggcccggtacccgtgggtccgtcggtccgttacggacgtacgtaaccgttaccgtactaccgtacgtacgtaccgtacggtacggtacggtacgggtccggtacgtaccggacggacggtaccgacgtacggtatgcg

SEQ ID NO: 222299 - DNA, 536 bp, Homo sapiens
  misc_feature: GYAE6OF02FSJKS.38.4.A04.1.454.CMB.1.raw
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (523)..(527): a, c, t, g, unknown or other
  misc_feature (523)..(527): n is a, c, g, or t
  modified_base (529)..(536): a, c, t, g, unknown or other
  misc_feature (529)..(536): n is a, c, g, or t
tcagtcgatcacgtcacgaccggtgctcgatttagagtagtgatcagggggggggtccctgagactctcctgtgcagcctctgcattcacctttagcagctatgccatgagctgggtccgccaggctccagggacgggtctggagtgggtctcacttatcagtaatagtggtggtaccacattcgacgcagactccgtgaagggccggttcaccatctccagagacaatccaaagaacacactatacctgacaaatgaagaccctgagagccgaggacacggccatatattactgtgtgaaaggggcacggggtgactccgnggggccagggaaccctggtccaccgtcncctcagcctccaccaacgggcccaagtccggtccttccccctggccacccctcctaccaagacgcaacccgtcgtcgggggcacgacgccgggccctgggtctcgcctgggtaccaaaggacctacttccgacgtgacgtcgacgtgacgcggcgtggacgaggcgcgatagnnnnngnnnnnnnn

SEQ ID NO: 222300 - DNA, 865 bp, Homo sapiens
  misc_feature: GYAE6OF02F999G.38.4.A04.1.454.CMB.1.raw
tcagtcgatcacgtcacgaccggtgctcgatttagagtagtgatcaggggctcgtcagagaggacgccttagccctggactccaaggcctttccacttggtgatcagcactgagcacagaggactcaccatggaattggggctgagcttgggttttccttgttgctatttagaagtgtcagtgtgaggtgcaacgtggtggagtcgtgggggagtcgttggtccaggccgggggggtccctggacgactctccgtgtcgcgacgcctcgtgcctagttccaaccgttttaacgtaaccgttaagttttaaagtggtaacggtccgttacggggttccccgaccgtacggtacccccgttaccggaaacggggggtaaacgggggtcccgttagggggtaacgggttcggggggttacgggacccgtaacgggtaacccttaaacgtttaaaaacccggaaaaggtaacggttaccggggtaaaaccggttaaagtaaaaaaaacttacgtttaaacgtttacgggttaacgggttaacccttaccgttaggttaaacgggaacggggttaccgtacgttttacccggacctacgttaccgttaccgaagaacggaaacccgtaaaccggacccgtaaaacgaacccgtttaccgaccgtttacggtacgggtaccctttacggaccctaaccgtaaggttaaccgggaaaccgggtcccgtaagggtaaccggacggggtaccgggtaaccgaaccggtaccggtaccgttaggtacgtttacgttacgttggtcggtacgggacgtacccgggacccctaggtcggaacgggtccgtacggaggtacgggactaccgtaaccgg

SEQ ID NO: 222301 - DNA, 667 bp, Homo sapiens
  misc_feature: GYAE6OF02G2GWS.38.4.A04.1.454.CMB.1.raw
  modified_base (337)..(337): a, c, t, g, unknown or other
  misc_feature (337)..(337): n is a, c, g, or t
  modified_base (662)..(662): a, c, t, g, unknown or other
  misc_feature (662)..(662): n is a, c, g, or t
tcagtcgatcacgtcacgaccggtgctcgatttagagtagtgatcaggggggggtccctgagactctcctgtgcagcctctgcattcacctttagtaactatttaatgagctgggtcccgccagccctccgagggaaggggctgggagtggggtggccagcaattaaccaagatggacgtagaaaaatactatgtggactctgtgaagggccattcgccatctccagagacaacgccaagaactcactgtggctgcacagtagaaccggcctggagacggcgacgacacggctggtgtacttctgtgcgagaccgcccccagtggacgggctaacgnggtgggagcctacgtacttgacttacggcgggccgacgggaaccctggtccaccgttctccctacacgccctacccgaaccgtaccgggccctacgtcccggttccccttcccccgtcggtccccaaccccttccctacccgaaagaccgcctacccgtccggtcggggaccacggaccgcccgggtcccgtggggtccctcgggacccgttcggtaccgaaaccgggttaccttacccgttaccgtaccgtagtacgttccggacggtcgggaacgggcccgggtcgtacggggtaccgaacggggtcccgacgtaaggtacgntcgtc

SEQ ID NO: 222302 - DNA, 702 bp, Homo sapiens
  misc_feature: GYAE6OF02H28C7.38.4.A04.1.454.CMB.1.raw
  modified_base (80)..(80): a, c, t, g, unknown or other
  misc_feature (80)..(80): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
tcagtcgatcacgtcacgaccggtgctcgatttagagtagtgatcgaggggggtccctgagactctccgtgtgcagcctntgcattcacctttagtaactatttaatgagctggtccgccagcctccgagggaagggctggagtggtggccagcattaaccaagatggacgtagaaaaatactatggtggactctgtggaaggccgattcgcatctcagagacaacgcaagaactcacgtgtggctgaccaacatgaaaccggctagagaaggcgacgacgacggctgtgtacttcngtgcgagacgccccagtgacggcctacgaggtgganctacgtactttgaactaccgtggggaccaggaaccgnggtacaccgtcctacctcgaccgtcctaccgtaacccgaacggggtacccacggttacccggtccccgttttacccccgccgggtacccgtaccccgttacccgttaacccgaaagtaccggacccgtaacccgtttccggtacgggggacctaacggtaccggaccgggcccgttcgggtaccttcggacccggttacgggtaccgaaacgggtacccttaaaccgttacccgtacggttacgtaccgtaaccggttaccgtacgggaacccgcggggtaccgttacgggaccggtaacgggtacccggacgtaacgttcggacgtagccc

SEQ ID NO: 222303 - DNA, 793 bp, Homo sapiens
  misc_feature: GYAE6OF02HWXFG.38.4.A04.1.454.CMB.1.raw
  modified_base (788)..(788): a, c, t, g, unknown or other
  misc_feature (788)..(788): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgccatcctacagacgacaaccgaccaagaactcactggtgctcgacacagtacggaaccggcgtagaggaggaccggaccgacgacggtcgttgtacgttacgttcgtgtcggacggacgacccgaccccctagtcggacgggtactacgagggtagggacgtaccgtaacgttacgtttacggaacgttacggtacggggaccgtaaccgggtaacccgttcggtacccgtacccgtcctaccctaccgaccgtcccctacccgaacccggaccggtacccttaccggttacccggttcccccgtttcccccggtccggaccccttaccccttaccccgtaacccgtaacggacctacccgttaccccggttacggggtaccgggggaccctaaccgggacccgggtccccgggtacccgggttccgggacccgttccgggtacccggtttacgggtaaccgtaaaccgggtaaccctttaccgttacccgacggttacgtacccgtaccggtacggtaacgggaccgggtcgggtccggtacgggaaccggaccggtaccggtacgaagtcgagngtacg

SEQ ID NO: 222304 - DNA, 560 bp, Homo sapiens
  misc_feature: GYAE6OF02FJSM4.38.4.A04.1.454.CMB.1.raw
  modified_base (558)..(559): a, c, t, g, unknown or other
  misc_feature (558)..(559): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacgagtgggagctacgactttgactacgtggggccaacggggaaccctggtccaccgtctcctcacgcctccaccgaacgggcccagtccggtccttccccccgtggcccaccctcctaccaagacgcacccgtcgtcggggccacgacgccggcccgtgggcctcgccttggtccaagggccttacgttcccacgtgtacgtcgactggaggccgggctggccgaacgggcgacgtagagtnnc

SEQ ID NO: 222305 - DNA, 575 bp, Homo sapiens
  misc_feature: GYAE6OF02FIG6Q.38.4.A04.1.454.CMB.1.raw
  modified_base (324)..(324): a, c, t, g, unknown or other
  misc_feature (324)..(324): n is a, c, g, or t
  modified_base (573)..(573): a, c, t, g, unknown or other
  misc_feature (573)..(573): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaaatctatgtggactctgtgaagggccattcgccatctccagagacaacgccaagactcactgtgctgcacatgaacgcctgagaggcgacgacacggctgtgtacttcgtgtgcgagacgcccccagtgagggctacgaggtggganctacgactttgactagtggggccagggaaccctggcaccgtctcctcacgccctccacacggcccagtcggtccttcccccgtggccctaccctcctcccaagacgacctacccgtcgtcggggaccacgacggccggacccgtgggcctcggtcccgtggtaccgtaacgggaccttaccttccacgttgactcggacgtggacggccgggtcgtacgggaccgtaacgggccgacgtagtacggtgncg

SEQ ID NO: 222306 - DNA, 745 bp, Homo sapiens
  misc_feature: GYAE6OF02FM3PW.38.4.A04.1.454.CMB.1.raw
  modified_base (288)..(288): a, c, t, g, unknown or other
  misc_feature (288)..(288): n is a, c, g, or t
  modified_base (327)..(327): a, c, t, g, unknown or other
  misc_feature (327)..(327): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaaggccattcgccatctccagagacaacgccaagactcactgtggctgcanatgaccgctggagaggcgacgacacggctgtgtacttcngtgcgagaccgcccccatagggagggcctacgagggttgggaacgtcgtaaccgttagttttacggaacctttaccgggtgggggacccgtaaccggggtaaaccccggttcgggttacccgtaccccggtttacccgttacccgtccgtaccgtccccttaccccgaacccggtaacccggggtaccccgtaaccgttcccgggttaccccgtttcccccgtcggtacccctaacccccgttccctaccccgaaacggtaccgtaccctacccgttccgggttaccgggggacccgaaccggtaccgggcccggtaccccgggtcgggtaccgtccggtcccggttcgggtaaccggtaacggttacccgttacccgtttaccgaccggttcgtaccgttaccggtaccgtacgggg

SEQ ID NO: 222307 - DNA, 602 bp, Homo sapiens
  misc_feature: GYAE6OF02HCL9E.38.4.A04.1.454.CMB.1.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (599)..(600): a, c, t, g, unknown or other
  misc_feature (599)..(600): n is a, c, g, or t
  modified_base (602)..(602): a, c, t, g, unknown or other
  misc_feature (602)..(602): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaaccaagatggacgtgaaaaatactatgtggactctgtgaagggccgattcgccatctccagagacaacgccaaagaactcactgtggctgcacatgaacggcctgagaggcgacgacacggctgtntacttcngtgcgagacgcccccactgaggctacaggtgggancgtacgactttgactacgtggggcacgggaaccttggcaccgtctcctcacgccctcaaccgacggcccagtccggtccttcccccgtcggccaccctcctccaaacgacgccaacccgtcggttcggggctaccgacggaccggcccgtcgggccgttcgcccgttgggtacccgaaaggggtaccttaaccgttacccgtaggttacgacgtaccggaccgtggaacggccggggacgtggtaccggaagggcccgtatacggtacggnngn

SEQ ID NO: 222308 - DNA, 638 bp, Homo sapiens
  misc_feature: GYAE6OF02FFZGO.38.4.A04.1.454.CMB.1.raw
  modified_base (118)..(118): a, c, t, g, unknown or other
  misc_feature (118)..(118): n is a, c, g, or t
  modified_base (446)..(446): a, c, t, g, unknown or other
  misc_feature (446)..(446): n is a, c, g, or t
  modified_base (632)..(632): a, c, t, g, unknown or other
  misc_feature (632)..(632): n is a, c, g, or t
tcagtcgatcacgtcacgaccggtgctcgatttagagtagtgatcagggggggtccctgagactctcctgtgcagcctctgcattcacctttagtaactatttaatgagctgggtccnccagccctccagggaagggctggagtgggtgccagcattaaccaagatggacgtgaaaaatctatgtggactctgtgaagggccattcgccatctccagagacaacgccaaagaactcactgtggctgcacatgaacgcctgagaggcgacgacacggctgtgtactctgtgcgagacgcccccagtgacgggcctacgaggtggggacgccgtacgtacgtttcgaccgtacgtcgggggacccaaggggtaacccctggtcctaaccggtcctcccgtacacgccctacccaaccgacgggcccagtcccggttcccttcccccgnggcccacccctcctaccgaagtaccgccaccgtcggtcggggacctacgacggcccgggtcccgttagggccgttcggtcccgttagggtacctaacgggtaccttaccgtttacccgacggttagtacgtaccggacgttcggaacggtccgggcgtacgggacgtaacgggccacgtagtacgntagacg

SEQ ID NO: 222309 - DNA, 760 bp, Homo sapiens
  misc_feature: GYAE6OF02GOKYA.38.4.A04.1.454.CMB.1.raw
  modified_base (252)..(252): a, c, t, g, unknown or other
  misc_feature (252)..(252): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccgagggagggctggagtgggtgccagcattaaccagatggacgtagaaaaatctatgtgactctgtgaaggccattcgccatcnccagagacaacgccaagactcactgtgctgcacatgaacgctgagaggcgacgacgacggctgtcgtacttcgtgtgacgtagaccgcccccagtggacgggtcctaacgagggtgggacgcgtaacggtactttggaacgttaccggtcggggacccgaacggggtaacccgttgggtcccgtaaccggttcccttacccgtcgaccgtccctacccgaacccggaacgggtaccctacggttcccggttcccttcccccggtacgggtcccctaacccccgttcccgtaacccgaacggtaccgtcccgtaacccgtttccggggtaccgggggaccctaaaccgggacccgggtccccggggtcccccgggttacgggggtccccgtttaaccgggccccggggttacggggttaaccccggtaaaaccggggttacccctttaacccggttaccccggtaaccgggttaacggtaaccggtttcccgaaccggttacccggggg

SEQ ID NO: 222310 - DNA, 557 bp, Homo sapiens
  misc_feature: GYAE6OF02ICJY4.38.4.A04.1.454.CMB.1.raw
  modified_base (420)..(420): a, c, t, g, unknown or other
  misc_feature (420)..(420): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccgattcgccatctccagagacaacgccaagaactcactgtggctgcacatgaacgctgagaggcgacgacacggctgtgtacttcgtgtgcgagacgccccagtggaggctacgaggtgggacgtctacgtactttgactacgtcggggaccgacgggacctggtcaccgtctcctcgacgccctacgaccgacggccacgtccgtccttccccgngccaccctcacaacgcgcaccgtcgcgggcacgcgccggccgtggctcgccgtggtaccgaacgtacctacgttccgacgtcgacgtacgacgtggacggtccgggcgtaggaccgtacggcgaccgagtacgngnc

SEQ ID NO: 222311 - DNA, 594 bp, Homo sapiens
  misc_feature: GYAE6OF02HDQIS.38.4.A04.1.454.CMB.1.raw
  modified_base (592)..(594): a, c, t, g, unknown or other
  misc_feature (592)..(594): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctgggagtgggtggccagcattaaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgaggtgggagctacgactttgactacgtggggccacgggaaccctggtccaccggtctcctcgacgccctaccgaccgaacgggcccagtcccggttccttcccccgtcggccctacccgtccctacccaacgcgaccacccgtcggtcgggggccacgacggcccggcccgtgggcctcggccgtcgggtaccaaacgggtccttaccgttcccgacgtcgactccgacgtcggacggcgggcgtcgggacgacgggccgacgagtacgnnn

SEQ ID NO: 222312 - DNA, 608 bp, Homo sapiens
  misc_feature: GYAE6OF02FGO8G.38.4.A04.1.454.CMB.1.raw
  modified_base (340)..(340): a, c, t, g, unknown or other
  misc_feature (340)..(340): n is a, c, g, or t
tcagtcgatcacgtcacgaccggtgctcgatttagagtagtgatcgtagggggggggtccctgagactctcctgtgcgagcctctgcattcacctttagtaactatttaatgagctgggtccgccagcctccaggggaagggctggagtgggtggccagctattaaccaagatgggacgtagaaaaatctatggtggactctgtgaagggccgattcgccatctccagacgacaacgccaagactcactgtggctgcacatgaacggcctgagaggcgacgacacggctgtgtacttctgtcgcgagacgtcccccagtgacgggctacgaggtgggacnctacgactttgactacgtggggccaggggacctggtacaccgtctcctcacgccctaccaccgacggcccagtccggtccttcccccgtggcccacccttcctacccaacgagcctacgtcgtcggggcacgacgccggtcccgtgggcctcgtccgttcggtacgaacggtacctacgttccgacggtacgtacgtacggtacgtacggacgggtccggggtaccgtacgggaccgaaccgggcgtaccgtaagttcggactgtacg

SEQ ID NO: 222313 - DNA, 595 bp, Homo sapiens
  misc_feature: GYAE6OF02G1XLD.38.4.A04.1.454.CMB.1.raw
  modified_base (333)..(333): a, c, t, g, unknown or other
  misc_feature (333)..(333): n is a, c, g, or t
  modified_base (592)..(593): a, c, t, g, unknown or other
  misc_feature (592)..(593): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacacgccaagaactcactgtggctgcacatgaacggcctgagaggcgacgacacggctgtcgtacttctggtgcgagaccgccccagtcggacggctacgaggtgggacnctacgtacttgactacgtcggggcaacgggacctggtcaccgtcctcctcacgcctaccaccgaacggccctacgtccggtcccttccccctcgggccctaccctccctaccaacgcgaccaccgtccggtcggggccacggaccggcccggtacccgtcgggccgtcggtcccgttacggtacgaaacggtaccttaccgtccgacgtgtatccgtacgtggacgggcggcgtacggacgacggccgacgtagtagcnncg

SEQ ID NO: 222314 - DNA, 663 bp, Homo sapiens
  misc_feature: GYAE6OF02GTLHX.38.4.A04.1.454.CMB.1.raw
  modified_base (658)..(658): a, c, t, g, unknown or other
  misc_feature (658)..(658): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggctgagaggcgacgacgacggctgtgtacttctgtgcgagaccgccccagtggacgggctacgaggtgggacgcgtacgtacttgactacggtcggggccgacgggaaccgtcggtccaccgtcctccgtcacgtccctccaaccgaacgggccctacgttcccggttcccttcccccgtcggccctaccctccctaccgaacgccgccgacccgttccgggtacggggcctaccgaccggcccgggtacccggtcggggtccctcgggtacccgttcgggtacccgtaaacgggtaccctttacccgttaacccgtcgttacgtaccgttaccggtaccggtgggaccgggtcccgggtacggtacgggaccggtacggccgtacgtacgtaggcngtacg

SEQ ID NO: 222315 - DNA, 609 bp, Homo sapiens
  misc_feature: GYAE6OF02I5WPR.38.4.A04.1.454.CMB.1.raw
  modified_base (581)..(581): a, c, t, g, unknown or other
  misc_feature (581)..(581): n is a, c, g, or t
  modified_base (607)..(607): a, c, t, g, unknown or other
  misc_feature (607)..(607): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaacctcactgtggctgcacatgaacggcctgagaggcgacgacacggctgtgtacttctgtgcgacggacgcccccatggacgggctacgaggtggggagaccgttacgtacgtttgaccttacggtcgggggacccgaacgggacccgtgggtcctacccgttctccgtcacgccctcccgaaccgacgggccctacgtccgttccctcccccgtcgccctaccctcctaccaacgacgaccctaccgtcgtcggggacaccgacgccggccgtcgggtctcgtccgtggcgacgggtaccttaccttccgacgtcgacgtccggtacgtcggacggcggggtcgnggaccggacggccgtaccgaatggcngc

SEQ ID NO: 222316 - DNA, 519 bp, Homo sapiens
  misc_feature: GYAE6OF02IXKQH.38.4.A04.1.454.CMB.1.raw
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (496)..(496): a, c, t, g, unknown or other
  misc_feature (496)..(496): n is a, c, g, or t
  modified_base (517)..(518): a, c, t, g, unknown or other
  misc_feature (517)..(518): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagaccaacgccaaagaactcactgtggctgcacatgaacggcctgagnggcgacgacacggctgtgtacttctgtgcgagacgcccccatggagggctacnggtgggngctacgtctttgacttacgnggggccagggaaccctggtcacgtctccncacgcctcacacggccatcggtctccccgngccacctccncgaacgncaccgtgtcgggcacgcgccgccgtggctcgccgtgcaacggtactactcncgtcgntcgactggagccgggngtcggacgacggcgacatagnnc

SEQ ID NO: 222317 - DNA, 758 bp, Homo sapiens
  misc_feature: GYAE6OF02JZSE7.38.4.A04.1.454.CMB.1.raw
  modified_base (326)..(326): a, c, t, g, unknown or other
  misc_feature (326)..(326): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccagtgagggctacaggtggganctacggacttttggacttacgtcgggggccaggggaacccttggtccaccggttctccgtcacggccctccgaacccgaacggggcccctaacgttcccgggttccctttacccccccgttgggcccctaacccccgttcccgttacccgaaacggacggccctaaccccgttcggttaccggggggcccaaacccgacgggtccccggggtcccccttggggggtccccttacgggtcccccgtttagggggttaccctaaaaccgggggtaacccttttacccgtttaaccccggaaccgggtttacgggaaccgtttcccgggtaacccgttacgggggtaaccgggacccggggggtaccgtttaccgggggaacccgtaaaacgggggccccgtaaccggtaaacggttaaccggttagacccggtg

SEQ ID NO: 222318 - DNA, 726 bp, Homo sapiens
  misc_feature: GYAE6OF02HVENY.38.4.A04.1.454.CMB.1.raw
  modified_base (197)..(197): a, c, t, g, unknown or other
  misc_feature (197)..(197): n is a, c, g, or t
  modified_base (689)..(689): a, c, t, g, unknown or other
  misc_feature (689)..(689): n is a, c, g, or t
tcagtcgatcacgtcacgaccggtgctcgatttagagtagtgatcgagggggggtccctgagactctcctgtgcagcctctgcattcacctttagtaacttatttaatgagctgggtccgcagcctcgagggaaggggctgggagtgggtggccagcaattaaccaagatggacgtagaaaaatactatgtggactntgtagaaggccgattcgcatctacagagacaacgaccaaagtaactcaactggtcggctgacctaacatcggaaaccggcctaggagaaggcgaacgacgacggtctaggtgttaacttcgtggtagacgaagaccggaccccctagtaggacgggtaccttaacgaggtacgggggaatcctaaacgggtacttttggaaccgttaacgggtcgggggaacccgaaggggtaacccctttgggaccctaacccggttccttaccgtaccgacgggtacccccttaccgaaaccccgaaaggggcccctaacgttccggtacccctttccccgaccggtacctacccctccgaaccctaaggaccacctacccgtttcgacggggaccaacgtacggacccggttccgacgggtctcggccgttaagggtaaccagggaccccttaactccgtacgtaggtactccggtacgtcggtacggacgggggtacnccggggacgaaccgggtcgaacgttaagcgtagcagg

SEQ ID NO: 222319 - DNA, 571 bp, Homo sapiens
  misc_feature: GYAE6OF02IPMX4.38.4.A04.1.454.CMB.1.raw
  modified_base (214)..(214): a, c, t, g, unknown or other
  misc_feature (214)..(214): n is a, c, g, or t
  modified_base (447)..(447): a, c, t, g, unknown or other
  misc_feature (447)..(447): n is a, c, g, or t
  modified_base (530)..(530): a, c, t, g, unknown or other
  misc_feature (530)..(530): n is a, c, g, or t
  modified_base (570)..(571): a, c, t, g, unknown or other
  misc_feature (570)..(571): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaggccattcgcatctcaganacaacgccaagaactcactgtgctgcacatgaacgctgagaggcgacgacacggctgtgtacttctgtgcgagacgccccagtgagggctacgaggtgggacgctacgtacttgacttacgtcggggccaggggaacccttggacctacccgtacgtcctacacgccctaccgacgaacgggccctactaccgttccgttccccctcggcctacccctcccgtaccaacgacncctacctcggtcggggcacgacgccggcccgtggcgtcgcctcggtacgtaacggaccttacgttccacgtcgactcgtacgnggtacggcgggtccgtaggaccgacggccgacgagtagcnn

SEQ ID NO: 222320 - DNA, 553 bp, Homo sapiens
  misc_feature: GYAE6OF02GLM1G.38.4.A04.1.454.CMB.1.raw
  modified_base (550)..(551): a, c, t, g, unknown or other
  misc_feature (550)..(551): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccatggagggctacgagtgggagctacgtactttgacttacgtggggccacggggaaccctggtcaccgtctcctcacgccctccaccgacgggcccatccggtcttcccccgtggccaccctcctaccaacgacgccacctcgtggggccacgcgccggccgtgggctcgccgtggtacgaacggtactaccttccgacgttcgatcgacgtcggaggccgggcgtggcgaacggcgacagtacgnngc

SEQ ID NO: 222321 - DNA, 637 bp, Homo sapiens
  misc_feature: GYAE6OF02GT0CW.38.4.A04.1.454.CMB.1.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (613)..(613): a, c, t, g, unknown or other
  misc_feature (613)..(613): n is a, c, g, or t
  modified_base (623)..(623): a, c, t, g, unknown or other
  misc_feature (623)..(623): n is a, c, g, or t
tcagtcgatcacgtcacgaccggtgctcgatttagagtagtgatcaggggggtcccgtggagacgtctcctgtgcagcctctgcattcacctttagtaactattaatgtagctggttccgccagccctccagggaaggggctgggagtgggtggccgagcgaattaaccgaagaagtggaacgtgaaaaatactatgtggactctgngaagggccagtgaccagtcctccganacggacaacgccttaagaactccangtggcctgcacatttacgaaacgccgtagacgaggttccgagacaacggcgttncgtaatccgtgngcganacgccccnctttagngggcctacaggngggacgacgttaaccgagttttcgaacgttaacgttcggggggccaagggggaacccctcggttcggaacccgttacggtcccccttgaacgtcccggtccccaaacgaaccgggtacccgacgtaccgccgttcccccgtcgtacccaccgttcccaccgtacaccgactacgtcctcggccgtacgacgtccgccgtacggctaccgcgtctccgagacctagtcccagccttagcaaccgtgaacgcggacccnggtcacggcngaacgttccagcgc

SEQ ID NO: 222322 - DNA, 585 bp, Homo sapiens
  misc_feature: GYAE6OF02GKAWB.38.4.A04.1.454.CMB.1.raw
  modified_base (344)..(344): a, c, t, g, unknown or other
  misc_feature (344)..(344): n is a, c, g, or t
  modified_base (415)..(415): a, c, t, g, unknown or other
  misc_feature (415)..(415): n is a, c, g, or t
  modified_base (582)..(582): a, c, t, g, unknown or other
  misc_feature (582)..(582): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccattcgccatctccagagacaacgccaaagaactcactgtggctgcacatgaacggcctgagaggcgacgacacggctgtgtacttctgtgcgagacgcccccatgagggctacaggtgggagctacgactttgactacgnggggccagggaaccctggtccaccgtctcctcacgccctccaccgaacggcccatccggtccttcccccgnggccaccctccctaccgaacgcgccacctcggtggggacacgacggccggcccgtgggcctcggcccgttgggtaccgaaagggtacccttacgtttcccgacgttacgacttccggaccgtggacggtccggggtactcgggaccgaagggccgactagtacggcngtc

SEQ ID NO: 222323 - DNA, 597 bp, Homo sapiens
  misc_feature: GYAE6OF02FLC0Z.38.4.A04.1.454.CMB.1.raw
  modified_base (342)..(342): a, c, t, g, unknown or other
  misc_feature (342)..(342): n is a, c, g, or t
  modified_base (594)..(595): a, c, t, g, unknown or other
  misc_feature (594)..(595): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtgctgcacatgaacggcctgagaggcgacgacacggctgtgtacttctgtgcgagacgcccccatggagggctacagtgggagctacgactttgactacgngggggccagggaaccctggtacaccgtctcctcacgcctcccaccgaacgggccctacgtccggtccttccccccgtggccctacccctccctacctaacgacgtaccgacccgttcgtacggggggccacgacggccggcccgtcgggccgttcgccgtgggtaccgaacggtacccttaccgttaccgacggtacgacgtccggtacgtggacggccggggtctcgggacgacgggcgaccgagtacgcnncg

SEQ ID NO: 222324 - DNA, 547 bp, Homo sapiens
  misc_feature: GYAE6OF02FXGD8.38.4.A04.1.454.CMB.1.raw
  modified_base (546)..(547): a, c, t, g, unknown or other
  misc_feature (546)..(547): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagagcccccatgagggctacgagtgggagctacgactttgactacgtggggaccagggaaccctggtcaccgtctcctcacgcctccaccgaagggcccatccggtccttccccctggccaccctccctacccaagacgccacctcgtcgggggccacacggccggcccgtgggcctgccctgggtacaaggaccttacttccgacgtgactcgacgtggacggcgggctggcgaaggccgcgatacgnn

SEQ ID NO: 222325 - DNA, 662 bp, Homo sapiens
  misc_feature: GYAE6OF02GNV6V.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaaggccgattcgccatctccagagacaacgccaagaactcactgtggctgcacatgaacggcctggagaggcgacgacacggctgtgtacttctgtgcgagacgcccccatgacgggcttacgaggtgggacgctacgtactttgaactacggtcggggaccaaggggaacccgttggtccaccggtctccctcgacgtccctccaccgaacgggccctacgtcccggttccttccccctcggaccctacccgtccctacccgaacgccgacctaacccgtcggtacgggggaccaaccgacggacccggcccggtacgggtccttcggtccgtacgggtaccgaacgggttaccttacccgttacccgtaccggttacgtaccgttaccggtaccgttgggaaccgggtccggggtaccggttacgggacccgaaccggggcggaccgtacgtacggtcagtac

SEQ ID NO: 222326 - DNA, 619 bp, Homo sapiens
  misc_feature: GYAE6OF02GGY1V.38.4.A04.1.454.CMB.1.raw
  modified_base (291)..(291): a, c, t, g, unknown or other
  misc_feature (291)..(291): n is a, c, g, or t
  modified_base (616)..(616): a, c, t, g, unknown or other
  misc_feature (616)..(616): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctgggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttntgtgcgagaccgcccccagtggagggctacgaggtgggagctaacgtactttgacttacgtgggggaccacggggaaccctgggtccaccgtctcctcacgtccctcccaaccgacggccctacgtccggtcccttcccccgtcggcccaccctccctaccgaacgacgccaccgtccgtcggggccacgcggccgggcccgtgggcctcggccgtcggtacgaacggtacccttaccgttacccgtacggtacgtacgtccggtacgtcggacgggtccggggtaccgttacgggaccgtaacgggccgacgtaagtaggtacnacg

SEQ ID NO: 222327 - DNA, 684 bp, Homo sapiens
  misc_feature: GYAE6OF02JNDEK.38.4.A04.1.454.CMB.1.raw
  modified_base (681)..(681): a, c, t, g, unknown or other
  misc_feature (681)..(681): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacgacggctcggtgtacttcgtgtcgcgacgacgcccccatggagggcctacgaggtgggagctacgtacttttcgaccttacggtcggggacccacggggaaccccttgggtaccctaccgtccttcccgtcgacgtcccctacccgaaccgtaacgggcccctacgtcccgggttaccctttccccccggtcggtaccctaccccgtacccgttacccgaaacgtaccgaccctaacccgtccggttaccggggggacccaaccgaccggcccgggtcccgtcggggtcctccggtcccgtcgggtaccgaacgggtaccttaccgttcccgtacggtcgtacgtacgtaccgtacggacggtccgggtcgtacgggaccgaacggggtccacgtaacgtacgacgnacg

SEQ ID NO: 222328 - DNA, 641 bp, Homo sapiens
  misc_feature: GYAE6OF02F0YHH.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctcagagacaacgccaagactcactgtggctgcacagtgaacggcctgagaggcgacgacacggctgtgtacttctgtgcgagaccgcccccagtggagggcctaacgaggtgggatccgtaacgtacttttggaaccttacggtcgggggaccaacggggtaaccctggtaccaccgttcctcctcgacgtccctacccgaaccgaacgggccctacgtcccggttcccttcccccgtggaccctacccctaccctaccgaacgaccgcctacccgtcggtcggggccacgacggccggccggtcgggccgtcgtccgtggtaccgaacggtaccttaccgttaccgtacgttgacgttccggacgtcggacgggccgggtaccgtacgggaccggtaaccgggccggaccgtaggtacgcgtgcg

SEQ ID NO: 222329 - DNA, 586 bp, Homo sapiens
  misc_feature: GYAE6OF02H0BE3.38.4.A04.1.454.CMB.1.raw
  modified_base (294)..(294): a, c, t, g, unknown or other
  misc_feature (294)..(294): n is a, c, g, or t
  modified_base (386)..(386): a, c, t, g, unknown or other
  misc_feature (386)..(386): n is a, c, g, or t
  modified_base (583)..(584): a, c, t, g, unknown or other
  misc_feature (583)..(584): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgccatctccagagacaacgccaagaactcactgtggctgcacatgaacggcctgagaggcgacgacacggctgtgtacttcngtgcgagacgccccatgagggctacaggtgggagcgtacgtactttgacttacggtcggggccacgggaaccctggtaccaccgtctcctcncgccctccaccgaacgggcccacgtccggtcccttccccgtcggcctccctccctaccgaacgacgccacccgtcgtcggggaccacgacggccggcccgtcgggccgtcgcccgtacggtcgaacggtaccttaccgtcccgtacgtcgacgtccgacggtgacggtcgggcgtcggcgaacggccgacagtagcnncg

SEQ ID NO: 222330 - DNA, 657 bp, Homo sapiens
  misc_feature: GYAE6OF02H0Q3H.38.4.A04.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (653)..(653): a, c, t, g, unknown or other
  misc_feature (653)..(653): n is a, c, g, or t
  modified_base (657)..(657): a, c, t, g, unknown or other
  misc_feature (657)..(657): n is a, c, g, or t
tcagtcgatcacgtcacgaccggtgctcgatttagagtagtgatcaggggggggtccctgagactctcctgtgcagcctctgcattcacctttagtaactatttaatgagctgggtcccgccagcctccagggaaggggctggagtgggtggccagcattaaccaagatggacgtagaaaaatactatgtggactntgtgaaggccattcgcatcncagagacacgccaagactcactgtgctgcanacgtgaacggctgagaggacgacgacacggctgtgtacttctgtgcgtagacgaccccactggacggtctacgtaggtgggacgcgttacgtacgtttagacgttaccgtcgggggaccaacggggacccgtttgggcctaccgttctccctcgacgccctacccgaacccgaacgggccctacgtcccggttcccctttcccccgtcggtaccctacccctacccgtccaacggacgtcctaacccgttcgggtacgggggacctaccggacggcccgggtcccggtcgggtaccgtcggtcccggttggtacgaacgggtacccttaccgtacccgtacgttgtacctacggtactgggaccggcggggtacctagggtacgaacgggccgacgtacggtacgntagn

SEQ ID NO: 222331 - DNA, 561 bp, Homo sapiens
  misc_feature: GYAE6OF02H79PR.38.4.A04.1.454.CMB.1.raw
  modified_base (192)..(192): a, c, t, g, unknown or other
  misc_feature (192)..(192): n is a, c, g, or t
  modified_base (559)..(559): a, c, t, g, unknown or other
  misc_feature (559)..(559): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctgggagtgggtggccagcattaaaccaagatggacgtgaaaaatactttttangtggactctgtgaagggccgattcgccatctccagagacaacgccaagaactcactgtgctgcacatgaacggcctgagaggcgacgacacggctgtgtacttctgtgcgagacgcccccatgagggctacaggtgggagctacgactttgactacgtggggccagggaccctggtcaccgtctcctcacgcctcaccaagggcccagtcggtccttcccctggccaccctcctccaagacgccacctcgtcgggggcacgacggccggccgtcgggccttcgccgttcgggtccaacggtacctacgttccgacgtcgacttcgaacgtggacggccgggctcggacgacgggcgctaagtacgtngc

SEQ ID NO: 222332 - DNA, 541 bp, Homo sapiens
  misc_feature: GYAE6OF02FPCNR.38.4.A04.1.454.CMB.1.raw
  modified_base (539)..(541): a, c, t, g, unknown or other
  misc_feature (539)..(541): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctgggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatggagggctacgagtgggagctacgacttttgactacgtggggccagggaaccctggtcaccgtctcctcagccctccaccgaacggcccagtccggtccttcccccgtggcccaccctcctccaagcgccaccgtcgcggggcacgcgccggcctgggctgccgtggtcaaggactacttccacgtgactcgacgtggacggcgggtcgtggacgacggcgcagtacgnnn

SEQ ID NO: 222333 - DNA, 552 bp, Homo sapiens
  misc_feature: GYAE6OF02GIGTQ.38.4.A04.1.454.CMB.1.raw
  modified_base (550)..(552): a, c, t, g, unknown or other
  misc_feature (550)..(552): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccaggggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccatgagggctacaggtgggagctacgactttgactacgtggggccagggaaccctggtcaccgtctcctcacgccctccaccgacgggcccacgtccggtccttcccccgtcggccctacccgtccctacccaacgacgcctaccctcggtcggggccacgacggccggcccgtgggctcgccgtggtacaaggtcctacttccacgtgatcgacgtggacgcgggctggcgaaggcgacagtgnnn

SEQ ID NO: 222334 - DNA, 533 bp, Homo sapiens
  misc_feature: GYAE6OF02ICFLO.38.4.A04.1.454.CMB.1.raw
  modified_base (400)..(400): a, c, t, g, unknown or other
  misc_feature (400)..(400): n is a, c, g, or t
  modified_base (518)..(518): a, c, t, g, unknown or other
  misc_feature (518)..(518): n is a, c, g, or t
  modified_base (520)..(524): a, c, t, g, unknown or other
  misc_feature (520)..(524): n is a, c, g, or t
  modified_base (526)..(526): a, c, t, g, unknown or other
  misc_feature (526)..(526): n is a, c, g, or t
  modified_base (529)..(533): a, c, t, g, unknown or other
  misc_feature (529)..(533): n is a, c, g, or t
tcagtcgatcacgtcacgaccggtgctcgatttagagtagtgatcaggggggggtccctgagactctcctgtgcagcctctgcattcacctttagcagctatgccatgagctgggtccgccaggctccagggacgggtctggagtgggtctcacttatcagtaatagtggtggtaccacattcgacgcagactccgtgaagggccggttcaccatctccagagacaattcccaagaacacactatacctgacaaatgaaagacccctgagagccgaggacacggccataatattactgtgtagaaggggcacggggtgactccgtggggccagggaccctggtccaccgtctcctcagcctccacacgggcccatcggtccttccccgtgccaccctccncagacgccacctcgtggggccacgacggccggcccgtgggcgtcgcccgtggtccgaacggacctaccgtccgacgtcgactccgactgacgcgggcgtgggacaggcacgagtacgnannnnnancgnnnnn

SEQ ID NO: 222335 - DNA, 623 bp, Homo sapiens
  misc_feature: GYAE6OF02JCG4D.38.4.A04.1.454.CMB.1.raw
  modified_base (618)..(618): a, c, t, g, unknown or other
  misc_feature (618)..(618): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatctatgtggactctggtgaagggccgattcgccatcctccagagacaacgccaaagaactcactgtggctgcacatgaacggcctggagagggcgacgacgacggctgtcgtacttctggtgcgagaccgcccccagtggacgggcctacgaggtgggagctacgactttgactcgtcggggccacgggaaccctggtaccaccgtcctcctcacgccctccacgacgggcccagtccggtccttcccccgtggccctaccctccctaccgaacgccgctacccgtcggtcgggggccacgcggcccggcccgtgggccttggcccgttggtaccgaacgggtacccttaccgttacccgtacggtcgacttaccggacgttagggaccgggtccggggccgttcggggaccgaacgggtccggaccgtagtacggntagcg

SEQ ID NO: 222336 - DNA, 652 bp, Homo sapiens
  misc_feature: GYAE6OF02JJBRO.38.4.A04.1.454.CMB.1.raw
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagtcgatcacgtcacgaccggtgctcgatttagagtagtgatcagggggaagaccgatgggcccttggtggaggcttggtccagccgggggggtcccgtgagactctcctgtgcagtctctggattaaccttagtgactatgccatgatctggtccgccaggctccagggaaggggctggagtgggtctcaggcaattaatggtaggggtgattcaccataattacgcagacctcggtggggggccgttcgaccatcgaccagagacaactccaggagacacactatatctaacgaaatgacacancctagagagtcgaggcacggcgttntaattctggtcgngagagactcccgaacggtgaacctccgtttagggtcgctttttaagcttttcgaggttcgacccggaaagggactaagtggtaccaccgttcttccttcacgtccgtccctaacgaccggacccgtaacgttccggtcccgtttcccccgtcggtcccgtcccgtcgtacgtcccgtacggacgccgtaccctaccggacgtaccggacctaccgacgtaccgggccctccggggcgtcgtcccgtaggtacccgtaacgggtaaccttaccgttaccgaccgttacgaccgtttaacgctacggg

SEQ ID NO: 222337 - DNA, 640 bp, Homo sapiens
  misc_feature: GYAE6OF02F9OTV.38.4.A04.1.454.CMB.1.raw
  modified_base (120)..(120): a, c, t, g, unknown or other
  misc_feature (120)..(120): n is a, c, g, or t
  modified_base (194)..(194): a, c, t, g, unknown or other
  misc_feature (194)..(194): n is a, c, g, or t
  modified_base (637)..(638): a, c, t, g, unknown or other
  misc_feature (637)..(638): n is a, c, g, or t
tcagtcgatcacgtcacgaccggtgctcgatttagagtagtgatcagggggggggtccctgagactctcctgtgcagcctctgcattcacctttagtaactatttaatgagctgggtccnccagcctccagggaagggctggagtgggtggccagcattaaccaagatggacgtagaaaaatctatgtggactntgtgaagggccattcgccatctcagagacaacgccaagaactcactgtggctgcacatgaacgcctgagaggcgacgacacggctgtgtactctgtcgcgagaccgccccagtggagggctacgaggtgggagtctacgtactttgacgttacgtcggggaccgacgggaaccctggtaccaccgtctcctcacgccctaccaccgacgggcccacgtccggttcccttcccccgtcggccctaccccgtccctacccgaaacggcgaccctacccgtcggtcgggggaccacgaccggtcccgggcccgtcgggtcctcggtcccgttacgggtacgtaaaccggtaaccttacccgttaccgacgttacgacgttccggtaaccggtggacgggtaccgggggtcctacggggacgtaaccggggccgtaccgagtaggcnncg

SEQ ID NO: 222338 - DNA, 613 bp, Homo sapiens
  misc_feature: GYAE6OF02GHG9J.38.4.A04.1.454.CMB.1.raw
  modified_base (610)..(611): a, c, t, g, unknown or other
  misc_feature (610)..(611): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaaagaactcactgtggctgcacatgaacgcctgagaggcgacgacacggctgtgtacttctgtgcgagacgcccccacgtggacgggctaacgaggtgggacgcgtacgtactttgaactacggtgggggaccacggggtaaccctggtaccaccgtctacctcacgccctacccgaaccgaacgggcccacgtcccggtccttccccgtcggcctccctccctaccaacggacgccacccgtcgtcggggcacgacggccggcccgtcggccgtcgccgtcggtacgaacggtaccttaccgttaccgtacgtcgtacgtccggtactcgggtacggccggggtcgtacgggaccgaacgggccgacgtagtcggtnncg

SEQ ID NO: 222339 - DNA, 890 bp, Homo sapiens
  misc_feature: GYAE6OF02HPTLR.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggtcgattcgccatctccagagacaacgccaagaactcactgtggctgcacatgaacggctgagaggcgacgacacggctgtgtacttcgtgcgacgaccgcccgaccgtaggcggacgtacgtacggtaggtacggtaccgtacgttacgttacgttacgtacggtacgggaccgggaaaccgggtaccggttaccggtaccgtacccgttacccgttccgtaccgtaccgtaccccgtacccgtaaaccccgggaaacccgggtaccccggtaccgttaccccgggtttcccccggttttaccccccggtacccccgggtaccccgtaacccccttaccccgtttaacccggaaacccggtaaacccgggtaccccgttaaccccggttaccgggggtttaccggggaacccgggtaaacccgtaccgggggtacccccgggtaccccggggttacccggggttccgggttaccccggtacccgggtttaacccggggttaaacccgggttaaaaccggttaaacccggttttaccccgtttaaaccccggttacccgggtaacggtttaccgtacccgggttaacccggtaacggggttaaccggggacccggggtaccgggttaaccgggaacccgggtaacgggttaacccggtaacgtaaccgggttaacgacggtcacggtag

SEQ ID NO: 222340 - DNA, 769 bp, Homo sapiens
  misc_feature: GYAE6OF02HI1BM.38.4.A04.1.454.CMB.1.raw
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (766)..(767): a, c, t, g, unknown or other
  misc_feature (766)..(767): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactcgtgtggaacgggccgattcgccatctccaganacaacgcaagaactcactgtgctgcanatgaacgcctgaggacggcgacgacgacggcttgtgttacttgtgtgcgacgaccgcccccagtcggacgggtcctacgagggtgggacgtacgttaaccgtaccgttttacgaacgttacgggttcggggacccggtaacggggtaaacccgttcgggtacccgtaccggttcctacccgtccaacgcccctacccgaacccggaaccggggtcccctaaccgttcccgggtttaccccgttcccccccgtacgggtccccctaccccgtaccccgttaacccgaaacggaccgtaccccgtaacccggtttcccgggtacggggggaccctaaccggggacccgggtcccgggtacccccgggttggggtccccgttcccgggtccggttaccgggtaaccgtaaacccgggttaaccctttaaccgtacccgtaacggtcggtaccgtaccgtaccggttcggacggtccggggtacgccgggacggtaccggccgagtacgtacggnngc

SEQ ID NO: 222341 - DNA, 568 bp, Homo sapiens
  misc_feature: GYAE6OF02IO7K2.38.4.A04.1.454.CMB.1.raw
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
  modified_base (566)..(568): a, c, t, g, unknown or other
  misc_feature (566)..(568): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctcagagacaacgccaagaactcactgtggctgcacatgaacggcctgagaggcgacgacacggctgtgtacttctgtgcgagacgcccccactggacgggctacgaggtgggagctacgtacttgactacgtggggtcgacgggtacctggtcaccgtctcctcacgccctccaaccgaacgggccctacgtccggtcccttcccccgcggtcccacccctcctaccgaacgacgacctaccgtcggtcggggccacgcggccggccgtgggctcgccgtggtaccaacggtaccttacttccgacgtgacgtcgacgtcggacggcgggcnggacgaggcgnatagnnn

SEQ ID NO: 222342 - DNA, 692 bp, Homo sapiens
  misc_feature: GYAE6OF02IP9K6.38.4.A04.1.454.CMB.1.raw
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacaacgccaagaactcactgtggctgcacatgaacggcctaggaggaggcgacgacacggctgtgtacttcgtggtgcgagacgcccccagtggacgggctacgaggtgggagtctacgactttgacgtacggtacggggaccgacgggaacccgtggtccgtaccgtccgtccctcgaccgtccctacccgaaccgtaaccgggcccaacgttcccggttcccgtttccccccgtcggaccctaccccgttcccgtacccgtaacgaccgtacccgtaacccgttcggtaccggggggtccaaccggaccggcccgggtaccccgtcggggtaccgtcgggtccccgttacgggttaaccgaaaccgggttaaccttaacccgtttacccgtaccggttacggtaacggttcccggtaacgtaccggg

SEQ ID NO: 222343 - DNA, 797 bp, Homo sapiens
  misc_feature: GYAE6OF02I409U.38.4.A04.1.454.CMB.1.raw
  modified_base (242)..(242): a, c, t, g, unknown or other
  misc_feature (242)..(242): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaaggccattcgccatctccagagacaacgccaagaactcactgnggctgcacatgaacggcctgagacggcgacgacacggctgtcgttacttcgtggtcgacgaggtaccgcccccgtacgtgggaacgggtcctaacgacggggttagggacgtaccgttaaccggttacgtttacggaaccgttaccgggtacgggggaccccggtaaccgggggtaaccccgtttcgggtaccctaaccccggttccttaccccgtacccgaaccggtccccgttaaccccgaaacccggaaccggggtaccccctaacggtttcccccggggtttcccctttcccccccggtcgggtacccctacccccgttccctaacccgaaacggtacccgacccttaaccggttccggggtacgggggaccaacccggaccgggtccccgggtaccccgggtcggggtacccgtcccgggtccggttacggggttaacccgtaaaccgggttaccctttaccgttcccgtacgttaccgtacgtaccgtacgtacgggaccgggtcgggtaccggtcgggaccggaacggtccgtacgagtacggcagcg

SEQ ID NO: 222344 - DNA, 611 bp, Homo sapiens
  misc_feature: GYAE6OF02GVDPE.38.4.A04.1.454.CMB.1.raw
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (370)..(370): a, c, t, g, unknown or other
  misc_feature (370)..(370): n is a, c, g, or t
  modified_base (608)..(609): a, c, t, g, unknown or other
  misc_feature (608)..(609): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaaggccgatcgccatctccagagacaacgccaagaactcactgtggctgcacatgaacggcctgagaggcgacgacacggctgtgtacttctgtgcgagcgcccccatcggaggctacgngtgggagctacgntttgactacgtcggggaccaggaaccctggcaccgttcncctcacgcctccaccgaacgggccctacgtccggtcccttcccccgtcggccctacccctccctacccgaaacgaccgccacccgtccggtcgggggaccaaccgacggcccgggcccgtcggggtccgtcggcccgttcggtaccgtaacggtaaccgtaccttacccgacgttcgtactccggacgttcggacggtccggggcctacgggaccgaacggggccgacctaagacgtnncg

SEQ ID NO: 222345 - DNA, 657 bp, Homo sapiens
  misc_feature: GYAE6OF02GPFWZ.38.4.A04.1.454.CMB.1.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
  modified_base (449)..(449): a, c, t, g, unknown or other
  misc_feature (449)..(449): n is a, c, g, or t
  modified_base (649)..(649): a, c, t, g, unknown or other
  misc_feature (649)..(649): n is a, c, g, or t
  modified_base (655)..(656): a, c, t, g, unknown or other
  misc_feature (655)..(656): n is a, c, g, or t
tcagtcgatcacgtcacgaccggtgctcgatttagagtagtgatcagggggggtcccgtgagactctcctgtgcagcctctgcattcactttagtaactatttaatgagctgggtccgccagcctccgagggaagggggctggaggtggtggccagcataaccagatggagtgaaaaatcaatgtggactcgtgngaagggccattcgccatctccagagacaacgccgaaataacgcactggtcggctgccaacatacgaacggcctaggaggtaggcgtaacgactaacgggctgtcggacttctgtcgnggagtacgcccctagtgacgggcctaagaggtggggaacgtcgtaacgtcctttagggactaacggttgggggacccaacgggtaaacccgtcgggtacaaccggtccctacttccacgggtaccctcccggaaacncccggggtaccaacgttccggtccgtttccccctccgggccctacccttaccccgtacccgtaacaccggtacctcctaccggtcggggaaccccgagaccgcccgggactccgggcctcggccgtacgtacgacgtacctacgtttccagttaccgtccggaaccgttgacgggccggtatcggaccgaagtccggaancgacgnnc

SEQ ID NO: 222346 - DNA, 602 bp, Homo sapiens
  misc_feature: GYAE6OF02FZIMJ.38.4.A04.1.454.CMB.1.raw
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtacttctgtgcgagacgcccccatggagggctacgaggtgggagctacgtactttgactacgtggggccacgggaaccctggtcaccgtctcctcacgcctccaccgaacggcccacgtccggtccttcccccgtggcccaccctccctaccaacgcgccaccgtcgtggggccacgcggcccggtccgtcgggcctcggtcccgttgggtaccgaaacggtaccttaccgttacccgtaccggttacgtacgttccggacgtcgggacggtccggggtccgtcggaccgaagggtccgaaccgtagtacggcagc

SEQ ID NO: 222347 - DNA, 713 bp, Homo sapiens
  misc_feature: GYAE6OF02FZTJN.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaaatctatgtggactctgtgaagggccgattcgccatctccagacgacaacgccaagaactcactgtgctgcacatgaacggcctgagaggcgacgacgacggctgtgtacttctgtgcgagacgccccacgtgagggctacgaggtgggagtcgtacgtactttcgactacgtcggggaccaacggggtaacccgtggtcctaccggtcctcccgtccgacgtccctacccgaaccggaaccggggtacccctacggtttcccgtacccgtttcccccgtcggtcccaccccttaccctacccgaaacggaccgtcccgtaaccccgttcgggtacgggggccaacccgtaccgggcccgggacccccgggtttggggccctttccggtcccggttaccgggttaaccggaaacgggttaacccttaccccgtttcccgaaccgtttcggacgttacccggaacgttcggggaacggtccgggggtaccggtcgggaaccggaacgggtccggtacgtaacggttagcgtagcg

SEQ ID NO: 222348 - DNA, 651 bp, Homo sapiens
  misc_feature: GYAE6OF02G8B3V.38.4.A04.1.454.CMB.1.raw
  modified_base (647)..(648): a, c, t, g, unknown or other
  misc_feature (647)..(648): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtggaagggcctattccgccatcctccagagacaacgccaaagaactcactgtgctgcacatgaacggcctgagaggcgacgacacggctgtgtacttcgtggtcgcggagccgccccagtggacggctacgaggtcgggacgtctacgtacgtttcgacttacggcggggtaccgaacgggtaacccgttggtaccacccggttactcccgtacgtaccgtccctacccgaaccgtaacgggtccccacgttcccggtcccttcccccgtggccctaccctccgtaccgaacgcgacctaccgtcgcgggacacgcggccggtcccggtcggactccggtccgtacgggtaccgtaacgtacccgttaccgtaccgtacggttaccgtacgtaccggtaacgtcgggaacggtcgggtaccgcggacggacggtcggacgtaggtacgnntcg

SEQ ID NO: 222349 - DNA, 631 bp, Homo sapiens
  misc_feature: GYAE6OF02F8IFF.38.4.A04.1.454.CMB.1.raw
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccattcgccatctccagagacaacgccaaagaactcactgtggctgcacatgaacggcctgagaggcgacgacacggctgtgtacttctgtgcgagacgcccccagtcggacgggctacgaggtcgggagtcgtacgtacttttgacttacgtcggggaccaggggaaccctggtcaccgtctcctcacgcctaccacgacggccctagtccggtccttccccgtggcctacccgtcctaccaacgacgtactaccctcggttcggggaccacgacggcccgggtacccgtggggtcctacggcccgttagggtaccgtaacgggtacccttaccgttcccgtacgtacgtacttaccggaccgtgggaaccggccggggtaccgttcgggaccgtaacgggccgtaccgtaaggttacggactgacg

SEQ ID NO: 222350 - DNA, 533 bp, Homo sapiens
  misc_feature: GYAE6OF02GAOSO.38.4.A04.1.454.CMB.1.raw
  modified_base (453)..(453): a, c, t, g, unknown or other
  misc_feature (453)..(453): n is a, c, g, or t
  modified_base (531)..(532): a, c, t, g, unknown or other
  misc_feature (531)..(532): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagattcactgtatttgcaaatgaacagcctgagagtcgaagacacggccatatattattgtagtaaaagatcattcgatatggtggcgacgtacgggtggcatgttctttgactcgtggggcctgggactccccggtctccgtctcctcagcctccaccacgggcccatcggtccttcccccgtgccaccctcctccaagacgcacctcgtcggggcacgnggcgccgtgggctgcctggtcaacggtactacttccacgtgagtcgactggacgcgggcgtggcgaggccgcactagnng

SEQ ID NO: 222351 - DNA, 680 bp, Homo sapiens
  misc_feature: GYAE6OF02F8LEJ.38.4.A04.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (429)..(429): a, c, t, g, unknown or other
  misc_feature (429)..(429): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccgagggaagggctggagtgggtggccagcattaaccaagntggacgtagaaaaatctatgtgactntgtgaaggcctatcgcatcncaganacaacgcaagactcactgtgctgnacatgacgcngagnggcgacgacgacggctgtgttacttctgtcgngacgccgcccctatgggacggctacgaggtgggactactacgtactttgactacggtcggggaccgacgggtaccgtcggtaccgaccgtcctccgtacncggtaccctcccgaacccggtaaccgggccctacggttacccgttcccccgtttaccccgtccggtaccccgtacccccgttcccgtaacccgaacggtaaccgtcccgtaaccccgtcgggttaccggggaccaaccgggaccgggcccgggtccccgggtacgggcccgttccggtccgttaccgggtaaccgtaacggtacccgttacccgttccgtaccggtaggtacccgtacggtacgtacgggg

SEQ ID NO: 222352 - DNA, 718 bp, Homo sapiens
  misc_feature: GYAE6OF02HRS47.38.4.A04.1.454.CMB.1.raw
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
  modified_base (712)..(713): a, c, t, g, unknown or other
  misc_feature (712)..(713): n is a, c, g, or t
  modified_base (716)..(716): a, c, t, g, unknown or other
  misc_feature (716)..(716): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctcgagggaaggggctgggagtgggtgccagcattaaccaagatggacgtagaaaaatctatgtggactcgtgtaggaagggcctattccgcatcctcagagacaacgcctaaagaactcacgtgtggctgcacatcggaacggctaggagacggcgtaacgacgacggtctgtagttacttcngtcgcgtagaccgcccctatggaggcctaagaggtgggacnccgttacggtacttttacgacggtcgggggaccaagggtaacccttgggccctaaccggttcctaccgtacgaacggtccctacccgaaacggtaaccgggtccctaacgtcccggttccctttcccccgtggaccctacccttcccgtaccgaaaacggtcggtaccctaaccgttccgggtacgggggactaaccgtaacgggcccggtaccccggttggggcccttacgggtccctacgggggttacctaaaccgggtacttaacccgttaccggtacggttacggaccgttacccgacggtttacggaacggggtccgggccgttaagggaaccgaaccgggcgacctaggttaacggnngtncg

SEQ ID NO: 222353 - DNA, 594 bp, Homo sapiens
  misc_feature: GYAE6OF02FVVBZ.38.4.A04.1.454.CMB.1.raw
  modified_base (242)..(242): a, c, t, g, unknown or other
  misc_feature (242)..(242): n is a, c, g, or t
  modified_base (325)..(325): a, c, t, g, unknown or other
  misc_feature (325)..(325): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacacgccaagactcatgtgcngcacatgaacggcctggagaggcgacgacacggctgtgtacttctgtgcgagacgcccccagtggagggctacgaggtggganctacgactttgactacgtggggccaagggaacccgtggtccaaccggtcctcctcacgccctccaaccgacggcccagtccggtccttccccgtcggcccaccctccctaccaacgacgcctaccgtcgtcggggccacgcgccggtacccgtgggccttcggccgtcggtaccgaaacggtaccttacccgttccgacggtacgtacgttacgacgtggacggtccgggtcgtacgggacgaacgggccgaacgtagtacgactgacg

SEQ ID NO: 222354 - DNA, 619 bp, Homo sapiens
  misc_feature: GYAE6OF02GLL3C.38.4.A04.1.454.CMB.1.raw
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (580)..(580): a, c, t, g, unknown or other
  misc_feature (580)..(580): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtgccagcattaaccaagatggactagaaaaatctatgtggactctgtgaaggccattcgcatctcagagacacgccaaagactcactgtggctgcacatgaacggcctggagaggcgacgacacggctgtgtacttctgtcgcgagacgccccacgtaggacgggctacgngtgggacnctacgtactttgactacgtcggggccacgggaaccctggtccgaccgtcctcctcacgccctcccaaccgacgggccctagtccggttcccttcccccgtggccctacccctacccgtaccgaacgaccgacctacccgttcggtcggggaccaccgacggcccggtcccgtcgggcctcgtaccgttcggtaccaacggttacccttaccgttaccgacgttacgacgttaccgacgtgggaaccggtccgggnggttaccggacgtaacgggccgtactaaggtacgcagtg

SEQ ID NO: 222355 - DNA, 608 bp, Homo sapiens
  misc_feature: GYAE6OF02IT9PW.38.4.A04.1.454.CMB.1.raw
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
  modified_base (604)..(604): a, c, t, g, unknown or other
  misc_feature (604)..(604): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactntgtgaagggccgattcgccatctcagagacacgcaagactcactgnggctgcacatgaacggcctgagaggcgaacgacacggctgtgtacttgtgtgcgagccgccccagtggaggctacgaggtgggagctacgtacttgactcggtcgggaccgagggaacccgtggtactacgtcgtcctccgtcacgcctacccgacgaacggcccagtccgttcccctccccgtcggacctaccccgtccaccgaagcgcctaccgtccggtcggggaccacgacggcccgcccggttacggcgtccgccgttcgggtaccgtaacgtaccgttacccgttaccgtacggtacgtacgttccggaacgtggaccggaccgggtcggtacggaccgacggtccgtcgaacgtgntcgg

SEQ ID NO: 222356 - DNA, 608 bp, Homo sapiens
  misc_feature: GYAE6OF02FG00C.38.4.A04.1.454.CMB.1.raw
  modified_base (248)..(248): a, c, t, g, unknown or other
  misc_feature (248)..(248): n is a, c, g, or t
  modified_base (319)..(319): a, c, t, g, unknown or other
  misc_feature (319)..(319): n is a, c, g, or t
tcagtcgatcacgtcacgaccggtgctcgatttagagtagtgatcagggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccattcgccatctccagagacaacgcaagaactcactgtggctgcanatgaacgcctgagaggcgacgcacggctgtgtacttctgtgcgagacgccccatgaggctacaggtggganctacgactttgactacgtggggccacggggtaaccctggtccaccgtctcctcacgccctaccaaccgaacgggccctagtccggttcctcccccgtggccctacccctcctaccaacgacgacctaccgtcggtcggggccacgtacggccggtacccgtgggcctcggtccgtcgggtacctaaacgggtacccttaccgttacccgtacggttacgtacgttaccggacgttcggacggtccgggtcgtacgggaccgaagggccgaaccgtagtacggcagtacg

SEQ ID NO: 222357 - DNA, 923 bp, Homo sapiens
  misc_feature: GYAE6OF02IQ7AD.38.4.A04.1.454.CMB.1.raw
  modified_base (920)..(920): a, c, t, g, unknown or other
  misc_feature (920)..(920): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgaggggaagggggctgggagtgggtggccagcattaaccaagatggacgtagaaaaatactatgtggactctggtggaagggccgtattcgccatctaccagagacaacgaccaaagaactcacgttggtaggtcctgaccaactagtacggaaccgggtcctaggaaggaacgggaccggaaccggtaacccgaccggggtacttcggttacggttacccttttcgtgggtacggaccggtaacggtaccccggacccccctacggtacgggaacggggtacctaaccggagggggttacggggaacgtaccgttaaccggttaaccgttttcgggaacccgtttaaccggggtaccggggggaccccgtaaacccggggggtaaccccttcgggtacccctaacccggttccttccccgtaccgtacccggtaccccgtaaccccgaacccgggaaccggggtccccctaaccggtttcccggttaccccccgttttccccccggtacggtacccccttacccccgttacccgtacccgaaaccgggtccgtacccgtacccggttccggggtaccgggggtacccaacccgggacgggtccccggtcccgggttacgggtccgttccggtacccgggtttaccgggtaacccgtaaacgggttaccctttacccggtacccggttaaccggttccgttaccgtacccgggtaccgggtaccggtaccggggcccggggttacggtacccggggtaccgaacggggtcccggacgttaacgtacggacgnccg

SEQ ID NO: 222358 - DNA, 731 bp, Homo sapiens
  misc_feature: GYAE6OF02HBXC4.38.4.A04.1.454.CMB.1.raw
  modified_base (253)..(253): a, c, t, g, unknown or other
  misc_feature (253)..(253): n is a, c, g, or t
  modified_base (335)..(335): a, c, t, g, unknown or other
  misc_feature (335)..(335): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctggagtgggtggccagcattaaaccaagagtggacgtagaaaaatactagtgtggactctgtgaaggccgtattcgcatctcagagacaacgcaagactcactgtggctgcanatagacgctagagaggacgacgacacggctaggtcttacttcgtggtgacggacgaccgccccagtggacgggtcctaacgnggtagggacgcgtaacgtacgtttcgaccgttacggtcggggacgtaacgggtaacccgtcggtaccgaacccgttcctacccgtccgaccggtacccctaacccgaacccgggaaccgggtccctacggttacccggttccccgtttcccccggtcgcccctaccctcccgtaaccgaacgaccgtacccgtaccgtacgggtcgggaccacggtccggacccggtaccggtcgggtacctccgggtaccgttacggtaaccggtaacgtacccgttaccgttacccggtaagggttaccgtaccgttacggtacccggtacgggaaccgggtccggggtaccgtacggggaacccggaacggggtaccctaacgggttacggtatacgcgtacg

SEQ ID NO: 222359 - DNA, 759 bp, Homo sapiens
  misc_feature: GYAE6OF02HDLKO.38.4.A04.1.454.CMB.1.raw
  modified_base (227)..(227): a, c, t, g, unknown or other
  misc_feature (227)..(227): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtggaagggccgattcgccatcctccaganacaacgccaaagactcactgtggctgcacatgaaccggctagaggaggcgacgacgacggctgtgtactttcgtggtgcgagaccgccccctagtggacgggctaacgagggtgggactcgtaacgtactttagaccttacggtcggggaccgaacggggtaaccccttgggtacccgtacccgttccttccctaccgaccgtacccccttacccgaaacccggaaccggggccccctaacgttccccgggttcccctttccccccgtcgggacccctaccccgtccctaaccgaaacggaccgacccgtaacccgtccgggttacggggaccctaaccgaccggccccgggtccccggtcgggtacccgtccggtacccggttacgggtaacccggaaacgggtaccctttaacccggttacccgacgggttcgtaccggttaccgaaccgggttacgggaacccggggtccgggtaccggttacgggacccggtaacggggcccgtaacggaacggtacgacgtcgacgg

SEQ ID NO: 222360 - DNA, 570 bp, Homo sapiens
  misc_feature: GYAE6OF02FUSIZ.38.4.A04.1.454.CMB.1.raw
  modified_base (568)..(570): a, c, t, g, unknown or other
  misc_feature (568)..(570): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaaagaactcactgtggctgcacatgaacggcctgagaggcgaacgacacggctgtgtacttctggtgcgagacgcccccatgagggctacaggtgggagcctaacgcttttgacttacgtgggggccaggggaaccctggtccaccgtctcctcacgccctcccaccaagggccccatccggtccttccccctggcccaccccgtccctcccaagacgcctaccctcgtcgggggccacgacggccgggccccttggggcctcggcccttgggtaccgaaacgggtacctaccgttccacgtgactcgacgtggacgcgggctggacaaggcgcatagnnn

SEQ ID NO: 222361 - DNA, 586 bp, Homo sapiens
  misc_feature: GYAE6OF02FW60V.38.4.A04.1.454.CMB.1.raw
  modified_base (583)..(584): a, c, t, g, unknown or other
  misc_feature (583)..(584): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctggagaggcgacgacacggctgtgtacttctgtgcgagacgcccccacgtggagggctacgaggtgggagctacgacgtttgactacgtcggggcagggaccctggtcgaccgtctcctcacgcctaccaccgacggcccacgttccggtcccttcccccgtcggccctacccctcctacccgaacgaccgaccgtacccgtcggtcggggaccaccgacggcccggcccgtcgggccgtcgccgtggtaccgaacggtaccttaccgttaccgacgtgtacgtcgacgtcgacggcggacgtggacgaggcggacagtgnncg

SEQ ID NO: 222362 - DNA, 677 bp, Homo sapiens
  misc_feature: GYAE6OF02ICKW5.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggtcttggtccaggccggggggtcctgagactctctgtgcagcctctgcattctaccttttagtaacttatttaatgagcgttcgggtccgcccacgtcccgtaccgaggggaacggggctgggaggtgggtggccagtctaagttaaaccgaagtagtacggagttaagaaaaatactaagtgtacggacttcgtagttaggacggggcctacgtttccggacctacgttcctaccgtaagaacgtaaccaaacggtaccgaaaacgtaaaccgtaccgtacgttacggtcggtaccttcgggaccaacgtaagtacggaaccggccgttaaggaggtacgggaccgaaccggaaccgaccgggacgttcggtacgtttattcgtcggtaggccggtaaccgaccggtcccccgtacgtacggaccggtcgtacggtagggtacggggacgtaccgttaaccgg

SEQ ID NO: 222363 - DNA, 635 bp, Homo sapiens
  misc_feature: GYAE6OF02ILS00.38.4.A04.1.454.CMB.1.raw
  modified_base (632)..(632): a, c, t, g, unknown or other
  misc_feature (632)..(632): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctgggagtgggtggccagcattaaaccaagatggacgtagaaaaatactaatgtggactctgtagaagggccgattcgccatctccagagacaacgccaaagaactcactgtggctgcacatgaacggcctgagaggcgacgacacggctgtgtacttctgtgcgagacgcccccatgagggctaacgaggtgggagctaccgactttgaactacgtcgggggccaggggaacccctggtaccaccggttctcctcacgccctcccaaccgaacgggccccagtcccgggttccttccccccgtggccctacccctccctacccaaagaccgccacccgtcgtcggggcctaccgacgcccgggccctcggggcctcggtccgtcggtacgaaccgggaaccttacccttaccgaacggttcgactccggtaaccgtggacgggtccggggtccgtacggggtaccgaacggggccgtaacctacggttaaggntgc

SEQ ID NO: 222364 - DNA, 642 bp, Homo sapiens
  misc_feature: GYAE6OF02GYKTG.38.4.A04.1.454.CMB.1.raw
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (414)..(414): a, c, t, g, unknown or other
  misc_feature (414)..(414): n is a, c, g, or t
  modified_base (634)..(634): a, c, t, g, unknown or other
  misc_feature (634)..(634): n is a, c, g, or t
  modified_base (640)..(642): a, c, t, g, unknown or other
  misc_feature (640)..(642): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtagaaaaatactagtgtggactcgtgtaggaagggccgtattccggaccatcctaccagagaacgaacgccaaagaactcacgtgtggctgcacatcgaacggcctagaggaggcgacgacgacgcgtgtgttactntgtcggngacgaccgtccccatggacggctacgaggtggacgctacggtcttagaccgtacgcggggtaccaaccggggtaccgtcggtaccaccgttcctccnccgtaacgcccctaccgaaccgaccgggaccctacgtccgtccccgttcccgtcgacccgtaccccgtcctaccgaacgacctccgaacccgttccgggtacgggccaccgaccggtccggcccggtcggcgtccgtccgtcggtaacgtaccgtaccgtacctacgaccgtagacctacggacggtcgaacggtccgggtctacggacgacggcgaccngtacgnnn

SEQ ID NO: 222365 - DNA, 572 bp, Homo sapiens
  misc_feature: GYAE6OF02F16QP.38.4.A04.1.454.CMB.1.raw
  modified_base (329)..(329): a, c, t, g, unknown or other
  misc_feature (329)..(329): n is a, c, g, or t
  modified_base (387)..(387): a, c, t, g, unknown or other
  misc_feature (387)..(387): n is a, c, g, or t
  modified_base (563)..(563): a, c, t, g, unknown or other
  misc_feature (563)..(563): n is a, c, g, or t
  modified_base (571)..(571): a, c, t, g, unknown or other
  misc_feature (571)..(571): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccagggaaggggctggagtgggtggccagctattaaccagatggacgtgaaaaatctatgtggactctgtgaagggccgattcgccagtctccagacgacacgccaagactcactgtgctgcacatgaacgcctgagaggcgacgacacggctgtcgtacttctgtggcgagacgcccccagtggaggctacgaggtcgggancgtacgtactttgactacgtcggggcccgagggaacccgtgggtcctaccgtcctccncacgcctacccacgacggccctagtccgtcctccccgtgccaccctcctcaacgcgccaccgtcgcggggccacgaccggtccggcccgttcgggccgtcgccgttacgcgtaacgacctaccgttccgacgttgacgtccgagtcggacggtccgggctcgggacgtaggccganagtcgagnc

SEQ ID NO: 222366 - DNA, 785 bp, Homo sapiens
  misc_feature: GYAE6OF02H7MBB.38.4.A04.1.454.CMB.1.raw
  modified_base (191)..(191): a, c, t, g, unknown or other
  misc_feature (191)..(191): n is a, c, g, or t
  modified_base (245)..(245): a, c, t, g, unknown or other
  misc_feature (245)..(245): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctcgagggaagggctggagtgggtgccagcattaaccaagatggacgtagaaaaatctatgtggactntggtgaaggccattcgccatctcagagacaacgcaagactcactgtggctgcantgaacgctgagaggcgacgacgacggctgtacgtacttctgtgacggacgaccgcccccgagtcggacgggtaccgtaacgagggttacggggaacgtaccgttaaccggtacgttttacggaaccgttaccggggtacgggggaccccgtaacggggtaaaccccgttgggtaccctacccggttccgttacccgtacgaccggtaccccgtacccgaaacccgggaacccgggtacccctaacgttccccggggtttaccccttccccccggtcggacccccgttaacccccttcccgtaacccgaaacggtaccgtaccccggtaacccggtttcggggttacgggaccctaaaccgggccgggccccgggttacccggttcgggccttaccggtacccggttacgggtaaccggtaaccgggttaacccttaaccgttacccgacgggttacctaccgggtacgtaaccggttcggggaccggtaccggggtccggttacggacggaccgggtacggaccgtaaggtcgacgagcg

SEQ ID NO: 222367 - DNA, 554 bp, Homo sapiens
  misc_feature: GYAE6OF02FZ584.38.4.A04.1.454.CMB.1.raw
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
  modified_base (379)..(379): a, c, t, g, unknown or other
  misc_feature (379)..(379): n is a, c, g, or t
  modified_base (550)..(550): a, c, t, g, unknown or other
  misc_feature (550)..(550): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccaggggaaggggctggaggtgggtggccagcaattaaccaagatggacgtagaaaaatctatgtggactntgtgaaggccattcgccatctcagagacaacgccaagactcactgtggctgcacatgaacggcctgagaggcgacgacacggctgtgtacttctgtgcgagacgcccccagtggaggctacgaggtgggacncgtacgtactttgactacgtcggggaccagggaccctggtccaccgtctcncacgcctccacgacggcccagtccgtccttccccgtggccaccctcctaccaacgcgcacctcgtcggggccacgcgccggtccgtcggctcgcgtggtcgacgtactaccttccgacgtcgactcgacgtcggacgtccgggcgtcggacgacgggccgacgagtacgcngtcg

SEQ ID NO: 222368 - DNA, 810 bp, Homo sapiens
  misc_feature: GYAE6OF02JU6RO.38.4.A04.1.454.CMB.1.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (809)..(809): a, c, t, g, unknown or other
  misc_feature (809)..(809): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgcatctcagagacacgccaagactcactgtgctgcacangaacgccngacgnggcgacgacacggctgtcgtacttcgtggtcgacgacgaccgcccccagtcggacgggaccttaacggacgggtaggggtactaccgttaaccggtaacgttttacggaaccgttaacgggtaccgggggtaccgaaacggggtaaccccggttcgggtacccgaacccgggttcccttacccgttaccaaccgggtcccctaaacccgtaacccggtaaaccggggacccctaaccggttcccggtttaccccggtttaccccccggtacccggggtaccccttaaccccgttaccccgttaaccccggtaaaccgtaaccggtaaccccggttaccccgtaccgggttacccgggggacccgttaaccggaaccgggtccccggggtacccgggtaccgggtccggtacccgggtccggttaacgggtaccggaaacgggttacccgttaaccgttaccgtaccggtacgtacgtaccggtacggttacggaccggtaccggggtcggtaccggtacggaacggtccggaacgacgtacggcaacgng

SEQ ID NO: 222369 - DNA, 592 bp, Homo sapiens
  misc_feature: GYAE6OF02ICU4L.38.4.A04.1.454.CMB.1.raw
  modified_base (590)..(591): a, c, t, g, unknown or other
  misc_feature (590)..(591): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaaggggctggagtgggtggccagcattaaaccaagatggacgtgaaaaatctatgtggactctgtgaagggccattcgccatctccagagacaacgccaagaactcactgtggctgcacatgaacggcctgagaggcgacgacgacggctgtcgtacttctggtgcgagaccgcccccagtggagggctaacgaggtgggacgctacgtacttgactacgtcggggccacggggaaccctggtaccaccggtctcctacacgccctaccgaccgaacgggccctacgtccggtcccttcccccgtcggccctccctacctaccaacgtacgccacccgtcggtcggggacaccgacggcccggtcccgtcgggccgtcgccgttacggtacgaacgggtaccttacgttccgacgtgacgtcgacgtgacggcggcgtggacgacggcacagtagcnng

SEQ ID NO: 222370 - DNA, 560 bp, Homo sapiens
  misc_feature: GYAE6OF02FXORJ.38.4.A04.1.454.CMB.1.raw
  modified_base (454)..(454): a, c, t, g, unknown or other
  misc_feature (454)..(454): n is a, c, g, or t
  modified_base (557)..(558): a, c, t, g, unknown or other
  misc_feature (557)..(558): n is a, c, g, or t
  modified_base (560)..(560): a, c, t, g, unknown or other
  misc_feature (560)..(560): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccaggggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagagcccccatcggagggctacgaggtgggagcgtacgacttttgactacgtggggccagggaaccctggtcaccgtctcctcacgcctccaccaagggcccatccgggtccttcccccgtggccacccgtccctaccaacgacgccaccctcgngggggccacagccggcccgtgggcctcgcctggtcaaggcctacttccgacgtgctccggacgtggacggtccgggcttcgggacaacgggcgacctagtagnngn

SEQ ID NO: 222371 - DNA, 599 bp, Homo sapiens
  misc_feature: GYAE6OF02I9T1D.38.4.A04.1.454.CMB.1.raw
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
tcagtcgatcacgtcacgaccggtgctcgatttagagtagtgatcaggggggggtccctgagactctcctgtgcagcctctgcattcacctttagtaactatttaatgagctggtccgccagcctccagggaaggggctggagtgggtggccagcattaaccaagatggacgtgaaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacaggtggganctacgactttgactacgtggggccagggaaccctggtcnccgtctctcagccctccaccgacggccctacgtccggtccttcccccgtcggcccaccccgtccctcccgaacgacgtccaccgtccgtcgggggaccaccgacggccgggcccgtcggggcctcgccgtcggtaccaaagggtacccttaccgttccgtacgtgacttaccggtaccgtggacggccggggtaccgtgggaccgaacgggccgtacctaaggtacgactgcg

SEQ ID NO: 222372 - DNA, 909 bp, Homo sapiens
  misc_feature: GYAE6OF02JMNWU.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctatttagaaggtgtccagtgtgaggtgcaactgggtggaggtcgtggggggaggtcgttgggtccgagggcccgggggggggttcccctgggaggaccgttctcccgtggtcgcgacgcctctggctacgttctacctttaagtaaacttactttaaatggtaagtcgttcgggtccgtaccgacggtcccgttaccggaacgggggaaacgggggccgttagggggtacgggttcggggggttcgggacccgaaggtccgtaaaacgttttaaaaacccggaaaggtaacggttacgggaaaccggttaaaggtaaaaaaaacttaccgttaaaggttacggttacgggtaaccgtttaccgttagggtaaccggggttaaaacggggggtcccgttaaggtttaccccggaacccgtaccgtttacccgttaacccgtaaacgggtaaccggaaacccgtaaaccccgggtaaaccctaaaaaccgggtaaacccgttaaccctaaccggttacgggttaaccggggttacccgttaacgggtaccaacccgtaaaggtaccgggaacccgggtaccggttaggaaacgggtaccgggggaaccgtaaccgggaaccgaccgggtaacgttcggttaccgggttaacctttccggttacggtcggacgggtaacggcccggtaacccccgagttaccgggacgggtacctaacggtaacgggtcggggtacgacggttaacccgg

SEQ ID NO: 222373 - DNA, 607 bp, Homo sapiens
  misc_feature: GYAE6OF02I8UHS.38.4.A04.1.454.CMB.1.raw
  modified_base (320)..(320): a, c, t, g, unknown or other
  misc_feature (320)..(320): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggccattcgccatctccagagacaacgtcaagaactcatgtgctgcacatgacgctgagaggcgacgacacggtctgtgtacttctggtgcgacgaccgcccccagtggacggtctacgnggtggagtccgtaacgtctttcgactacggtcggggaccaacggggtaacccgtggtaccgaccgtctccctcgacgacccttccgaaccgacgggcccacgtccgggttaccccttcccccgtcggaccctaccccgtcccgtaccaacgaccgccgtacccgttccggtcggggacgaccgacggcccggtacggtcggccgtcgccgtcggtacgaacgtacctacgtccacgtcgacgtcgtacgtgacgcgggtcgtacggacgacggcgtacgagngangc

SEQ ID NO: 222374 - DNA, 733 bp, Homo sapiens
  misc_feature: GYAE6OF02F4CTU.38.4.A04.1.454.CMB.1.raw
  modified_base (251)..(251): a, c, t, g, unknown or other
  misc_feature (251)..(251): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtgggtggccagcaattaaccaagatggacgtagaaaaatctatgtggactctgtggaaggccattcgccatctccagacgacaacgccaagactcactgtgctgcacntgaacggcctgagaggcgacgacacggctgtcgttacttctgtcgcgagaccgcccccatcgggacggctacgagggtgggacgtctaacgtactttgaaccgtacggtcggggacccgaacgggtaacccgttggtaccctacccgttccgtccctccgaacgtcccctacccgaaccggaaccggggtcccctaacggtttccccgggtttaccccgtttcccccccggtggtaccccccttaaacccccgtttccccgttaacccggaaacggacccggtaccctaaccccggttcgggttaccgggggaccctaaccggtaccgggccccgggtcccgtacggggccgttccggtaccgttacgggtaccgtaaaccgggttaccctttacccgttacccgacgggttcgaccttaccggtacgtcgggaccggtcgggcgttacgggacgttacgggcctacgtacgtacgctgacg

SEQ ID NO: 222375 - DNA, 560 bp, Homo sapiens
  misc_feature: GYAE6OF02HVZXG.38.4.A04.1.454.CMB.1.raw
  modified_base (558)..(560): a, c, t, g, unknown or other
  misc_feature (558)..(560): n is a, c, g, or t
tcagtcgatcacgtcacgaccggtgctcgatttagagtagtgatcaggggggggtccctgagactctcctgtgcagcctctgcattcacctttagtaactatttaatgagctggtccgccagcctccagggaaggggctggagtgggtggccagcattaaccaagatggacgtagaaaaaatactatgtggactctgtgaagggccgattcgccatctccagagacaacgccaagaactcactgtggctgcacatgaacggctgagaggcgacgacacggctgtgtacttctgtgcgagacgccccatggaggctacaggtgggagcgtacgacttttgactacgtggggccagggaccctggtcaccgtctcctcacgcctccaccgacggcccagtccgttcccttcccccgtcggcctaccccgtccctccgaacgacgcctacccgtcgtcggggccacgacgccggccgtggctcgcctggtacgaaggtcctaccttaccgacgtgtacgtacgacgtggacggtcggggctcggacgacggcgacagtagnnn

SEQ ID NO: 222376 - DNA, 610 bp, Homo sapiens
  misc_feature: GYAE6OF02GWS99.38.4.A04.1.454.CMB.1.raw
  modified_base (324)..(324): a, c, t, g, unknown or other
  misc_feature (324)..(324): n is a, c, g, or t
  modified_base (605)..(605): a, c, t, g, unknown or other
  misc_feature (605)..(605): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaaatctatgtgactctgtgagggccattcgcatctcagagacaacgccaagaactcactgtggctgcacatgaacggcctgagaggcgacgacacggctgtgtacttctgtgcgagacgcccccagtggaggctacgagtcggganctacgactttcgactacgtggggccacggggaaccctggtacaccgtctcctcacgccctccaaccgaacgggccctacgtccggtcccttcccccgtggcccacccctaccctaccgaagcgcctacccgtcgtcggggaccacgacgccgggcccgtgggcctcggtccgttcgggtacctaacgggtaccttaccgttaccgtacgtacgtacgtaccgtacgtcggacgggtaccccggggtcttaccgggacgtaacgggtccgtactaaggtcgntatag

SEQ ID NO: 222377 - DNA, 754 bp, Homo sapiens
  misc_feature: GYAE6OF02JC117.38.4.A04.1.454.CMB.1.raw
  modified_base (248)..(248): a, c, t, g, unknown or other
  misc_feature (248)..(248): n is a, c, g, or t
  modified_base (736)..(736): a, c, t, g, unknown or other
  misc_feature (736)..(736): n is a, c, g, or t
  modified_base (746)..(746): a, c, t, g, unknown or other
  misc_feature (746)..(746): n is a, c, g, or t
  modified_base (752)..(752): a, c, t, g, unknown or other
  misc_feature (752)..(752): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctgggagtgggtggccagcaattaaccaagatggacgtagaaaaatctatggtggactctgtgaaggccgtattcgccatctccagagacaacgccaagaactcactgnggctgcacatgaacgcctgagaggcgaacgacacggctggtgttacttcgtagtcgcgagaccgacccccagtggcgggtactacgcgggtagggcgtacgttaccgtacgttttcgaaccgtaccggtgggggaccctaacggggtaacccttgggtacccaacccgtttcccgtcctacccgtacggaccccgttccccgaaaccggtaaacccggggtccctaaccggtcccggtttacccgtttccccccgtacggtaccccgtacccccgtaccgttaacccgaaccgggtacaccccgttaacccggttccggttaccggggggacctaccggacggtccccgggtcccggtcgggtccctaccgggtcccgttacggaaccgtaacgggtaacccgtttaccgttacccggacggtttacgaccttaccgggccttacggggaacggtccggggtacgttacggtaaccggacgggtaccngttaaccggnggtcgncg

SEQ ID NO: 222378 - DNA, 756 bp, Homo sapiens
  misc_feature: GYAE6OF02H8I39.38.4.A04.1.454.CMB.1.raw
  modified_base (220)..(220): a, c, t, g, unknown or other
  misc_feature (220)..(220): n is a, c, g, or t
  modified_base (755)..(755): a, c, t, g, unknown or other
  misc_feature (755)..(755): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgcatctcaganacaacgccaagaactcactgtggctgcacatgaacggcctgagaggcgacgacacggctgtgtacttctgtgcgagacgcccccatgagggctacgaggtgggagctacgtacttttgaccgtacgtcgggggaccgacggggtaaccctggtccacccggttcctccctcaccgtccctaccgaacccgaacggggtacccctacgttcccgggttccccttttacccccccgcggggtccccaccccctttacccccgttacccgaaaacggtaccggaaccccgtacccccgtttccggggttaccgggggggaccctaaccggaaccggggtcccccggggtccccgggtttccggggggcctttcccggggtccccgtttacgggggtaccccgaaaacggggtttaacccgttaacccgtttaccccgtacgggtacgttaacgttcccgggtaacgttcgggaaccggggtcccggggtccggttacgggaccggtaaccggggccgtaccgaaggttacggcgacgng

SEQ ID NO: 222379 - DNA, 586 bp, Homo sapiens
  misc_feature: GYAE6OF02IFMQ9.38.4.A04.1.454.CMB.1.raw
  modified_base (414)..(414): a, c, t, g, unknown or other
  misc_feature (414)..(414): n is a, c, g, or t
  modified_base (585)..(586): a, c, t, g, unknown or other
  misc_feature (585)..(586): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccgattcgccatctccagagacaacgccaaagaactcactgtggctgcacatgaacgctgagaggcacgacacggctgtgtacttctgtgcgagacgcccccatgagggctacgaggtggagctacgtacttgactacgtggggccagggaaccctggtcaccgtctcctcacgcctaccaccaacgggcccacgtccggtcccttcccccnggcctacccctcctacccaagacaccaccctcggtggggccacgacgccggtcccgtcgggtcctacggcccgttagggtacctaaacgggaccttaaccgttcccgtacgtagacgtaccgtacgtcggaacggccgggtcctagggaccgaacgggccacacgtagacnn

SEQ ID NO: 222380 - DNA, 554 bp, Homo sapiens
  misc_feature: GYAE6OF02HCV9S.38.4.A04.1.454.CMB.1.raw
  modified_base (544)..(544): a, c, t, g, unknown or other
  misc_feature (544)..(544): n is a, c, g, or t
  modified_base (551)..(552): a, c, t, g, unknown or other
  misc_feature (551)..(552): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctcagagacaacgccaagactcactgtggctgcacatgaacggcctgagaggcgacgacacggctgtgtacttctgtgcgagacgccccatgacgggctacgagtgggagctacgactttgactacgtggggccagggaaccctggtccaccgtctccctcacgccctccaaccgaacgggcccagttccggtcccttcccccgtcggcccaccctcctccaacgacgccaccgtcgtcggggccacgacgccggccgtgggcctcgccgtggtacaacggaccttactccgacgtgactcgactggacgcgggcgtggacgaacggccganagtacgnncg

SEQ ID NO: 222381 - DNA, 812 bp, Homo sapiens
  misc_feature: GYAE6OF02HKWBA.38.4.A04.1.454.CMB.1.raw
  modified_base (261)..(261): a, c, t, g, unknown or other
  misc_feature (261)..(261): n is a, c, g, or t
  modified_base (807)..(807): a, c, t, g, unknown or other
  misc_feature (807)..(807): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccaggggaaggggctgggagtgggtggccagcaattaaccaagatggacgtagaaaaatactatgtggactctggtggaacgggccgtaattcgccatcctaccgagagacaaccgacccaagaacctcactggnggctgcaacatacggaaccggcctaggaggacggacgaccgacgacggcgttgtagttacttcgtgtcggcgacgaccgcccccgtacgtcgggacggtctaacgaggtacgggacgtacctaacgtacgttacggaacgtacggtcgggggaccgaacgggtaacccggtcgtaccgtaccgttccgtcccgtacgaccgtccctaacccgaacccggtaacggggtacccctaccggtttcccgggtttacccccgtttcccccggaccggggtcccctaacccccgttacccgtaacccggaaaccggtaacccgacccgttaacccggttccgggtaccggggggaccctaaaccggtccgggaccccgggtcccgggttccgggaccgttcccgggtacccggttacggtaacgtaaccggggtaacctttaaccccgttaccgaaccggttccggtaccgtaccggttaccggaacggttaccggggccggggtacccggttacggggaccggtaacgggtaccgaccgtaaaggtcggngacgc

SEQ ID NO: 222382 - DNA, 812 bp, Homo sapiens
  misc_feature: GYAE6OF02J2KOV.38.4.A04.1.454.CMB.1.raw
  modified_base (118)..(118): a, c, t, g, unknown or other
  misc_feature (118)..(118): n is a, c, g, or t
  modified_base (809)..(809): a, c, t, g, unknown or other
  misc_feature (809)..(809): n is a, c, g, or t
tcagtcgatcacgtcacgaccggtgctcgatttagagtagtgatcgaggggggtccctgagactctcctgtgcagcctctgcattcacctttagtaactatttaatgagctgggtccnccagcctcgagggagggctggagtgggtgcagcattaaccgaagagtggaacgtagaaaaattctagtaggtggacttcgtggtacggaacgggtcctattccgcctactcgaccgagaacgtaccaaccgtaccgaacgtaacctcgtacgtgtcggaccgtcgaccgacgtacgtacggaaccggcgtacggacggacggacggaccgtacgtaccggtcgttaggtcgttacgtcgtcgacgccgaccgacccgaccccgtaggtcggacggtaccgtacggtacgggcggtaccgtacgtaccggttacgttacggaccggttaccgggtaccggggacccggtaaccggtacccgttcggtaccgtacccgttctacccggtcccgacccgttccccaccggacccggtaacggtcccgttaccggtcccgtttcccgtacccccggtcgtaccccgtaccccgtacccgtaaccgaccggtaccgtacccgttccggtaccggggtacgggcccaccgggtcccggtcccgggccggttaccgggtccgtacccggtaccggttaaccggaccggttaaccgttacccgttaccgtccgtacggttaccgtacgttaccgggtacccgtggggtacccggtcgggtaccggaaccggtacggtaccggacgtacggtcgacgtgngac

SEQ ID NO: 222383 - DNA, 583 bp, Homo sapiens
  misc_feature: GYAE6OF02GXJ8E.38.4.A04.1.454.CMB.1.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
  modified_base (583)..(583): a, c, t, g, unknown or other
  misc_feature (583)..(583): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgagggaaggggctggagtgggtggccagcattaaccaagatggacgtgaaaaaatactatgtggactctgtgaagggccgattcgccatctcaganacaacgccaagaactcactgtggctgcacatagaacggcctgagaggcgacgacacggctgtntacttctgtgcgagaccgcccccagtgacgggctacgaggtgggacgtctaacggtactttgaacttacggcggggaccaacggggaacctggtaccaccggtcctaccgtcgacgccctaccgaaccgaacgggcccacgtccggtcctccccgtcgccaccctccaccaacgacgccaccgtcgtcggggacacgacgccggccgtgggctcgccgtggtacgaacgtacctactaccgacgtagactcgtacgtggacggcggccgtaggaccgaggaccgataagtagcagn

SEQ ID NO: 222384 - DNA, 948 bp, Homo sapiens
  misc_feature: GYAE6OF02JUBO9.38.4.A04.1.454.CMB.1.raw
  modified_base (922)..(922): a, c, t, g, unknown or other
  misc_feature (922)..(922): n is a, c, g, or t
tcagtcgatcacgtcacgaccggtgctcgatttagagtagtgatcagggggaagaccgatgggccctggtggaggcgtggtccgagccgggggggtcccgtggagacgtcgtccctgtgcagcctctgcattcacctttagtaacttacttttaagtagagtcgtcgggttccgaccacggtcccttcccgaggggaacggggggccttcggggaaggtggggttcgggcccaaggtcgtaacgtttaacccgaaaggtctaggggtaacccggtagtaaaaaaaagttccgtaaagttgggtaagggtacctacttagggttacgggaaacgggggtcccgtaagttttcccgggcctaagttcccgttaccgaaacggaacggtaaaccgaaaccggacccgtaaaacggaaaccttacccgaacgttacggttcgggacccgttacggaccaaacgtaccgttacggaaacccgggtcccttaggaaggtaccgggacgaaccggaccgtacggaccgtcggtacggtacgtttcctacggttggaccggaaggtacccgccccccgagtgggtaacggggcctaacggtaggtcgggagttaccgtacgtacgttttacggaccgtacggtttcggggaaccgtacggggtaacccgtcgggtacctacccgggtaccttccgtactaccggacccttacccgaacccggaacgggtccccctacggttacccgggttccccttaacccgtccggtaacccgtacccccttaccggttacccgaaccgggtacctcccggtacccccgttacggggttccggggacccttaacgcccgggtacccgggtccccgtggtcccgtaacccggtcgttaccgggtaccgtaaccggcctttaacccgtccggtaaaccggnggttaaccctccgggtaccctacggg

SEQ ID NO: 222385 - DNA, 808 bp, Homo sapiens
  misc_feature: GYAE6OF02GXR12.38.4.A04.1.454.CMB.1.raw
tcagtcgatcacgtcacgaccggtgctcgatttagagtagtgatcaggggggggtccctgagactctcctgtgcagcctctgcattcacctttagtaactatttaatgagctgggtccgccagcctccagggaagggctggagtgggtggccagcattaaccaagatggacgtgaaaaatctatgtggactcgtgtgaagggcccgattcgccatctccagagacacgccaagaactcactgtggctgcacatgaacggcctgagagcgacgacacggctgtgtacttctgtgcgagacgcccccagtcggacgggcttaacgaggtggggaacgcttaaccggacttttcggaaccttaacggttcggggggaccctaacgggggaaaccccttgggtaccctacccggttcctacccttaccaacggtccccttacccgaacccgtaaagggggccccctaaggttcccgggtttaccccgtttacccccccggttgggtacccctaacccccgttaccccgttaccccgtaaagggtaaccgtcccggtaaacccggttccggtttcggggggggaccctaaccgggtaccgggacccggggtccccggtttacgggggtaccctttcgggccccgtttacggggtacccggtaaaccggggttaaccgttaaaccccggtttcccgaaccgggtttacggaaccgttacccggtaccgtaaccggggtaacgggtccccgggggtcccgttaccggggtaccggtaaaccggggttccgaaccggtacctaagggcctagtccg

SEQ ID NO: 222386 - DNA, 735 bp, Homo sapiens
  misc_feature: GYAE6OF02I39ZL.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctggagtgggtgccagcaattaaccaagatggacgtagaaaaatctatgtggactctgtgaaggccattcgcatctcagagacaacgccaagactcactgtgctgcacagtgaacgctgagaggcgacgacgacggcttgtgtacttcgtgtgcgagccgccccagtggacggctacgaggtgggactacgtacgtacgtttacgacgtacggtcggggaccgtaacgggaacccgttggtaccctacccgttcctcccgtacgaccgtaccccgtaccgaacccggaaccgggtccctaacggttcccggttcccccgtttaccccccggtcgggtaccccttaaccccgttacccgtaacccgtaaacggtacccgtacccgtaacccgtttccgggtaccgggggaccctaaccgggaccggacccgggtcccggttcggggtcccgtccggtaccgtacgggttaacccgtaaaacgggttacccttacccgttacccgtacggttacgtaccgtaccggtaccgtcgggaacggtcccgggtacgttacgggaaccgtaacgggcccgtaacgtacgtacggaccgtgacg

SEQ ID NO: 222387 - DNA, 634 bp, Homo sapiens
  misc_feature: GYAE6OF02FJXKT.38.4.A04.1.454.CMB.1.raw
  modified_base (274)..(274): a, c, t, g, unknown or other
  misc_feature (274)..(274): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtgccagcattaaccaagatggacgtgaaaaatctatgtggactctgtgaagggccattcgccatctcagagacaacgccaagactcactgtgctgcacatgaacggcctgagaggcgacgacacggntgtcgtacttctgtgcgagaccgcccccagtggagggcctacgaggtcgggatcctaacgtacttttgaacgtacgtcgggggccaacggggtaccctgggtacccaccgtcttcctaccgacgtccccttaccgaacccggtaacgggcccctaacgtcccggttcccttcccccgtcggccctacccctccctaccaacgacaccgtaccgtcggttcggggccacgacgtccgggtcccgtgggtcctcgtcccgtcggtaccgtaacgtaccttaccgttaccgtacggtcgtacgtaccggacgtcggacggtaccgggtcgtacggacgacggtcgtacgtacgcggtcagtcg

SEQ ID NO: 222388 - DNA, 653 bp, Homo sapiens
  misc_feature: GYAE6OF02J02YT.38.4.A04.1.454.CMB.1.raw
  modified_base (293)..(293): a, c, t, g, unknown or other
  misc_feature (293)..(293): n is a, c, g, or t
  modified_base (651)..(653): a, c, t, g, unknown or other
  misc_feature (651)..(653): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccattcgcatctccagagacaacggcctaagaactcactgtggctagcacatcgaacgcctgagaggcgacgacacggctgtcgtactgtgngcgagacgccccctagcggagggtcctaacgaggtgggacgtcgtaacggtactttagaccgttacggtcgggggacctaacggggtaacccttggtaccgacccgttccgtccgttacacggtccctaccgacccggtaacggggccccctaagttcccggttcctttaccccccgtcggccctacccctccgtacccgaagtaccgcctacccgtacggtcgggggaccaacccggaggtcccggtacccggtcggggtccctcgtcccggttcggtaccgaaacggtcccttaccgtccgtacgtcgactccgtacgtggaccggcggtcgtcggacgacggtcgccaaggtcgnnn

SEQ ID NO: 222389 - DNA, 730 bp, Homo sapiens
  misc_feature: GYAE6OF02FLWY3.38.4.A04.1.454.CMB.1.raw
  modified_base (267)..(267): a, c, t, g, unknown or other
  misc_feature (267)..(267): n is a, c, g, or t
  modified_base (726)..(726): a, c, t, g, unknown or other
  misc_feature (726)..(726): n is a, c, g, or t
  modified_base (729)..(729): a, c, t, g, unknown or other
  misc_feature (729)..(729): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaaatactatgtggactctgtgaagggccattcgccatctccagagacaacgccaaagaactcactgtggctgcacatgaacggcctgagnggcgacgacacggctgtgtacttctgtgcgagacgccccccagtggacgggctaacacgggttggggagccgttaacggacttttggaacctacggtcgggggacccacggggaaaccccttgggtaccaaccggttcctcccttccgacgtcccttacccaacccgaaacggggcccctaactcccggggttaccctttcccccccgtcgggcccctaaccccttcccttacccgaaacggacctacccgtaaccccgttccgggttaccggggggacctaaccgaccgggccccgggtaccccgttgggggcccgtttccggcccgtttcgggtaccgtaaaacgggtaaccctttaaccggtttcccgtaaccgggttacgacgttaccgggtaccgtcgggacggtaccgggggaccttcgggacccgaacggggcccgtacggaagttaacggncgng

SEQ ID NO: 222390 - DNA, 623 bp, Homo sapiens
  misc_feature: GYAE6OF02I1F5F.38.4.A04.1.454.CMB.1.raw
  modified_base (118)..(118): a, c, t, g, unknown or other
  misc_feature (118)..(118): n is a, c, g, or t
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (595)..(595): a, c, t, g, unknown or other
  misc_feature (595)..(595): n is a, c, g, or t
  modified_base (620)..(623): a, c, t, g, unknown or other
  misc_feature (620)..(623): n is a, c, g, or t
tcagtcgatcacgtcacgaccggtgctcgatttagagtagtgatcagggggggtccctgagactctcctgtgcagcctctgcattcacctttagtaactatttaatgagctgggtccnccagcctccagggagggctggagtgggtgccagcaattaaccagatggactagaaaaatctatgtgactntgtgaaggcatcncatcncagancaacgcaaagactcactgtgctagcacatcgaacggcctagagcggcnccgaacaccgggttntacgtnttaccgttcgnggtagacgacgcccgtccccgagnggacggctaacggggtcggatcgtacgtattcgatacggcggggacctaacggtaccctggaccctaccgttccaccctcgaccgtacccacccgaacggaaccgtcccgtacgttacccgtccccgttccccgccggtaccctacccgtacccgtaaccgaacgtaccgacccgtacggtccgggtacgggacctaaccgccggtcccggtacccggtcggtaccgtcgtaccgtacgtacgtaacgtaccgttacctacgtacgtgacgtacgtacgngacggcgacgtgaccgagcgagagnnnn

SEQ ID NO: 222391 - DNA, 715 bp, Homo sapiens
  misc_feature: GYAE6OF02IT59P.38.4.A04.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (709)..(709): a, c, t, g, unknown or other
  misc_feature (709)..(709): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgaggggaaggggctgggaggtgggtggccaggcattaaaccaagagtggacgtagaaaaatctatcgtggacctntgtaggacgggcgtattcgcatctcagagaacacgacaagactcatgtgctgctacagtcggaacgcgtgaggaggcgaacgacgcggtctgttactacgtttgngtcgacgacgacccgccccgtagnggacggtctaagnggtggaacgtcgtaacgtctttacgaccgtacggtcggggaccgtacgggtaacccttggtacccgtacgtcctccgtacgcccgtaccccgtaccgaaacccggaccgggaccctcgtacccggttccccgtttcccccgccggtaccccaccccgtccctaaccgaaccggtacgtaccgtccgtaccggggtccgggaccaccgggaccgtcccgggccggtcgggtaccctccgtaccgtcggtaacccggttaacgtacccgtaccgttaccgacgttcgtaccggttccgtacggtccgggtaacggtcccgggtacggttccggaaccggtaacgggtacccgacttaaggtaccggngacgag

SEQ ID NO: 222392 - DNA, 570 bp, Homo sapiens
  misc_feature: GYAE6OF02G5ZGN.38.4.A04.1.454.CMB.1.raw
  modified_base (330)..(330): a, c, t, g, unknown or other
  misc_feature (330)..(330): n is a, c, g, or t
  modified_base (568)..(569): a, c, t, g, unknown or other
  misc_feature (568)..(569): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcaactgtggctgcacatgaacggcctgagaggcgacgacacggctggtgtacttctgtgcgagacgcccccactgaggctacaggtggganctacgactttgaactacgtggggccacgggaaccctggtccaccgtctcctcagcctccaccgaacgggcccacgtccggtaccttccccccgtggcctacccctcctccaaacgacgctaacctcgtcggggcacacggcggtcccgtgggcctcgcccgtggtaccaaagggtacctaccgttccgacgttcgactcgacgtcggacggcgggtcgtggacgaacggcgacatagnnc

SEQ ID NO: 222393 - DNA, 721 bp, Homo sapiens
  misc_feature: GYAE6OF02I5BKA.38.4.A04.1.454.CMB.1.raw
tcagtcgatcacgtcacgaccggtgctcgatttagagtagtgatcaggggggtccctgagactctcctgtgcagcctctgcattcacctttagtaactatttaatgagctggtccgccagcctcgagggaagggctggagtggtgccagcattaacagagtggacgtagaaaatctatgtgactcgtggtagaacggcctattcgccatcctacagacgacaaccgtaccaaagactcacgtagtcggctagacaacatacgaaccggctaggaggacggacgaacgacgtacggtcttaggtacgttaaccgttcgtaggtaggacgaacggacccgtacccccaagttcggaacgggtacctaaacgtagggtacggtaacgtaccgtaacggttacctttaggaaccttaacgggttccggggaaccgtaaccggggtaaccgttcggtacccgtaaccgttccgtaccgttacgaaccgtccctaccgaacccggtaacggacccgtacgtaccgttacccgttaccccggtacgtacccgtacccgtaccctaccgaacgtacgaccgtaccgtacggtacggtaccgacgtacggaccggtaccgcggtccgtcgaccgtacgtacgaacgtaccgtaccgtaccgtacgtacgtacgtacggtaacgtacgtacggacggtacggtacgacggacggtacgacgtacgtagacg

SEQ ID NO: 222394 - DNA, 593 bp, Homo sapiens
  misc_feature: GYAE6OF02JIDQW.38.4.A04.1.454.CMB.1.raw
  modified_base (325)..(325): a, c, t, g, unknown or other
  misc_feature (325)..(325): n is a, c, g, or t
  modified_base (592)..(592): a, c, t, g, unknown or other
  misc_feature (592)..(592): n is a, c, g, or t
tcagtcgatcacgtcacgaccggtgctcgatttagagtagtgatcaggggggtcccgtgagactctcctgtgcagcctctgcattcacctttagtaactatttaatgagctggtccgccagcctccagggaagggctggagtgggtggccagcattaaccaagatggacgtgaaaaatctatgtggactctgtgaagggccattcgcatctccagagacaacgccaaagaactcactgtggctgcacatgaacggcctgagaggctacgacacggctgtgtacttctgtgcgagacgccccatggacgggctacgaggtgggacnctacgacttttgaccttaacgtgggggcctaaggggaacccctgggtccaccggtctcccgttcacgtccctaccaaccgaacgggcccagtccggtccttcccccgtggtcccaccctccgtccaacgcgccacctcgtacggggcacacggtccggcccgtggccgtacgtcccgtaggtccaacgggtacctaccgttccgaacgttcgactccggacttcggacgtccgggctcgggaccaacgggccgacgtaacgtggcgnc

SEQ ID NO: 222395 - DNA, 646 bp, Homo sapiens
  misc_feature: GYAE6OF02H4TQ8.38.4.A04.1.454.CMB.1.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
tcagtcgatcacgtcacgaccggtgctcgatttagagtagtgatcagggggggtccctgagactctcctgtgcagcctctgcattcacctttagtaactattaatgagctggtccgccagcctcagggaagggctggagtgggtggccagcaattaaaccaagatggacgtagaaaaaatactatgtggactctgtgaaggccgattcgccatctccaganacaacgccaagaactcactgtgctgcacatgaacggcctgagaggcgaacgacacggctgtntacttctgtgcgagccgccccctgtggagggcctacgaggtgggacgcttacgtactttgaaccgttacggtcggggccaacggggtaaccctgggtacccaccggttccctcccgtcaacgtccctaacccgacccgtaacggggcccctacgttcccggttccccttcccccgtccggtaccctacccccgttccgtacccgaacggtacgaccctcccggttacgggtcggggacccaccgacggcccggccgtccgggcctcggcccgtggaaccgtaacgtaccttccgtacccgtcgtagacgtccggtagtacgggaccgtccgggactcgggaccgtacgggccagactagcatg

SEQ ID NO: 222396 - DNA, 572 bp, Homo sapiens
  misc_feature: GYAE6OF02HHZ1C.38.4.A04.1.454.CMB.1.raw
  modified_base (321)..(321): a, c, t, g, unknown or other
  misc_feature (321)..(321): n is a, c, g, or t
  modified_base (487)..(487): a, c, t, g, unknown or other
  misc_feature (487)..(487): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtgccagcattaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagacgcccccatggacgggctacnggtgggagctaacgtactttgaactcgtcggggccacgggaaccctgggtccacccggtctcctccgacgtccctaccaccgaacgggcccagttccggtccttcccccgcggccacccctcctaccgaagacgccacccgtcggcggggacacgcgccggcccgngggctcgccgtcggtacgaaggtacctacgttccacgtcgactcgacgtggacggtcgggcgtcggacgacggcgcaagtcgnan

SEQ ID NO: 222397 - DNA, 646 bp, Homo sapiens
  misc_feature: GYAE6OF02HH5N6.38.4.A04.1.454.CMB.1.raw
  modified_base (323)..(323): a, c, t, g, unknown or other
  misc_feature (323)..(323): n is a, c, g, or t
  modified_base (636)..(636): a, c, t, g, unknown or other
  misc_feature (636)..(636): n is a, c, g, or t
  modified_base (642)..(642): a, c, t, g, unknown or other
  misc_feature (642)..(642): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctggtgaagggccgattcgccatctccagagacaacgccaagaactcagtgtggctggacatgaacggcctgagaggcgacgacacggctgtgtacttctgtgcgagacgcccccagtggaggctacgnggtgggagctacgtactttgactacgtggggccagggaacccgtggtccaccgtctcctcgacgccctaccaccgacgggccctagtccggttcccttcccccgtggcccctaccccgtccctaccgaacggtacgccctaccgttcgggtacgggggcccaacgaccgggccgggtaccccgtcggggcctccgggtcccgtcgggtaacccgtaaacgggtaccttacccgttccgaacggtcgtaaccgtccggaacgttcgggaacgggccggggcgttcgggaccgtaacgggcggtactagtacggntaccgngtcg

SEQ ID NO: 222398 - DNA, 570 bp, Homo sapiens
  misc_feature: GYAE6OF02I58FF.38.4.A04.1.454.CMB.1.raw
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacgcctgagaggcgacgacacggctgtgtacttctgtgcgagacgcccccagtggacgggctacgaggtgggagtcgtacgtactttgactacgtggggccacgggaacctggtcaccgtctcctcacgccctccgaccgacggcccacgtccgtcccttcccccgtcggccctaccctcctaccgaacgacgccaccgtcgtcggggcacgacggccggcccgtcgggcctcgccgtcggtacgaacggtaccttaccttccgacgtactcgacgtggacggcggcgtcggacgaggcgacgagtagcncngc

SEQ ID NO: 222399 - DNA, 527 bp, Homo sapiens
  misc_feature: GYAE6OF02HRNK9.38.4.A04.1.454.CMB.1.raw
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
  modified_base (501)..(501): a, c, t, g, unknown or other
  misc_feature (501)..(501): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggagcttggtccgaggcccgggggggtccctggagactctcctgtgcagcctctgcattcaccttttagtaacttatttaatgagtctgggtccgccagccctccgaggggaaggggctggagtggggtggccagcattaaccaagatggacgtagaaaaatactatgtggacttcgtgtgaacgggcgattccgcatctccaagngacaacgaccaagaactcactgtggctgcacancgaacgctgagcgcgacgacacggctgtgtacttctgcgcgacgcgcccccganggcggctacgaggtgggagcgtacgg

SEQ ID NO: 222400 - DNA, 625 bp, Homo sapiens
  misc_feature: GYAE6OF02GRAHC.38.4.A04.1.454.CMB.1.raw
  modified_base (321)..(321): a, c, t, g, unknown or other
  misc_feature (321)..(321): n is a, c, g, or t
  modified_base (619)..(619): a, c, t, g, unknown or other
  misc_feature (619)..(619): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtggaaggccgattcgccatctccagagacacgccaagactcactgtggctgcacatgaacggctgagaggcgacgacacggctgtgtacttctgtcgcgacgacgcccccagtgacgggctaaccgnggtgggacgtctacgtaccttttgaccgtacgtcggggccgtaacgggtacccctggtacctacccgtctccgtcgaccgtccctacccacgaaccgggccctacgtccgttaccccgttccccgtcggcctacccctccctaccaacggccgaccaccgtcggtcgggccacgcgccgggccgttcgggactcgtccgtcggtaccgtaacgcctaccttccgtacgtacgacgttcgacgttcgggacggccgggttccgacgggacccgtacgggccgaaccgtaggtacgtacngtaccg

SEQ ID NO: 222401 - DNA, 603 bp, Homo sapiens
  misc_feature: GYAE6OF02IN9R7.38.4.A04.1.454.CMB.1.raw
  modified_base (220)..(220): a, c, t, g, unknown or other
  misc_feature (220)..(220): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (599)..(599): a, c, t, g, unknown or other
  misc_feature (599)..(599): n is a, c, g, or t
  modified_base (601)..(602): a, c, t, g, unknown or other
  misc_feature (601)..(602): n is a, c, g, or t
tcagtcgatcacgtcacgaccggtgctcgatttagagtagtgatcaggggggggtccctgagactctcctgtgcagcctctgcattcacctttagtaactatttaatgagctgggtcccgccagcctccgagggaaggggctgggagtgggtgccagcattaaaccaagatggacgtagaaaaatactatgtgactctgtgaaggccgattccgccatcncagagacacgcaaagaactcactgtggctgcacatgaacgctgagaggcgacgacgacggctgtntacgttntgtgacgagaccgcccccagtggacgggctaacgnggtgggagcgtacgtactttagacgttacgtggggccgacgggaaccctggtccaccgtctcctcacgccctccgaaccgacgggcccacgttccggtcccttccccgtgccctacccgtccctaccgaagcgcctacctcggacggggccacgacgccggtcccgtcgggtccgtcggccgtagggtaccgaaacgggttacctaccgttccgaacgttcgtacgccggtagtcgggacgccgggtctcggaccgaaggccgacaggtcgngnng

SEQ ID NO: 222402 - DNA, 693 bp, Homo sapiens
  misc_feature: GYAE6OF02I3SDQ.38.4.A04.1.454.CMB.1.raw
  modified_base (235)..(235): a, c, t, g, unknown or other
  misc_feature (235)..(235): n is a, c, g, or t
  modified_base (687)..(687): a, c, t, g, unknown or other
  misc_feature (687)..(687): n is a, c, g, or t
  modified_base (692)..(692): a, c, t, g, unknown or other
  misc_feature (692)..(692): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtggtgccagcattaaccaagatggacgtagaaaaatctatgtcgactctgtagaagggcctatccgccatctcctagaagaccaacgccaaanaactcaactgtggctgacacagtacgaacggcctaggaggacggccgaacgaccgacggcttgtcgtaccttgtcgtggcgagaccgacccccgagtcggacgggctaacgaggtcgggcgtacgtaacgtactttgtaacctaccggtcggggaccctaaccgggaacccttggtacccaacccggttcctaccgccaccggccctacccgaaaccggtaaccgggccctaacgttcccggttaccccgtttcccccgtcggtcccctaccccttaccctaacccgaacgtaccgacccttaaccgtccggttcgggaccaccgtaccggcccggtccggtggaccgtcggtcccgtacggtacgaaacgggtaccttaccgtaccgtacgtcgactcgaccgtggaccggtccgggcgttacggaaccgtacggacctacgtacgtacgngtacnc

SEQ ID NO: 222403 - DNA, 592 bp, Homo sapiens
  misc_feature: GYAE6OF02G6O9C.38.4.A04.1.454.CMB.1.raw
  modified_base (324)..(324): a, c, t, g, unknown or other
  misc_feature (324)..(324): n is a, c, g, or t
tcagtcgatcacgtcacgaccggtgctcgatttagagtagtgatcaggggggtcccgtgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaaagaactcactgtggctgcaacatgaacggctgagaggcaagcacggctgtgtacttctgtgcgagcgcccccatgagggctacgaggtggganctacgactttgactacgtggggcctagggaaccctgggcaccggtctcctcagcctcaccacgggcccagtccggtcttcccctggcctacccgtcctaccaagacgaccacctcgtacggggcacgagcccggtccgtagggtcccgtggtcccgttcgggtaccgaacggtaaccgttaccgttacccgaccggttacgacgttaccggactggtaaccggccgggtacgtcgggaaccgtacgggccgtacacgttaagcagtcg

SEQ ID NO: 222404 - DNA, 605 bp, Homo sapiens
  misc_feature: GYAE6OF02G708N.38.4.A04.1.454.CMB.1.raw
  modified_base (603)..(604): a, c, t, g, unknown or other
  misc_feature (603)..(604): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtgctgcacatgaacgctgagaggcgacgacacggctgtgtacttctgtgcgagacgcccccagtgagggctacgaggtgggagcgtaacgtactttgacgttacgtcggggaccgacgggtaacccgtggtaccaccggttcctccctcaccgccctacccgaacccgaacgggcccacgtcccggtcccttcccccctcggccctacccctccctacccgaaacgacgaccaccgtcggtcggggaccacgtacgccgggcccgtcgggcctcgccgtcggtacaacggtccgttaccttcccgtacgtagacgtacgacgtcgacgggcgggtcgcgggacgaacggcgacgtagtgnnc

SEQ ID NO: 222405 - DNA, 686 bp, Homo sapiens
  misc_feature: GYAE6OF02HYYYI.38.4.A04.1.454.CMB.1.raw
  modified_base (334)..(334): a, c, t, g, unknown or other
  misc_feature (334)..(334): n is a, c, g, or t
  modified_base (681)..(681): a, c, t, g, unknown or other
  misc_feature (681)..(681): n is a, c, g, or t
tcagtcgatcacgtcacgaccggtgctcgatttagagtagtgatcagggggggtccctgagactctcctgtgcagcctctgcattcacctttagtaactattaatgagctgggtccgccagcctcagggaagggctggagtgggtggccagcattaaccaagatggacgtagaaaaatactatgtggactctgtgaagggccattcgccatctcagagacaacgccaaagactcactgtggctgcacatggaaccggcctgagaggccgacgacgacggcttggtgttacttcctggtcgcggagtacccgccccacgtggacgggtctaacgngggtgggacgtctaacgtctttacgacgtccggtcggggacccgaacggggtacccttggtcctaccgttcctccgtcaccgtcccctaccgaaccggaaccggtcccgtaacgttcccggttaccccttcccccggtcgtacccgtacccccttcccgaccgtaaaccggaccgtaccctaacccgttcggggtaccggggaccctaacggaccgggtcccgggtacccggtcgggtcccgtcggtacccggtcggtaacgtaacgggttaccttaccgtaccgtaccgtacgttacgcgtaccgtaggcggtccggggtcgtcggacgtacggcgacgtaagctncgacg

SEQ ID NO: 222406 - DNA, 637 bp, Homo sapiens
  misc_feature: GYAE6OF02IWYGR.38.4.A04.1.454.CMB.1.raw
  modified_base (225)..(225): a, c, t, g, unknown or other
  misc_feature (225)..(225): n is a, c, g, or t
  modified_base (497)..(497): a, c, t, g, unknown or other
  misc_feature (497)..(497): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
tcagtcgatcacgtcacgaccggtgctcgatttagagtagtgatcgaggggggggtccctgagactctcctgtgcagcctctgcattcacctttagaacttatttaatgagctcgggtcccgccacgcctccgaggggaaggggtctgggagtgggtaggccagctaattaaaccaagatggaacgtagaaaaatctatgtggactctggtgaacgggccattcnccatctcagagacaacgccaagaactcaactgacgactgacacgtatcggaacggccgtgacggaggcctaacggacgaccggtctggtagtacttctgtcggacgagaccgccccaagtcggacggactagacggtgggacacgtacgtactttcgacctacgtggggaccacgggtacctggtaccaccgtttcctacctacgacgccgtacccaacggaggccctaagtccggtaccttcccgtcggccctacctcctaccgaacggcncctaaccgttggcggggtacaacgtccggccggtcccgtaggtcctcggtccggttaggacgtaacggtactaccgttaacacgtgtactcggactacggcgtacgggtctggacgtaacggctacgtacgtacgtnang

SEQ ID NO: 222407 - DNA, 790 bp, Homo sapiens
  misc_feature: GYAE6OF02J2564.38.4.A04.1.454.CMB.1.raw
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
  modified_base (457)..(457): a, c, t, g, unknown or other
  misc_feature (457)..(457): n is a, c, g, or t
  modified_base (787)..(787): a, c, t, g, unknown or other
  misc_feature (787)..(787): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagccctccgagggaaggggctgggaggtgggtggccagcattaaccagatggaacgtagaaaaatctatgtggactctggtgaaggcctattccgcattcncagagacacgctaagaactcactgtggctggcactagtcggaacggcctggacgaggaccgaccgacgtaccggnttggaggttaccttcgtggtgaccgaacgcccgacccccgtaaggtcggaagggtcctaacggacggggttacgggacgtaccggttaccgtaacttttcgggaacccgttacgggttccgggggaaccgttaaccggggtaacccttcgggttaaccccncccgggttacttcccgtaccgaacccggtccctaccccggaaaccggtacccgggtacccgttaccgtacccggttccccgttcccccgtacccgtaccccgtaaccccgtcccgtaaccgtaccggacccgtacccgtacccggtccgggtacggggcccaaccgggtccggcccgggtcccggtcgggtacccggttcccgtacccgggtaccggtaaccgtaaccggttacccttacccgtacccgtacggtaccgtacgtccgtacggtacggtaccggcgggtccggtacgggtacggtaacgggacctacggtacgtaacggcngtg

SEQ ID NO: 222408 - DNA, 614 bp, Homo sapiens
  misc_feature: GYAE6OF02HA05F.38.4.A04.1.454.CMB.1.raw
  modified_base (196)..(196): a, c, t, g, unknown or other
  misc_feature (196)..(196): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgagggaaggggctgggagtgggtggccagcattaaccaagatggacgtagaaaaatctatgtggactntgtgaagggccattcgcatctccagagacacgcaagactcactgtgctgcacatgaacggcctggagaggcgacgacacggctgtgtacttcgtgtgcgagacgcccccagtcggagggtctacgaggtgggacgtcgtacgtactttgactacgtggggccaggggaccctggtacaccggttctccctcgacgtccctccgaccgtaacgggccctagtccggtcccttcccccgtggccctaccctcctccgaagcgccaccgtcggtcgggggcaccgaggcccggtcccgtggggtcctcggcccgtgggacctaacgggtaccctaccgttcccgacggttacgtacgtcggtaccgtgggtacggtccgggacgttccggacgaacggccggtaactaggtacgtcgagcg

SEQ ID NO: 222409 - DNA, 757 bp, Homo sapiens
  misc_feature: GYAE6OF02HWBWN.38.4.A04.1.454.CMB.1.raw
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (278)..(278): a, c, t, g, unknown or other
  misc_feature (278)..(278): n is a, c, g, or t
  modified_base (751)..(751): a, c, t, g, unknown or other
  misc_feature (751)..(751): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtgccagcattaaccaagatggacgtagaaaaatctatgtgactntgtgaggccatcgcatcncaganacacgcaagactcactgtgctgcacatgaacgctagagaggcgacgacacggcttgtgttacttntgtcgcgtacgaccgtccccagtcgacgggtactacgagggttgggactcgtaacgtaccgtttgaaccgtacggtacgggggcccaacggggtaacccttgggtacccgtacccggttccttacccgtcgaaccggtcccgtaaccgtaaccggaaccggtaccccgtacgttcccgggttcccccgttttacccccggtcgggtacccctaccccgtttaccccgtaaccgaaacgggtaccgtacccgttaacccggttccgggtaccgggggaccctaaaccggtccgggtacccgggtacccgggtttcggggacccgttaccgggtcccggttacgggtaaccggtaaacccgggttaccttaacccggttacccgttaaggtacggttaaccgttccggtaacccggtgggacccgggtccgggtcggtacggaccgtaacgggcccgtaacggtacgtaacggtntacggc

SEQ ID NO: 222410 - DNA, 565 bp, Homo sapiens
  misc_feature: GYAE6OF02I251I.38.4.A04.1.454.CMB.1.raw
  modified_base (330)..(330): a, c, t, g, unknown or other
  misc_feature (330)..(330): n is a, c, g, or t
  modified_base (369)..(369): a, c, t, g, unknown or other
  misc_feature (369)..(369): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcaattaaccaagatggacgtagaaaaatactatgtggactctgtgaagggccgattcgccatctccagagacaacgccaagaactcactgtggctgcacatgaacggcctgagaggcgacgacacggctgtgtacttctgtgcgagacgcccccagtggaggctacgagtggganctagtacttgactacgtcggggccaggaccctggtaccnccgtctcctcacgccctacccaccgaacgggcccagtccgtcccttccccncggcccaccctccaccaacgacnccacctccgcggggccacgacgccggcccgtcgggcctcgccgtcggtacgaacgtaccttaccgtccgacgtcgactcgacgtggacggcgggtcgcggacgacggcgacgagtacgnngn

SEQ ID NO: 222411 - DNA, 821 bp, Homo sapiens
  misc_feature: GYAE6OF02JJQ9S.38.4.A04.1.454.CMB.1.raw
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (820)..(820): a, c, t, g, unknown or other
  misc_feature (820)..(820): n is a, c, g, or t
tcagtcgatcacgtcacgaccggtgctcgatttagagtagtgatcagggtgggtccctgagactctcctgtgcagcctctgcattcacctttagtaactatttaatgagctgggtccgccagcctccaggggaagggctggagtgggtggccagcattaaccaagatggacgtagaaaaatactatgtggactctgtgaagggcgattcgccatcncagagacaacgcaagaactcagtggngctcacatagacgtaaccgcgtagacggacggaccgaacgacgacggtcttggtacttacttcgtggtacgacggaacgacccccgtacccgtaggacgggtaccggtacctaacggtaggggtacgggtaacctaccgtaacgtttacgttaccggtaaccgttacggggtaccggggaacccggtaaacccgggtaaccgttcggtacccgtaccccgttaccgtcccgtaccgtaacccgtccccgtaacccgaaaccggggtaacccggtccccgttacggttccccgggtttcccccctttacccccggtccggtacccctacccccgttaccgtaacccgaagtcccgtaacccgtcccgggtacggggtccgggaccctacggacccgggtccccggtacgggtaccgggtcccgtaccggtaccggttaccggggtaaccgaaaccggtttacccttacccggttacccggtaaggttaccgtaccggtaacccggtggttaccgggaccggggttacccggtacggtaccgggaacgggtaacccggccttacggtaacggagttccgng

SEQ ID NO: 222412 - DNA, 725 bp, Homo sapiens
  misc_feature: GYAE6OF02I78GU.38.4.A04.1.454.CMB.1.raw
  modified_base (166)..(166): a, c, t, g, unknown or other
  misc_feature (166)..(166): n is a, c, g, or t
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (348)..(348): a, c, t, g, unknown or other
  misc_feature (348)..(348): n is a, c, g, or t
  modified_base (720)..(720): a, c, t, g, unknown or other
  misc_feature (720)..(720): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagntggactagaaaaatctatgtacggactntgtagaacgggcctattccgactatctcagacgacaacgcaanaactcactgngctgacacatcgaacggcctggacgaggacgtacgacgaccggctagtcggtacttcgtggtgccgtaaggaccacccccgtagcggacgggccttaacgngggtagggactaccgtaccgtattttacggacgttacgggcggggacctaacggggaaccctcgggtaacctaccggttcctacccttaccgacgtcccctaccgaaccgtaaccgggaccacgttcccggttcccttacccccgtcgaccctacccgtacccttaccgacgtacgacccgtaccgtccgggtcggggaccctacgaccgggtcccggtcccgtccgggaccttccgggtcccgtacgggtacccggaacggttacccgttaaccgttaccgtaccgttacgaccgttaccgtaccggtccggtaacggccggggtacgttcccggaacgggttaccggaccggaccggttaacacggtacncgacg

SEQ ID NO: 222413 - DNA, 728 bp, Homo sapiens
  misc_feature: GYAE6OF02IOCNX.38.4.A04.1.454.CMB.1.raw
tcagtcgatcacgtcacgaccggtgctcgatttagagtagtgatcagggggctctcagagaggagccttagccctggactccaaggccctttccacttggtgatcagcactgagcacagaggactcaccatggaattggggctgagcttgggttttccttgttgcttagttttagaaggtgtccagtgtgaggtgcaactggtggagtcgtgggggagtcttggtccgagggcccgggggggtccctggagtaccttcctcctgtgcacgcctctgactattcctaccttttaagtaacttatttaagtgagtcgtcgggtcccgaccacgccctcggaaggggacggggcgtgggaggtgggtcgaccagactataaaccgaagtgtaggaacgtaagaaaaattcgttaagtgggtacgtaccttacgtagggtacggaaacgggtcccggtatttcccggaccctacttcccgtacccgtaaggaaccgaaaccgaaaccgacccgaaacgaacctaccgtacgtggttacggtacctacggaccacgtaacgttacgggaaccggtacccgtaggaacgggagggacccggaacgaaccggaccggtccgttaggttacgttaccgtttacgtggttacggaccggtaccgacccgtccccccgtaacgtagggtacccgggtacgttaccggtacggggtacggtacggtaccgttaacccgg

SEQ ID NO: 222414 - DNA, 571 bp, Homo sapiens
  misc_feature: GYAE6OF02GV16L.38.4.A04.1.454.CMB.1.raw
  modified_base (385)..(385): a, c, t, g, unknown or other
  misc_feature (385)..(385): n is a, c, g, or t
  modified_base (569)..(570): a, c, t, g, unknown or other
  misc_feature (569)..(570): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagaccgcccccagtggacgggctacgaggtgggagctacgtactttgactacgtcggggccgacgggaacctggtcaccgtctcctcncgcctccacgacgggcccagtccggtccttccccgtggcccaccctcctaccgaacgcgcctaccgtcggtcggggccacgacggccggccgtcgggcctcgccgtggtaccgaacggtaccttaccgtccgtacgtcgacgttcggtacgtggacggcggtcgcggacgacggccgagagtgnnc

SEQ ID NO: 222415 - DNA, 604 bp, Homo sapiens
  misc_feature: GYAE6OF02I33RX.38.4.A04.1.454.CMB.1.raw
  modified_base (600)..(600): a, c, t, g, unknown or other
  misc_feature (600)..(600): n is a, c, g, or t
tcagtcgatcacgtcacgaccggtgctcgatttagagtagtgatcagggggggtccctgagactctcctgtgcagcctctgcattcacctttagtaactatttaatgagcgtggtccgccagcctccgagggaaggggctgggaggtgggtggccagcaattaaccaagatggacgtagaaaaatactatgtggactctgtagaggccgattcgccatctcagagacacgcaagaactcagtgtgctgcacatgaacgctgagaggcgacgacgacggctgtgttacttcgtgtggcgacgaccgccccagtcggacgggctacgaggtgggacgcgtacgtacttcgacgtacgtggggaccgacggtacccgtcggtacctaccgtcctccgtcacgtccctaccaccgaccggcctacgtccggttcccttccccgtcgtccctccctcctaccgacgaccgccgtaccgtcggtccgggaccgacgccggccggccgtcggtccgtccgtccggtcggtaccgtaacgtaccgtccgtaccgtacggtctacgtcgacggtacggcggtcggcgtacggacgacggcggacgatgnagcg

SEQ ID NO: 222416 - DNA, 845 bp, Homo sapiens
  misc_feature: GYAE6OF02GXOR2.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcttgggttttccttgttgcttattttagaggtgtccagtgtgaggtgcaacgtggtggtagtcggtgggggagtcgttggtccgagggcccgggggggtccctggacgacctctccgttgtcgcacgcctctgctacttccaccttttagtaaccttaatttaatggtagtccgtggtcccgtccgacgtccctaccgaaggggaacgggtcgtgggaggtggggtcgaccgagcctaactttaaaccgaagtacgttacgggaacgtaagaaaaacgttccttaagtcggtaggtaccttacggttggttaagggaaaccggggtacccgttagtttacccggtacccgtagtcccgtacccggaaaggaaccggtaacccgaaaccgacccgtaaaaacgtaacccttaccgtaacgttcggggttacggtaccttcgggaccctaacggtaacgtttacgggaaacccggtactaaaggttaccgggaaagggtaccgggaaccggtaaacccggtaaccggaaacccgggttccgttacggggtttaaccgttaacccgtttcggttacggggtaacccgggtacggttaaacccgggtacccccggtaaccccccccggttaaggttaacgggggttacccgggttaccgttaaaccggggtacggggtttaccggggtaccgtttaaaccccggg

SEQ ID NO: 222417 - DNA, 733 bp, Homo sapiens
  misc_feature: GYAE6OF02IWRKC.38.4.A04.1.454.CMB.1.raw
  modified_base (191)..(191): a, c, t, g, unknown or other
  misc_feature (191)..(191): n is a, c, g, or t
tcagtcgatcacgtcacgaccggtgctcgatttagagtagtgatcagggggggtccctgagactctcctgtgcagcctctgcattcacctttagtaactatttaatgagctggtccgcagcctccgagggaggggctggagtgggtggccagcattaaccaagatggacgtagaaaaatactatgtgactntgtgaaggccattcgccatctcgagagacacgccaagactcactgtgctagcacatgacggctgagacggcgacgacgacggctgtcgtacttcgtgtggcgagccgcccccgagtcggcgggctacgaggtgggacgctaaccggtactttcgaccgtacggtcgggggacccgtacggggaacccgtggtacccgtaaccgttccctacccgtcaccggtacccctaccgaaccccgaacggggtacccctacggtttaccccggttccccgtttccccccggtcgggaccccttaccccgttacccgttaacccgaaaccggtaccgtaccctacccggttccgggtcgggggaaccctaccgggaccggtacccggggtccccggttaggggtcccgttacggcccggtttacgggtaacccgtaacggggttaaccttacccgtacccgtagttaccggtacgttaccgtacggtacggaaccgggcggggtaacctcgggaaccgtaacgggaccgtacgaggttacgtcggatcg

SEQ ID NO: 222418 - DNA, 542 bp, Homo sapiens
  misc_feature: GYAE6OF02F4BZF.38.4.A04.1.454.CMB.1.raw
  modified_base (306)..(306): a, c, t, g, unknown or other
  misc_feature (306)..(306): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
tcagtcgatcacgtcacgaccggtgctcgatttagagtagtgatcaggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtcggggggtccctgagactctcctgtgcagcctctggattcaccttcagtggcttttagcatgaacgtggggtcccnccgaagggcctccgaaggggaaggggctgggagtcgggtctcatccattacggtagtaggtagtcgtcactatatactacgcagtactcagtgaacgggccattcacatcctcagacgacaacgccaagactcactgtancgtanacaaatgaaacngcctagagacgcgagacncggctgttcctattacgtggtgtacggaaggtaactaaccgtacttacgttactcgttaag

SEQ ID NO: 222419 - DNA, 580 bp, Homo sapiens
  misc_feature: GYAE6OF02FTKZU.38.4.A04.1.454.CMB.1.raw
  modified_base (579)..(580): a, c, t, g, unknown or other
  misc_feature (579)..(580): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctcagagacaacgccaagactcactgtggctgcacatgaacgcctgagaggcgacgacacggctgtgtacttctgtcgcgagaccgccccagtggacggcacgaggtgggacgcgtacgtacttacgacgtacgcgggccgacggtaccgtggtccaccgtctcctcacgccctccgaccgacggccctagtccggttccttcccccgtgccctaccctcctaccgaacgacgccaccgtcgggtcggggaccacggcggtccggccgtcgggctcgccgtggacgtaacggtacctaccgttccgacgtcgtacgtacggacgtggaccggtcgggacgtcggacgacggcgacgtagagcgnn

SEQ ID NO: 222420 - DNA, 647 bp, Homo sapiens
  misc_feature: GYAE6OF02HGEZA.38.4.A04.1.454.CMB.1.raw
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
  modified_base (407)..(407): a, c, t, g, unknown or other
  misc_feature (407)..(407): n is a, c, g, or t
  modified_base (591)..(591): a, c, t, g, unknown or other
  misc_feature (591)..(591): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
tcagtcgatcacgtcacgaccggtgctcgatttagagtagtgatcgagggggggtccctgagactctccttgtgcagcctctgccattcacctttagtaactatttaatgagctgggtccgccagcctccaagggaaggggctggagtgggtgccagcattaaccaagatggacgtagaaaaatctatggtggactctgtgaacgggcctattcgccatcctcagagacaacgccaaagactcactgtcgctgcantgaacggctgagcggcgacgtacncggctgtcgtacttcgtagtcgcgtagaccgccccctaagtggacggtctacgtaggtgggactccgtacgtacttttgacgttccggtggggccaacggggtaccctggccgtaccggtcctaccnccgacgtcccctaccgaacggtaaccggccctacgttcccgtccgttcccccgcgggtaccctacccgtccgtaaccgaagtccgcccgtaacccgtcgggtacgggaccctacggccggtacccgggtcccgtacgggtccgtccggtccgtcggtaccaacggttcctaccgttcgacgtanacgtacgtacgtggccggtcgggtctacggaccggacggtccacgtagtcgnancg

SEQ ID NO: 222421 - DNA, 652 bp, Homo sapiens
  misc_feature: GYAE6OF02FSZEK.38.4.A04.1.454.CMB.1.raw
  modified_base (247)..(247): a, c, t, g, unknown or other
  misc_feature (247)..(247): n is a, c, g, or t
  modified_base (649)..(649): a, c, t, g, unknown or other
  misc_feature (649)..(649): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgagggaaggggctggagtgggtggccagcaattaaccaagatggacgtagaaaaatctatgtggactctgtgaagggccgattcgccatctccagacgacaacgccaaagactcactgnggctgcacatgaacggcctgagaggcgacgacacggctggtcgtacttctgtggcgagaccgcccccagtggacgggctacgagggtgggacgtacgtacgtacgttttcgacgtacggtcgggggacccgaacggggtaacccctgggtccgtaccgtccgtccctccacggtccctacccgaccgtaacgggcccctacgtcccggttccccgttcccccgtcgggcccctacccctttcccacccgaacggccgaccgtacccgtccgtcgggggaccaacgtccggacccgggtcccggtccgggtctcggtcccgtggtaccgaacggtacctacccgttcgacggtcgcgtcggactcggacggccggtcgtacgacggacggcgacgtatggtcntcg

SEQ ID NO: 222422 - DNA, 642 bp, Homo sapiens
  misc_feature: GYAE6OF02IQMP1.38.4.A04.1.454.CMB.1.raw
  modified_base (338)..(338): a, c, t, g, unknown or other
  misc_feature (338)..(338): n is a, c, g, or t
tcagtcgatcacgtcacgaccggtgctcgatttagagtagtgatcagggggggggtccctgagactctcctgtgcagcctctgcattcacctttagtaactatttaatgagctgggtcccgccagcctccagggaaggggctggagtgggtggccagcattaaaccaagatggacgtagaaaaatactatgtggactctgtggaagggcctattcgccatcctcagagacaacgccaaagaactcactgtggctgacacatagaacggcctgagaggcgacgacacggctggtgtacttctgtgcggagacgccccatggagggctacgaggtggganctacgtacttgacttaaggcggggccgaacggggtaaccctggtacaccggttctcctcagccctcccgaaccgaacgggcccacgttccgtccttcccccgtcggaccctaccctccgtaccaacgacgccacctcgtcggggaccacgtacgcgggcccgtacgggtctccggtcgtcggtaacgtaaccgggtaaccttacccgttaccgtaccggtacgtacgttcggaaccgttaggaaccggaccggggtaccgtacgggaccggtaaacgggcggtacccaaggttaccgagtagac

SEQ ID NO: 222423 - DNA, 797 bp, Homo sapiens
  misc_feature: GYAE6OF02GF16D.38.4.A04.1.454.CMB.1.raw
  modified_base (788)..(788): a, c, t, g, unknown or other
  misc_feature (788)..(788): n is a, c, g, or t
tcagtcgatcacgtcacgaccggtgctcgatttagagtagtgatcaggggggggtccctgagactctcctgtgcagcctctgcattcgacctttagtaactatttaatgagctggtccgccagcctccagggaaggggctggagtgggtgccagcattaaccaagatggacgtagaaaaatctatgtggactctgtgaagggccgattcgcatctccagagacacgccaagactcgactgtcggctagacaacagtacgaaccggcctaggacggagggaccgaacggaaccaacgggtcttcggttacgttaacctttctggttacggcggacggtaccgccccccgagttcggacgggactaacgtagggtgggtacgacgttaaccgtacgttttcggaaccttacgggtacgggggacccgtaacggggtaacccggtcggtaccggtacccgtttcctcccgtaccgaccggtaccctacccgaaccgaaccggggaccctaccggtttccggttacccccttccccgtccgggtaccccgtaccccttacccgtacccgaaacgaccgtacccgtaacccggttccgggtaacggggacctaaccggaccggtaccccgggtcccggttacggggcccgttccgggtacccggttccgggtaaccgtaaaccgtacccgtttaccgttaacccgtaccgtacggtaccgtaccggtaccggttgggaaccgggcccgggttaccggtacggaccggtaaaccggccggttaccgaacggtanccgttgacg

SEQ ID NO: 222424 - DNA, 670 bp, Homo sapiens
  misc_feature: GYAE6OF02FUZTL.38.4.A04.1.454.CMB.1.raw
  modified_base (278)..(278): a, c, t, g, unknown or other
  misc_feature (278)..(278): n is a, c, g, or t
  modified_base (666)..(667): a, c, t, g, unknown or other
  misc_feature (666)..(667): n is a, c, g, or t
  modified_base (670)..(670): a, c, t, g, unknown or other
  misc_feature (670)..(670): n is a, c, g, or t
tcagtcgatcacgtcacgaccggtgctcgatttagagtagtgatcaggggggggtccctgagactctcctgtgcagcctctgcattcacctttagtaactatttaatgagctggtccgccagcctccagggaggggctggagtgggtggccagcaattaaccaagatggactagaaaaatctatggtgactcgtgtaggaagggccgattcgccatcctccgaagacgaacaaccgccaaagaactcacgtgcggctgcacagtgaaccggctagagnggcgacgacgacgctgtcgtactcgtgtgacgagaccgccccagtggacggctaagagggtggacgtaccgtaacgttacgttacgacgtacggtccggggaacccgtaccgggaacccgtttcgggaccctacggtccctccgtccaccgtacccacccgaaccgtacggccccgtacgtcccggttcccttccccccggcggtacccctacccgttcccgaccgtacgaccgtaccgtacccgtcgggtcggggaccaacggtccggcccggtcccgtacgggtccgtaccggtccgtacggtaccgtaacgtaccttaccgttaccgacggtcgtacgtccggagtcgggacggccgggtccggtagacggacgcgtacaggtcnncgn

SEQ ID NO: 222425 - DNA, 586 bp, Homo sapiens
  misc_feature: GYAE6OF02F7V94.38.4.A04.1.454.CMB.1.raw
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
  modified_base (389)..(389): a, c, t, g, unknown or other
  misc_feature (389)..(389): n is a, c, g, or t
  modified_base (582)..(582): a, c, t, g, unknown or other
  misc_feature (582)..(582): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtgccagcattaaccaagatggactgaaaaatctatgtgactctgtgaagggccattcgccatctccagagacacgccaaagaactcactgtggctgcacatcgaacggcctgagaggcgaacgacacggnttgtgtacttcngtgacgagaccgccccagtgacgggtctaacgaggtgggagtcctaacgtactttgactacgtcgggggaccagggaaccctggtacccaccgtctccncgacgccctcccaacgaccggccacgtcccggtcccttcccctcgcctaccctccgtaccgaacgacgtccaccgtcggtacgggccacgacggccggccgtcggcgtaccgtcgtcgtacgaacggtacctcgtaccgcgtacacgtcgacgtcggacggcggctcggacgtacggcggtaccagtacgcgngtac

SEQ ID NO: 222426 - DNA, 758 bp, Homo sapiens
  misc_feature: GYAE6OF02F0RXC.38.4.A04.1.454.CMB.1.raw
  modified_base (116)..(116): a, c, t, g, unknown or other
  misc_feature (116)..(116): n is a, c, g, or t
  modified_base (571)..(571): a, c, t, g, unknown or other
  misc_feature (571)..(571): n is a, c, g, or t
tcagtcgatcacgtcacgaccggtgctcgatttagagtagtgatcagggggggtccctgagactctcctgtgcagcctctgcattcacctttagtaactattaatgagctggtccnccagcctcagggaagggctggagtgggtggccagtcaattaaccgaagactggacgtagaaaaactactatggtggactctggtagaagggccgtattcggctagtcctaccgaagtacgaacaacgtaccaaaagtactcaacgttgtggctacgatacatacgaacggtccgtaggacggagcgaaccgaacacggttaccgtaggttactacgtttccgtggtcggaggacggaccccgtaccccaacgtgggtaacggtccaaacgtggtaccggggaacgtaccgttacggtaacgttttacgaaccgttacgggtacggggaaccggtacccgggtaaaccgtttcgggtacccgttacccgtcgttaaccccgcgaaccgtccccgtacccgaacgaacccgggaccctacgtcccgttcccgtaccccgtcgccgtcccgtcgtccnccgacggactccgtacccgccggacgacgaccgtacgacccggtcggacccgtcggtacgtccggtaccgtaccggttacgtaaccggtaccgttaccgaccgttacgtacgtaaccggtcccgtaaggtcgtaaccgggccgggtaccgtacgggtaccgtacggaacggtactaacggtcaacgg

SEQ ID NO: 222427 - DNA, 773 bp, Homo sapiens
  misc_feature: GYAE6OF02JQVHP.38.4.A04.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (770)..(770): a, c, t, g, unknown or other
  misc_feature (770)..(770): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctgggagtgggtggccagcattaaccagatggacgtagaaaaatactatgtggactctgtagaagggtccgtagttcgccgatcctccgagaagactaaccggaccaagaacctcactgtggactgcctangtagacggcctgacgaggcgacgacnggtctgtcgtacttntggtgcgacgaccgaccccagtcggcggcctacgaggttgggaccgcgtacgttcgttagacgttacggtcggggaccgacggtaaccccgtgggtccctaccggtttctacccgtacgtacccgtacccgtacccgaaaccggtaacccggggtacccctaaccggtttaccccggttaaccccctttccccccgggtaccggtacccccttacccccgttaccccggttaacccgtaaaccgggacccgtaacccgtaccccggtttacccgggacccggggggacctaaaccgggacccggggtacccggtaccccgggttccgggtaccggttccggtacccggttcgggttaacccgggaaacgttaacccgttacccgttacccgtacggtacgtaccgtacggtaccggtacgggtacggtcggacgtcgggacgtacggacggtcacggtgntgc

SEQ ID NO: 222428 - DNA, 594 bp, Homo sapiens
  misc_feature: GYAE6OF02GCH65.38.4.A04.1.454.CMB.1.raw
  modified_base (244)..(244): a, c, t, g, unknown or other
  misc_feature (244)..(244): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcatgngctgcacatgacgcctgagaggcgaacgacgacggctgtgtacttctggtgcgagacgcccccacgtggagggcctacaggtgggagtctacgtactttgactacgtggggaccacgggtaaccctggtccgaccgtcctcctcgacgccctccacgacggccctacgtccggtcccttccccgngcccnccctcccaccgaagcgccaccgtcggcggggaccacgaccggccggcccgtgggtcctcggcccgttggtaccaagggtacccttaccgtaccgacgtgacgtcgaccggtggtacggccgggtcgtcggacggtacggccgacgtaaggtacggctgcg

SEQ ID NO: 222429 - DNA, 681 bp, Homo sapiens
  misc_feature: GYAE6OF02JTL7Q.38.4.A04.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagctgggttttccttgttgcttatttagaggtgtccagtgtgaggtncaactggtggagtcgtgggggagngttggtcgaggtccgggggtcctgacgctctcctgtcgcacgcctcgtcgctattacctaaccgttttaagtaaacttaattttaatggtaagtcgtcgggtacccgccgacgcctacgaggggtaacgggcgtggaggtgggtcggccaggtcaacttaacgacgaggtacggtaagtaacgtaaaaacgtcttacgttggacgtactctaggggtacggtaacgggccgttaacgtcgaccgtatacccgtaccgagtaacgacccgaaacggaactaaaccgaaacctacccgtacggtaacggtcggtaacgtcgtacaacgtacgacggtaaccgcgtacgggagaaggccgaacgacgtcggacgttgtacgttctacgtggtccgtaacggacgtacccgccccggtaagccgggaacgggtacccgttacggacgggtaggtacggtaccgttaaccggg

SEQ ID NO: 222430 - DNA, 697 bp, Homo sapiens
  misc_feature: GYAE6OF02J1QR3.38.4.A04.1.454.CMB.1.raw
  modified_base (218)..(218): a, c, t, g, unknown or other
  misc_feature (218)..(218): n is a, c, g, or t
  modified_base (283)..(283): a, c, t, g, unknown or other
  misc_feature (283)..(283): n is a, c, g, or t
  modified_base (692)..(692): a, c, t, g, unknown or other
  misc_feature (692)..(692): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatactatgtgactctgtgaggccatcgccatctccaganacacgccaagactcactgtgctgcacatgaacggctgagaggcgacgacacggctgtgtacttcngtgcgagaccgccccagtcgacgggcctacgaggtgggacgtcgtaaccgtcgtttacgaccgtacgtcgggggaccaaggggtacccctggtccgacccgttcctacctaccgcgtacccctaccgacccgaacgggcccctagttcccggttacccttccccccggtacggtcccctaaccccttcccgtaccgtaaacgaccgtaccctacccgtaccgggttcggggacccgaccgtaacggtccccgggtcccggttgggtaccctccggtacccggttacgggtacccgtaaacgttacccttacccggttacccgttacggtaccgtaacgtcccggtacggtacgggtaccggaccggggtccgtacgggtaccgaacgggttccgacgttaaggacgtanctacg

SEQ ID NO: 222431 - DNA, 683 bp, Homo sapiens
  misc_feature: GYAE6OF02JJP3N.38.4.A04.1.454.CMB.1.raw
  modified_base (109)..(109): a, c, t, g, unknown or other
  misc_feature (109)..(109): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (676)..(676): a, c, t, g, unknown or other
  misc_feature (676)..(676): n is a, c, g, or t
tcagtcgatcacgtcacgaccggtgctcgatttagagtagtgatcgagggggggggtccctgagactctcctgtgcagcctctgcattcacctttagtaactatttaangagctggtccgccagcctccgagggaaggggctgggagtgggtggccagcaattaaccaagatggacgtagaaaatctatgnggactctgngaggcattcgcatcncagacgacacgccaaagactcactgtgctagcanatacgaacgctgagaggcacgacncggctgtcgtacttcgtgtgcgacgaccgccccagagacgggctacggaggtgggactacgtacgtacttgacgtacggcggggacacgggtaaccgtggtaccaccggttcctaccgtacgaccgtccctaccgaaccgacgggccctacggttccgtaccccgttccccgtcggaccctacccgtaccgtaccgaaacgtacgtacccgtaccgttacgggaccggggacctaccggtaccggtcccgggtacccgtcggggtaccttccgggtaccgttacgggtaaccgtaaccggttaaccgttacccgttccggaacgttacgtaccgtaccgtaacggtcgggaacggtccgggtaccgttacgggaccgaacgggtccgtaacgtaacggtacgngccgtag

SEQ ID NO: 222432 - DNA, 873 bp, Homo sapiens
  misc_feature: GYAE6OF02IWIQO.38.4.A04.1.454.CMB.1.raw
  modified_base (296)..(296): a, c, t, g, unknown or other
  misc_feature (296)..(296): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgagggaaggggctggagtgggtggccagcattaaccaagatggacgtagaaaatactatgtggactctgtgaaggccgattcgcatctccagagacaacgccaagaactcactgtggctgcacatacggacgcctgagaggccgaacgacgacggcgtgtcgtacttntgtgacgacgaccgccccacgtggacggactagcggtgggacgtaccgtacgtacctttaggacgttacggtccggggaccgtaaccgggtaacccgttcggtaccctaccggttcctcccgtaccgacgtaccccttacccgaacccggtaaaccggggtccccttaaccgggtttccccggttttacccccgttccccccggttacgggtacccccttaacccccgttacccgttaacccgaaaccgggacccgtaccccgttaacccggttacccggggtaccgggggtacccctaaccggggtaaacccgggtcccccgggttaaccccggggtttcccggggtacccggttaccggggtttaccccgggtttaccgggttaaaccccgggtaaaccggggtttaaccccttttaacccccggtttacccgggtaaacccggtttacggtaccccggtttaacccgggtttaaccgggttacgggggtaacccggggttaccccggggggtaccgtttaacggggacccggttaaacggggtacccgtacgggttaacgtacggtcctagccg

SEQ ID NO: 222433 - DNA, 618 bp, Homo sapiens
  misc_feature: GYAE6OF02GHW2Y.38.4.A04.1.454.CMB.1.raw
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggactgaaaaatctatgtggactctgtgaagggccattcgccatctccagagacaacgccaaagaacncactagtggctgcacatgaacggctgagaggcgacgacacggctgtntacttcngtgcgagacgcccccanggagggctacgagtggganctacgactttgactacgtggggccaagggaaccctggtaccaaccgtctaccctcaacggccctacccgaaccgaacgggcccagtccggtcccttcccccgtggaccctaccctcctaccgaaacgtacaccgacccgtacggtcgggggcaacgtacggccggcccgtaggggcctcggcccgtaggttaccaaagggaccttaaccgtccgtaacgtaggtactcggaacgttacgggacggtccggggtaccttacgggaccgtaaacgggcctaccgaagtacgngan

SEQ ID NO: 222434 - DNA, 736 bp, Homo sapiens
  misc_feature: GYAE6OF02GWFGD.38.4.A04.1.454.CMB.1.raw
  modified_base (228)..(228): a, c, t, g, unknown or other
  misc_feature (228)..(228): n is a, c, g, or t
  modified_base (734)..(734): a, c, t, g, unknown or other
  misc_feature (734)..(734): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtggaggcctattcgcatctccagagacaacnccaagaactcactggtgctgcacatgaacggcctaggagacggcgacgacgacggctgtgtacttctgcgcgacgaccgcccccacgtagggacgggacctaaggtagggtgggacgaccgttaacgttactttacgaaccgtacgggtacgggggacccgaaccggggtaaccctgggtacccacccggtccttcctaccgaccgtcccctacccgaacccggaaccgggtcccgtacgttccccgggtttaccccttcccccggtccgggaccccctaccccctttacccgtaacccgaaaggcccgtaccgtacccccggttacggggaccgggggtacccaccgggacccggcccgggtaccccggtggggtacccgttccgggccgttaccgggtaccgtaaccgggtaaccctttacccgtacccgtacggtagtaccgttccggacgtcgggaacggtccgggtaccgtcgggacgtaccggggcgtacgaagtcgagntg

SEQ ID NO: 222435 - DNA, 644 bp, Homo sapiens
  misc_feature: GYAE6OF02JA13Q.38.4.A04.1.454.CMB.1.raw
  modified_base (395)..(395): a, c, t, g, unknown or other
  misc_feature (395)..(395): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcaattaaccaagatggacgtagaaaaatctatgtggactctgtgagggccattcgcatctcagagacacgccaagaactcactgtggctgcacatgaacggcctagagaggcgacgacgacggctgtacgttacttcgtgtgcgacgaccgccccagtggacgggtctacgagggtgggacgtacgtacgtacttttacgcggtacgggggaccaagggtaccctggtaccaccgtctccncacgccctaccgaccggaacggtcctacgttccgtcccttccccgtcggccctacccctcctaccgaacgaccgtcccgtaccgttcgggtaccggggcctaccggccgggtacccgggtcccgtacgggtccgtcccggtcccgttacgggtaccgaacgggttacccttaccgtacccgtacgtcgtactcgtacgtcggaacgggccggtacgtgggacccgacgggctacgacgtacngangacg

SEQ ID NO: 222436 - DNA, 642 bp, Homo sapiens
  misc_feature: GYAE6OF02FYW58.38.4.A04.1.454.CMB.1.raw
  modified_base (244)..(244): a, c, t, g, unknown or other
  misc_feature (244)..(244): n is a, c, g, or t
  modified_base (339)..(339): a, c, t, g, unknown or other
  misc_feature (339)..(339): n is a, c, g, or t
tcagtcgatcacgtcacgaccggtgctcgatttagagtagtgatcagggggtccctgagactctcctgtcgcagccctctgcacttcacctttagtaactatttaatgagctgggtccgccagcctccagggaagggctggagtgggtggacagcattaaccaagatggactgaaaaatctatgtggactctaggtgaagggccattcgccatctcagacgacacgaccaaagaacctcactgnggctgccacatgaacggcctgagacggcgacgacgacggctgtagtacttctgtgacgagtaccgccccagtgaagggtctaacgaggtcgggancgttacgacgtttgacgtaacggttggggacctaacgggaacctggttccaaccggtctacctacgacgtccctaccaacggtacggccctagtccgttcctccccgtcgtccaaccctcctaacccaagtaccgacctaccgtacgtcggggtcaaccgacggccggtaccgttacgggccttacggcccgttagggtacccgaaacgggtaacccttaccgttacccggacgttcgacttacgacgtacggacgggtccggggtcgttacggacgaacggtcgtaccaggttacgctgacg

SEQ ID NO: 222437 - DNA, 904 bp, Homo sapiens
  misc_feature: GYAE6OF02HJMX3.38.4.A04.1.454.CMB.1.raw
  modified_base (160)..(160): a, c, t, g, unknown or other
  misc_feature (160)..(160): n is a, c, g, or t
  modified_base (235)..(235): a, c, t, g, unknown or other
  misc_feature (235)..(235): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagcgtggtccnccagcctacgagggagggctgggagtgggtcggcagcaataacaagatggacgtagaaaaatctagtgtggactntggtacggaacgggcctagttccgactacgttcctccgaagtacgaaacccgaaccggaccaaacggaacctaccacgtagtggacctgacaacacgtaggaaccggcgtaggacgaggaccggacgtaaccggacggtctaggtttcgttacctttgtcggtacggacgacgaccgcccccgtagtcggaccgggtacgtaaccgtagggtcggggtaactccgttaaccgggtttaacgtttacggtaaccgttacccgggtttcgggggtaaacccccggggtaaccggggttaaacccccggttcggggttaccccgtaacccccgggttccccgtttccccgtacccggtaacccgttcccccgggttaacccccgaaacccggggaaaccccgggttcccccgttaccgggttttaaccccggtttcccccggtttaccccccgttccgggtaccccccttaccccgttaaccccgtaccccgtaaaggttacccgacccggtacccggttacccgggttgggggacccctaaccgggccgggtccccgggtccgtacgggttcccgtcggggttacccgtacggggtttaaacccggaggttaacccctttcccggttaaccggtaaccggttacgtacccggttacggttcgtaaccgggg

SEQ ID NO: 222438 - DNA, 742 bp, Homo sapiens
  misc_feature: GYAE6OF02JRN5B.38.4.A04.1.454.CMB.1.raw
  modified_base (54)..(54): a, c, t, g, unknown or other
  misc_feature (54)..(54): n is a, c, g, or t
  modified_base (163)..(163): a, c, t, g, unknown or other
  misc_feature (163)..(163): n is a, c, g, or t
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (590)..(590): a, c, t, g, unknown or other
  misc_feature (590)..(590): n is a, c, g, or t
tcagtcgatcacgtcacgaccggtgctcgatttagagtagtgatcagggggaanaccgatgggcccttggtggaggcttggtccagccggggggtccctgacgactctcctgtcgcacgcctctgcattcacctttagtaactatttaatgacgctgggtccnccagccctccaggggaagggctggacggttgggnggccagcctaagttaaaccaggactggacgtagaaaaactcgtatcgtggacttctggtagacgggtccnttacgcctatccgtcgagagaccaacgccaaagacctcgacngtcggtactcgactaacagtgaacgtcccgnggtagacggggccaacgctaacgggctacgtcggttaccttcnggttcgacggacacccgaccccganacgggacgggtcctaacggagggtacgggaacgtacgtaccgttacgttttcgaaacgttccgacgggggtccgacggtacccgtgtacccgacgttcctacccgtcacgggtcccaccgtacccgacgggtaccccttaggtccccgttccccgttccccgttaccggacccgttaccccncccgggaacccacgggaccgtccgtaacccggtccttacggggacaacccgccgggttccggcccgtacgggtcccgtcgaacccggttgttaccggaacccgtacgttccctaaccggttccgtaacggtcggtacccgtcggttaccggg

SEQ ID NO: 222439 - DNA, 794 bp, Homo sapiens
  misc_feature: GYAE6OF02IMJH9.38.4.A04.1.454.CMB.1.raw
  modified_base (123)..(123): a, c, t, g, unknown or other
  misc_feature (123)..(123): n is a, c, g, or t
tcagtcgatcacgtcacgaccggtgctcgatttagagtagtgatcgagggggggggtccctgagactctcctgtgcagcctctgcattcacctttagtaacttatttaatgagcgtgggtccnccagcctccgaggggaaggggctagggaggtgggtcggccagcaattaaccaagagtggaacgtagaaaaaattctatggtcggactcgtaggtggaacggggccctattccgcctattcctaccgaaggaacaaccgaaccggcctaaagtaaccttcaaccgtggtacggccttgacctaacgaagtacggaaccggtccgtaaggacggacgggaccgaccggaaccgtacgggccttggtacgttactttcgtcggtggaccgacgacccggaccccctagtaggacgggtaccttaacgggaggtacggggactccgttaacggtaccgttttacgaaccggttacggggtccgggggaaccgaacggtaccccgtttggaccctaccgttctacccgtacgaccgtccctaaccgaaccggacggaccctacggtccgtacccgttccccgcgaccctaccctctaaccgaagcctaccgtacccgttcggcgggaccaccggtacggacccgggtccgtacgggccttaccggccgttacggttaccgaaaccgttacccgttaccgtaaccgtacggttacgtaccgtccggtaccggtaaggtaccgggcgggtacccgtacgggaaccgtacggggtaccgacggtaacggtcgagtgacg

SEQ ID NO: 222440 - DNA, 792 bp, Homo sapiens
  misc_feature: GYAE6OF02I0ZC0.38.4.A04.1.454.CMB.1.raw
  modified_base (790)..(790): a, c, t, g, unknown or other
  misc_feature (790)..(790): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccgagggaaggggctgggagtgggtggccagcaattaaccaagatggacgtagaaaaatactatggtggactctgtgagggcctatcgccatctccagacgacaaccgccaaagaactcactgtggactgcacatgaacggctaggagaggcgacgacgacggtctgtgtacttcgtgtcggcggacggaccgacccccgacgtagggacgggacctaacggacgggttaggggacgtcgttaacgtaccgtttacgaaccgtaccggtcgggggacccggaaccggggtaaccccgttcgggtacccgtaacccgtcccgttacccgtacgacccgtacccctacccggtaaaccccggaaccgggtaccccgtaccggttcccgggttcccctttaccccccggtccggtacccctaccccgttacccgtaacccgaaaggtacccgaacccgttaacccggtaccgggttacccgggggacccaaacccgggtaccggccccggggttacccggtcgggggtcccgtacccgggtcccggggttaaggtacccggtaaaggttacccgttaccgtttaaccgtaccggtacgtacggtaccggtaccggttagggccgggacgggtccgtacgggaccgacggaccgacgtagtacgctnag

SEQ ID NO: 222441 - DNA, 819 bp, Homo sapiens
  misc_feature: GYAE6OF02F9ZP6.38.4.A04.1.454.CMB.1.raw
  modified_base (228)..(228): a, c, t, g, unknown or other
  misc_feature (228)..(228): n is a, c, g, or t
  modified_base (818)..(818): a, c, t, g, unknown or other
  misc_feature (818)..(818): n is a, c, g, or t
tcagtcgatcacgtcacgaccggtgctcgatttagagtagtgatcagggggggtcccgtggagactctcctgtgcagcctctgcattcacctttagtaactatttaatgagctgggtccgccagcctccgagggaaggggctgggagtgggtggccagcattaaccaagatggacgtagaaaaatctaatgtaggacttctggtaggacgggccgtattcgccatccncagacgaacacgccaaagaacctcactcggtgctgcacatcggaacggcctggagacggcgaacgacgtacgggctggtcgtacttcgtgtggccgagaccgcccccctagtggacgggcctaacggcggtagggacggtacctaaccggtaccttttaacggtaaccggtcggggaccggaaaccggggaccccttagggtccccaacccggtttcctccccgttacggcggtccccctaccccgtaaaacccgggacgggtccccctaggtcccgggtttccccttccccccggtcccgggtaccctaccccccggttaccctacccggaaaaccgccggtccccgtaacccgttcccggtaccggggggtaccccaaaccgggccgggacccccggggtcccgtcggggttcccgtaaccggggttcccgtaccggggttacccaaaaccgggggttcctttaaccccggttaccggtacccgttaggggttaccctacggtaacccggttagggaacccgggccgggtcccggtaacgggttaccggaacgggttccccggaactagggttaacccggtaccgtgng

SEQ ID NO: 222442 - DNA, 677 bp, Homo sapiens
  misc_feature: GYAE6OF02JIOIB.38.4.A04.1.454.CMB.1.raw
  modified_base (222)..(222): a, c, t, g, unknown or other
  misc_feature (222)..(222): n is a, c, g, or t
  modified_base (671)..(671): a, c, t, g, unknown or other
  misc_feature (671)..(671): n is a, c, g, or t
  modified_base (674)..(674): a, c, t, g, unknown or other
  misc_feature (674)..(674): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctgggagtgggtggccagcattaaccaagatggacgtagaaaaatctatgtaggactctgtgaagggccattcgcatctcaganacaacgccaaagactcacgtgtcggctgacactatacgaacggcctgaaggaggcgaacggacacggctgtagtccttactggtgacggacgaccgccccagtggaacggctacgaggtggactcgacggtactttacggaacgttaccggtgggggtaccgaaacggggtaacccttgggacccgtaccgttcctaccccgtaccgaggtacccctacccgaacccggtaacgggtcccgtaaccgttcccggttcccttccccccggtcgggtaacccctaacccgttccctacccgaaacggcctaccgtaccgtccgggtcgggacctcgaccggcccggtccgtcggggaccctcggcccgtggtaccgtaaacggtccttaccttccgagtactacgtccgtacgtcggacggcggtcgacgggaccgaggccgcgaggtacncgntcg

SEQ ID NO: 222443 - DNA, 878 bp, Homo sapiens
  misc_feature: GYAE6OF02HILC0.38.4.A04.1.454.CMB.1.raw
  modified_base (293)..(293): a, c, t, g, unknown or other
  misc_feature (293)..(293): n is a, c, g, or t
tcagtcgatcacgtcacgaccggtgctcgatttagagtagtgatcaggggggtccctgagactctcctgtgcagcctctgcattcacctttagtaacttatttaatgagctgggtccgccagcctccgagggaaggggcttggaggtgggtggccaggcattaaccaagacgtggaacgtagaaaaaatctagtggtggacctctggtggaaggggcccagtttccgacctattcctacaaggagaacctaaacggacccgaaagtaacctctaacgtggtaggcctgaccanagttacggaaccggccgtaggaggacggtacgaccgaccgaggtccttaggtgtacctttcgtaggtgacggacgaccgccccctaagtcggagggcctaacgtcggggtagggccgacgtttacggtaacttttgggaaaccgttacgggttacggggggaccctaacggggggtaacccccttttagggggaccctttaccccggttacccttcccgttacggaacccgggttccccccctaacgtaaaccccggaaccggggtaccccgttacccggtacccggtttcccccgtttaccccccggtccgggtacccctacccccgttccccgtaacccggaaacgtaccccgtaaccgtacccggttacggacccggggtacccgtaccgaccggtccggggtacccgtccgggggtcctaccggtcccgttacgggtaacccgtaaccgggtaaccgtttacccgttaacccggttaacggtacggttaccggtacccggtacggttaaccgggtccggacccggggttccggtaaccggggaccggttaaccgggaccgaccgttaaggaacgcgtacgc

SEQ ID NO: 222444 - DNA, 587 bp, Homo sapiens
  misc_feature: GYAE6OF02FP8VF.38.4.A04.1.454.CMB.1.raw
  modified_base (454)..(454): a, c, t, g, unknown or other
  misc_feature (454)..(454): n is a, c, g, or t
  modified_base (585)..(585): a, c, t, g, unknown or other
  misc_feature (585)..(585): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcaattaaccaagatggacgtagaaaaatactatgtggactctgtgagggccattcgcatctcagagacaacgccaagaactcactgtggctgcacatgaacggcctgagaggcgacgacacggctgtgtacttctgtggcgagaccgcccccagtcggacgggctacgaggtgggagtctaacgtactttgactacggtcggggaccacggggaaccctggtccaccgtctcctcacgcctccaaccgacgggcccagtccggtccttcccccgtcggcctaccctcccaccaacgacncctaccgtcgtacgggaccacgacggccggtcccgtcgggctcgccgtaggtacgaacggtcctaccttccgacgtcgtacgtccgacgtggacggtccgggtactcgggacgacggcgacgtagtacgcngc

SEQ ID NO: 222445 - DNA, 622 bp, Homo sapiens
  misc_feature: GYAE6OF02GLFTH.38.4.A04.1.454.CMB.1.raw
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (507)..(507): a, c, t, g, unknown or other
  misc_feature (507)..(507): n is a, c, g, or t
  modified_base (528)..(528): a, c, t, g, unknown or other
  misc_feature (528)..(528): n is a, c, g, or t
tcagtcgatcacgtcacgaccggtgctcgatttagagtagtgatcagggggaagaccgatgggcccttggtggaggcttggtccagccggggggtcctgagactctcctgtgcagcctctgcattcaccttttagtaactatttaatgagctgggtcccgccaggccttccgaaggggaacgggctgggagtgggtcggccagctaattaacccaagactggacgtggaaaaactctatgtggacctcgtgngaacggcattcgccatcctacagcgaacacgaccaagaactcactgtagctnccaangtacgacgcctagagacggcgaccgacgacggacttgtacgtacttctaggtcgcgacgacnccccagtggaggctaacgnggacgagcgtaaccgtcttttacgacttcggtcgggaccacgggtaacccnggtacccgtacgtcgtaccncgacgtaccctcccaccgaacggccctagtccgtacccttccccgngcctacccgctaccagtaccncgtaccgtccgtgggtaccagaccgtccgaccgtgggaccctcggcccgttcgtacggacgtacgtaccttcgaccgtagcgttcgactacggg

SEQ ID NO: 222446 - DNA, 596 bp, Homo sapiens
  misc_feature: GYAE6OF02IE3SN.38.4.A04.1.454.CMB.1.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (313)..(313): a, c, t, g, unknown or other
  misc_feature (313)..(313): n is a, c, g, or t
  modified_base (594)..(594): a, c, t, g, unknown or other
  misc_feature (594)..(594): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcaattaaccaagatggacgtagaaaaatactatgtggactntgtgaagggccattcgcatctcagagacaaccgaccaagaactcactgnggctgcacatggaaccgtctgagacggcgacgacacggctggtctacttctgtgacgagaccgccccngtcgagggactacgaggtgggactcgtacgtctttcgacgtacggtcgggccaacggggtaccctggtccaccgtctcctcgacgtccctcgaaccgacggtcccacgtcccgttcccttccccgtcggccctacccgtaccctaccgaacgacgccctaccgtcggtcggggccacgcggccgccgtggcctcgccgtggacgaacgtaccttactccgacgtcgtacttccggacgtcggaacggccgggcgtacggcggaacggtcgaccgagtagcngc

SEQ ID NO: 222447 - DNA, 545 bp, Homo sapiens
  misc_feature: GYAE6OF02GARCB.38.4.A04.1.454.CMB.1.raw
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (542)..(543): a, c, t, g, unknown or other
  misc_feature (542)..(543): n is a, c, g, or t
tcagtcgatcacgtcacgaccggtgctcgatttagagtagtgatcgagggggggtccctgagactctcctgtgcagcctctgcattcacctttagtaactatttaatgagctgggtccgccagcctccagggaaggggctggagtgggtgccagcaattaaccaagatggacgtagaaaaatactatgtggactctgtgaaggccattcgcatctccagacgaacaacgccaagaactcactgtggctgcacatgaacggcctgagaggcgacgacacggctgtgtacttctgtgcgagacgcccccatggagggctacgaggtgggacgctacgtactttgactacgtcggggccacgggaaccctggtaccaccgtctcctcacgccctccaccgaacggccctacgtccggttccttcccccgtggcccnccctcctaccaacgacnccaccgtcgtcgggccacgcgcgccgnggctcgccgtgtcacgctactccacgtcnctcgcngcggcggcgtggacgacggcgacagtagcnncg

SEQ ID NO: 222448 - DNA, 628 bp, Homo sapiens
  misc_feature: GYAE6OF02I1C1U.38.4.A04.1.454.CMB.1.raw
  modified_base (627)..(627): a, c, t, g, unknown or other
  misc_feature (627)..(627): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaaagactcactgtggctgcacatgaacggcctgagaggcgacgacacggctgtgtacttctgtgcgacgacgcccctatggacgggtctacgaggtgggaacgccgtaacgtacttttgactacgtcggggccacggggtaaccctggtcctaccgtctccgtcacgccctaccaaccgaacgggccctacgtccggtcccttcccccgtcggtccctaccctccctaccaacgaccgtccaccgtcggtcggggaccaccgacggccggacccgtcgggcctcggtccgtacggtacgaacggtaccttaccgttacccgacgtcgtacgttaccgacggtcggtacggtccggggtccgtcgggtacgaacgggccggtactaaggtagcgtacgng

SEQ ID NO: 222449 - DNA, 775 bp, Homo sapiens
  misc_feature: GYAE6OF02H0R9R.38.4.A04.1.454.CMB.1.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (772)..(772): a, c, t, g, unknown or other
  misc_feature (772)..(772): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccaggggaaggggctgggaggtgggtggccagcattaaccaagatggacgtagaaaaatactatgtggactctgtgaagggccattcgcatctccaganacaacgacaagactcactgtgctgcacagtgaaccggctgaagnggcgacgacaggctgtcgtacttcgngcgtcgacgaccgcccctagtggacgggtactacgngggttacggggacgtccgttaacggtacttttacgaccgttaacggtcgggggaccgtaacgggtaccccgtggtacccgtacccggttctcccgtaccgtaccgtccccgtaccgaaccccgggtaaaccgggcccccgtaacgtttccccgggtttacccccgttttacccccccggtaccggacccccgttaacccccgtttacccgacccgaaacggtaccgacccgttaaccccggttcggggtaccgggggaccctaaccggaccgggtcccgggtccccggtccggggttcctcccggtaccggttacggggtaacccgaaaccgggtttacccttaaccggttcccggttaaccggttaacggtccgtaccggttacggaacgggtcgggtacccggcggttacgggcgtaaccgggtcacggtagtacgcgngac

SEQ ID NO: 222450 - DNA, 620 bp, Homo sapiens
  misc_feature: GYAE6OF02F68YQ.38.4.A04.1.454.CMB.1.raw
  modified_base (616)..(617): a, c, t, g, unknown or other
  misc_feature (616)..(617): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtgctgcacatgacgcctgagaggcgacgacacggctgtgtacttctggtgcgagacgcccccacgtggacgggctacgaggtgggagctaacgtacgttttagacttacgtcggggaccacggggtaaccctgggtaccaccggtctcctcgacgccctaccaccgaacgggcccacgtccggttcccttcccccgtcggccctacccctccctaccgaacgaccgaccacccgttccggtcgggggccacgacggcccggcccgtcgggcctcggcccgtgggtaccgaaacggtacccttaccgttccgacgttcgacgtcgacgttggacggccgggtcgtcgggacgaacgggcgaccgtagtacggnngcg

SEQ ID NO: 222451 - DNA, 756 bp, Homo sapiens
  misc_feature: GYAE6OF02IH7PJ.38.4.A04.1.454.CMB.1.raw
  modified_base (244)..(244): a, c, t, g, unknown or other
  misc_feature (244)..(244): n is a, c, g, or t
  modified_base (751)..(751): a, c, t, g, unknown or other
  misc_feature (751)..(751): n is a, c, g, or t
tcagtcgatcacgtcacgaccggtgctcgatttagagtagtgatcagggggggtccctgagactctcctgtgcagcctctgcattcaccttttagtaactatttaatgagctgggtccgccagcctccagggaaggggctggagtgggtggccagcattaaaccaagagtggacgtagaaaaatactatgtggactcgtgtggaaggccgattcgccatctccagagacacgaccaagaacctnactggtcgctgccacgagtacgaaccggcgtagagacggccgaacgaccgacggtcttggtagtaccgtttctggtcggtacggacgaccgaccccctagtacggacgggtacaccgaggtgggacgtacgtaccgtcgttacgaccgttacggacgggaccgaaccgggtaccctggtacctaccgttcctacccgtaccgacgtcccgtaccaacccggaacgggtccccgtacgttcccgttacccccgttaccccccggacggtacccctaccccgtaccgtacccgaacgtaccctaccggtaccccgttcgggtaccggggaaccctacccggaccgggtacccgggtcccggtccgggttacccgtccggtaccgggttaccggtaccggtaacgggttacccttaccggttacccgtacgttaccggtacgttccggtaccggtcgggacccgggtcgggtaccgtcggtaaccgtacccgggcgtacgaacgtcgcgngtacg

SEQ ID NO: 222452 - DNA, 654 bp, Homo sapiens
  misc_feature: GYAE6OF02FWC9K.38.4.A04.1.454.CMB.1.raw
  modified_base (263)..(263): a, c, t, g, unknown or other
  misc_feature (263)..(263): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccgattcgccatctccaganacacgccaagaactcactgtggctgcacatgaacgcctgagaggcgacgacgacggctgtgtactttacgtgtcgcgaggaccgcccccagtcggacgggtctaacgaggtcgggatcgtaacgtacgtttagacgttaaccggcgggaccgaacgggtaacccgtgggtacctacccgttccttccgtaccgacgtccctacccaaccggaaccgggccctagttcccggttcccttccccgtcggtcccacccttccgaacccgagaccgcctacccgtcggacggggacacgaccggtcccggcccgtcgggtcctcgggtcccgtacggtaaccgaacggtaccgttaccgttaccgtaccggttacgtaccgtaccgacgtacggg

SEQ ID NO: 222453 - DNA, 766 bp, Homo sapiens
  misc_feature: GYAE6OF02HDDU6.38.4.A04.1.454.CMB.1.raw
  modified_base (747)..(747): a, c, t, g, unknown or other
  misc_feature (747)..(747): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccacgggaaggggacgtggaggtgggtgggccgagcattaaccaagatggagtagaaaataactatgtggactctgtgaaggcgactcgcatcgtccagagacaacgaccaacgaacactactggtggctgcacatacgaacggcctggaagagggccgacgacgacggctgtgttaacttcgtggtgcggacgaccgcccccgactgggacgggactaacgagggttggggacgaccgttacggtactttttcggaccgttaacggtcggggggaccgaaccggggtaaacccgttcggtccgtaacccgttcctccccttacgcgtaccccctacccgtaaaccggaaccggggcccgtaccgtaccgggtttcccctttccccccggtcgggaccccttccccgtacccgtacccgtaaggaaccgtacccgtcccggttaaccgggtcgggggtaaccacccgaccggtcccgggtcccggtcggggtccgtccgggtaccccggttgggtaacccggtaaacgggttaccgttaccccttacccgaaccgttcggtaccttacggtaccgtcggggtaacggcccgggggcgttacgggaaccggaccgggtaccggngtaaaccgtgggactgacg

SEQ ID NO: 222454 - DNA, 758 bp, Homo sapiens
  misc_feature: GYAE6OF02J013N.38.4.A04.1.454.CMB.1.raw
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccacgcctccgaggggaagggtctgggagtgggtggccagcattaaccaagntcggacgtagaaaaactctangtcgactctggtggaggcctatcgcactctcgagacgacaccgcaagactcacgtggtgctcgcaacatagaacgcctaggaggacggcgaccaccgacgtcgtgttcgtacttgttgcggtaccggacgacccggacccccgtagtacgggacggtaccgtacggaacgggttaggggacgttaccgtacgttaccgtttacggtaacgtaccgggtaccgggggttaccggacccggggtaaacccgttcgggtaaacccgtccgttccgtacccgttacggaccccgtaccgtacccgaacgtaacccgggtccctacgtcccgttcccgtaccccgtcgtaccccgcccttccaaccgacgtaccgtccgtaacccggtccggggtacggaacccgtcggaccggtcccgtacccgggcggttaacccggccggttaccggttaccgggacttaaacccgggttcctacccgttaccggtacggcgttacgtccgtacggttacgggacgggtccggtacggtaaccggtcggacccgggcaaccggttacgacggngngcg

SEQ ID NO: 222455 - DNA, 858 bp, Homo sapiens
  misc_feature: GYAE6OF02JN2GY.38.4.A04.1.454.CMB.1.raw
  modified_base (119)..(119): a, c, t, g, unknown or other
  misc_feature (119)..(119): n is a, c, g, or t
tcagtcgatcacgtcacgaccggtgctcgatttagagtagtgatcagggggggggtccctgagactctcctgtgcagcctctgcattcactttagtaactatttaatgagctgggtccnccagcctccgagggagggctggagtgggtggccagcattaaccaagatggacgtagaaaaatactatagtggactcgtgtaggaagggccgattccggcctaatcctcaagagaacaaccgccaaagactcactggtggactcggcaacagtacggaccggctaggagacggaccgaccgacgacggtcttagtacgttcttacgtggtacgacggtacacccgtccccgacgtggacgggactaccggaggttaaggggcgttacgtaaccgtacggttttacgaaccggttcggttacgggggacccgtaacggggtaacccccgtgggttaaccccacccggttccctacgtacccgaacgtcccccgtaaacccgaacccggaaccggggtacccctaacgtcccccgggttttacccccgttaccccccgggtacccggtacccccgtacccccgttacccccgtaccgtaaacccgggcgtcccggttaaaccccggttacccggggtccggggacccgggaaccgtaaccccgggtcccggggtcccggttccgggtaccggtccccggttccgggttaaccgggttaaccgaaaccgggtttaacccgttacccggtttcccgtaacccggttacccgtaccgttaccgggtaaccggttcggggaccgggtacccggggtcggtaacccggggtaccggaacgggaccggtacgtaggaacgtcgacgcg

SEQ ID NO: 222456 - DNA, 728 bp, Homo sapiens
  misc_feature: GYAE6OF02JDMBO.38.4.A04.1.454.CMB.1.raw
  modified_base (118)..(118): a, c, t, g, unknown or other
  misc_feature (118)..(118): n is a, c, g, or t
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (727)..(727): a, c, t, g, unknown or other
  misc_feature (727)..(727): n is a, c, g, or t
tcagtcgatcacgtcacgaccggtgctcgatttagagtagtgatcagggggggtccctgagactctcctgtgcagcctctgcattcacctttagtaactatttaatgagctgggtccnccagcctccgaggggaaggggctggagtgggtggccagcaattaaccaagntggacgtagaaaaatctatggngactctgtaggaagggcctattcgccatcncagacacacgcaagactcacgtggtcgctgcanactgaacggctgaggacggacgacgaaccgaggtctggtagttacttacgtgtacggccgacgaccgcccccgagtagggacggtctaccgagtgggacacgtacgtacgttacgctacggtcgggaccgtacgggaacctggtccgaccgttctcccgttcacggtccctaccgaaccgtacggccctacgtccggttcccttaccccgtcggacctaccccgtccgaacccgtaaggacccgtacctccgtttccgggtaccgggaccctaccgggtaccgggccccgggttacccggttacgggcccgttacgggtaccccggttagggtaacccggtaaacggtttaaccctacccggttttaaccccggacgtttaccgtaccgggtaccgttacccggaagggccggttaccggggaccgttacggaacggttaaccggggctaaccggtaggtaaccgtcgtacgng

SEQ ID NO: 222457 - DNA, 909 bp, Homo sapiens
  misc_feature: GYAE6OF02F47VV.38.4.A04.1.454.CMB.1.raw
  modified_base (147)..(147): a, c, t, g, unknown or other
  misc_feature (147)..(147): n is a, c, g, or t
  modified_base (158)..(158): a, c, t, g, unknown or other
  misc_feature (158)..(158): n is a, c, g, or t
  modified_base (208)..(208): a, c, t, g, unknown or other
  misc_feature (208)..(208): n is a, c, g, or t
  modified_base (769)..(769): a, c, t, g, unknown or other
  misc_feature (769)..(769): n is a, c, g, or t
tcagtcgatcacgtcacgaccggtgctcgatttagagtagtgatcagggggaagacccgatgggcccttggtggaggcttggtccagccgggggggtccctgagactctccgtgtgcagcctctgcattcaccttagaactattaangagctggtccncagcctcgagggacgggctggacgtcgggtgccagtcaattaaaccagtntaggtacgtagaaaaaatctatgtacggacttctgtaggaacgggccctaatttccggaccctattccgttacccgaaggtccgaaccgtaacggaccaaacggtaacctcgaaccttaggttccggcgttacgacctacgtacgtacggaacccggtcccgttggtaacggtagggaccgtaacggtaaccgtaaccggtccgttaggttaaccggttaccttttacggttaacggtccgttacggaaccggtaacccggacccccctaacggttcgggaaaccgggtttacccaacgggttaacgggttacgggggaaccgttaccctaacgggtaacctttttccgggaaaccgtttaccgggtccgggggttaacccgggaacgggtaaccccgttcggggtaacccctaaccgggtaccttacccgtaacgtacccggtccgttaaaccccgacccggtaaccggacccgttaaaccggttccggttacccccgttaccccgtacggtaccccgtaccccgttaccgtacccggtaacgtacgtacccgttaaccnccgggtaacgggtcccgaccgttacggacccgggttcccgtaccggggcgtcggttaccccgggtacgggtaaccgtaaccggttaccgtttacgtccccgttaaagggttccctaacgttcccgtacggtaacccgggg

SEQ ID NO: 222458 - DNA, 732 bp, Homo sapiens
  misc_feature: GYAE6OF02FPNY5.38.4.A04.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (729)..(729): a, c, t, g, unknown or other
  misc_feature (729)..(729): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagccctccgagggaaggggctggagtgggtgccagcattaaccaagatggacgtagaaaaatactatgtggactctgtgaagggccatcgcatcncagagacagccaagactcactgngctgcacatgaacgctagagaggcgacgacacggtcttagtttacttcgtagtcggacgagacgcccccactggacgggctacaggtggagcttacgactttgactacgtcggggccaagggaaccctggtaccaccggtctcctacgacgtccctcccaacccgtaaacgggccccgtacgttaccgggttccctttacccccccggtgggtaccccctacccccgttaccccgtacccgaaaaccgggtaaccgcccgtaaaccccgtttcgggtaccgggggggaacccaaccgggtaccggggaccccgggttaccccggtacgggggtcccgtttacggaccccggtttacgggtaaccggtaaacgggttaccccgtttaaaccgtttaccccgtaacgggttacccgtaaggtcccggtaacgacgggtacggccggggtacgtacgggtaaccacgggttacggaccgtaagtacgagacgntag

SEQ ID NO: 222459 - DNA, 669 bp, Homo sapiens
  misc_feature: GYAE6OF02ILVOC.38.4.A04.1.454.CMB.1.raw
  modified_base (668)..(668): a, c, t, g, unknown or other
  misc_feature (668)..(668): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacgcctgagaggcgacgacacggctgtgtacttctgtgcgagacgcccccagtgaggctacagtgggagctacgtactttgacgtacgtgggccagggacctggtcaccgtctcctcacgccctacccgaccgaacgggcccacgtccggtccctttccccccgtcgggccctaccccgtccctacccgaaacggaccgtacccgtaacccgttccggtcggggggtcccaacccgaacggtccccggggccccgttacgggggccttcgggtaccccgtggggttaccgaaaccgggttacctttaacccgtttacccgtacccggttgtaaccggttccggtaacgtcgggacggtaccgggggtcccgtacggggacctaacggggcctaacccggagtaaggcacgng

SEQ ID NO: 222460 - DNA, 562 bp, Homo sapiens
  misc_feature: GYAE6OF02GFQQB.38.4.A04.1.454.CMB.1.raw
  modified_base (164)..(164): a, c, t, g, unknown or other
  misc_feature (164)..(164): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (558)..(559): a, c, t, g, unknown or other
  misc_feature (558)..(559): n is a, c, g, or t
tcagtcgatcacgtcacgaccggtgctcgatttagagtagtgatcgaggggggggtccctgagactctcctgtgcagcctctgcattcacctttagtaactattaatgagctggtccgccagcctccagggaagggctggagtgggtgccagcattaaccaagntggacgtgaaaaatctatgtggactctgtgagggccattcgccatctcagagacacgcaagactcactgtgctgcanatgaacgctgganaggcgacgcgacggctgtgtacttctgtgacgagacgcccccagtgacggctacgnggtggancgtactacgtttgaacttcgnggggaccaggggtaaccctggtccaccgtctacctcacgcctaccacgacggcccatccggtcctccccgtcgccaccctcctccgaacgcgcaccgtcgtacggggcaccgaggtccggaccgtcgggtacgtgtccgtggtaccgaacggtaccttacgttaccacgtgacgtcgacgtggacggcggtacgtacggacgacggtcgccacgtacgtnntcg

SEQ ID NO: 222461 - DNA, 687 bp, Homo sapiens
  misc_feature: GYAE6OF02FG5FN.38.4.A04.1.454.CMB.1.raw
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgccagcctcgagggaaggggctggagtgggtgccagcattaaaccagntggactgaaaaatctatgtggacctntggtgaagggccgattcgcctatcctccagagaccaacggccaagaactcactggtggctgcacntcgaacggcctgagacggcgtacgacgacggctgtacgtactttctgttggcggacgaacgcccccctaatgggacggggacttacgaggtggggagtccgtaacggtaccttttgaacgttaccggtggggaccgaacgggaaacccgtggtacctaccggtctccctactaccggtccctaccgaccctaacggggccccacgttacccggttcccttcccccggttaccggtacctacccccgttaccttacccgaacggtaccgaccgtaacccgtcgttcgggggcaccgtacgggccggtacccggtgggccgttaccggcgtcggttaaccgaccgggttacctaccgttcccgtaaccgtcggtacgttccgtactacggg

SEQ ID NO: 222462 - DNA, 878 bp, Homo sapiens
  misc_feature: GYAE6OF02JTAST.38.4.A04.1.454.CMB.1.raw
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctggagtcttgggttttccttgttgcttattttagaaggttgtccagtgtgaggtgcaagtgggtggagtcggtgggggaggtcgttgggtccgaggggtcccggggggggttcccctggacggtaccgttccgtcccgtggtcggccgacggtcccttcgtgcctatttcctaccttttaagtaacttaatttangtagtcgtcgggtaccnccgacgtccctaccggagggaacggggtcgtgggtaggtgggtcgggaccaggcctaaagttaacccgaaggtagtacgggtaacgtaacggtaaaaattaccgttaaggtacggttacggtactaccggttaggtacggggaaacggggtaccggttacgtttaacccggtacccgtacgtttacccgtacccgtaaaggaaccgtaaaccgaaaccccggaaccgtaaaccgtaaaccgtaccgtaaccggttacggttacggtaacccgtcgggtaacgaaccgtacggtaacccggtaaccggggttacccgttaagggaacgggaaccggggcccggaaccgggtaaacccgggtaaccgggttacggttacggtttaacccgggtttaactttccggttaacgggtaccggtaacccggggtaaggtacccccggtaacccccggtacggttaacgggtacccgggaccggtttaaccggaacggggtttacggggacggttacccggtttaaacccggg

SEQ ID NO: 222463 - DNA, 619 bp, Homo sapiens
  misc_feature: GYAE6OF02F8S3E.38.4.A04.1.454.CMB.1.raw
  modified_base (616)..(617): a, c, t, g, unknown or other
  misc_feature (616)..(617): n is a, c, g, or t
  modified_base (619)..(619): a, c, t, g, unknown or other
  misc_feature (619)..(619): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctcagagacaacgccaagaactcactgtggctgcacatgaacggcctgagaggcgacgacacggctgtgtacttctgtgcgagacgcccccagtcggagggctacgaggtgggagctacgtactttgacttacgcggggccacgggaaccctggtcaccgtctccctcgacgccctacccaccgaacgggcccctaagtcccggtccctttccccccgtggacccctaccccgtccctacccgaacgaccgcctacccgttcgggtacggggaccaccgacggcccgggtacccgtcggggctaccggtccgtggtaccgaacgggtacccttaccgttccgtaacggtcgtacgttccgacgtggacggccgggcgttcggacggtacggcgacagtacgnngn

SEQ ID NO: 222464 - DNA, 633 bp, Homo sapiens
  misc_feature: GYAE6OF02F2FHE.38.4.A04.1.454.CMB.1.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (387)..(387): a, c, t, g, unknown or other
  misc_feature (387)..(387): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccaggggaaggggctggagtgggtggccagcattaaccaagatggacgtagaaaaatactatggtggactctgtgaagggccgattcgccatctccagagacaacgccaagaactcactgtggctgcacatgaacggcctgagaggcgagacacggctgtntacttntgtgcgagccgccccagtggacggctacgaggtgggancgtacgtactttgactacggtcggggccgtaacgggacctcggtcaccgtctccncacgtccctcccgacgaccggcccacgtccggttcccctccccgtcgccctcccctcctaccgaacgacgccaccgtcggtcgggccacgaccggccggttttcccgacggtaccgtccggtcccgttacgggtaccgtaaccgggttaaccttaccgttacccgtaacggttactaccgtacgtaccggttaggaccggggtccgggtaccgtcgggaaccgacgggcgaacgtagtacgngngn

SEQ ID NO: 222465 - DNA, 728 bp, Homo sapiens
  misc_feature: GYAE6OF02G4UPK.38.4.A04.1.454.CMB.1.raw
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgtgtccgccagcctccagggaagggctggagtgggtggccagcattaaccaagatggacgtagaaaaatctatgtggactctgtgaagggccattcgccatctcagagacaacgccaagaactcactgtgctgcacatgaacggcctgagacggcgacgacacggctgtgtacttctgtgcgagacgcccccagtcggaggtcctaacagggtcgggagctaacgtacttttggaactacggtcggggtaccgaacgggaacccttcgggtacctacccggttccttaccgtccgacgtccctacccgaacccggaaacggggtcccctaacggttcccggttcccttaccccccgtcgggtacccctaacccccgttacccgtaccccgtaaaacgccggtaacccgtacccgttccgggtcgggggaccctacccggtacggaccccggggttccccgtcgggggtcccttcggggtaccccgtttacggggtaacccggtaaaacggttaccccgtttaacccgtttaccccggtaaccgggtttacgtacccggttacccggtaacccggg

SEQ ID NO: 222466 - DNA, 724 bp, Homo sapiens
  misc_feature: GYAE6OF02JLI61.38.4.A04.1.454.CMB.1.raw
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
  modified_base (723)..(723): a, c, t, g, unknown or other
  misc_feature (723)..(723): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtggaagggccgtattcgccatctccagagacaacgccaaagaactcactgtcggcgtgcacatggaacggcctggagaggccgacgacgacggcttgtgttacctttcgtgtgcgaggacccnccccagtggagggctacgnggtgggacgacgtacgtacgtttcgaccgttaggtccgggggcctaacgggtaaccccgttcgtacccgaccgttccgtacccttccggacgtccccgttaccccgaaccgggaacccgggtccccgtaccgtttacccgggtttccccgtttacccccccgtcggccccttaccccgttacccgttacccgaacggtaccgcccttaccggtccgggtacggggacctaccggaccggccccggtcccggtacgggtccctcggcccgttacggtaaccgtaaccggtacccttaaccgtaccgtacgtacggttacgtcccggtacggtacgggcgggtccgggtaccgacgggaccgacggccgtacaggtaacgcgtagng

SEQ ID NO: 222467 - DNA, 634 bp, Homo sapiens
  misc_feature: GYAE6OF02FS5ZI.38.4.A04.1.454.CMB.1.raw
  modified_base (630)..(630): a, c, t, g, unknown or other
  misc_feature (630)..(630): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacaacgccaagactcactgtggctgcacatcgaacggcctgaggaggcgacgacgacggcttgtgttacttctgtcggacgagacgcccccagtggagggctacgaggtcgggagcctaacgtactttcgacgttacggtcgggggacccacggggtaacccttcggtccgaacccgttccgtacccgtccgaacggccccttacccgaaccgtaacgggccccgtacttcccgggttcccttccccccgtcggccctacccctcccgtaccgaacgcgaccaccgtcggtcgggccacgcgccggccgtggcgtcgcgtcggtaccgagtacctaccgtccgacgtcgtacgtccgacgttcggacggccgggtcgtcggacggaacggtcggaaccgtagtacggtncgcg

SEQ ID NO: 222468 - DNA, 620 bp, Homo sapiens
  misc_feature: GYAE6OF02GFKCS.38.4.A04.1.454.CMB.1.raw
  modified_base (216)..(216): a, c, t, g, unknown or other
  misc_feature (216)..(216): n is a, c, g, or t
  modified_base (295)..(295): a, c, t, g, unknown or other
  misc_feature (295)..(295): n is a, c, g, or t
  modified_base (613)..(613): a, c, t, g, unknown or other
  misc_feature (613)..(613): n is a, c, g, or t
  modified_base (616)..(617): a, c, t, g, unknown or other
  misc_feature (616)..(617): n is a, c, g, or t
  modified_base (619)..(619): a, c, t, g, unknown or other
  misc_feature (619)..(619): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcaattaaccaagatggacgtagaaaaatctatgtggactctgtgaaggccattcgccatcnccagagacaacgccaaagactcactgtgctgcacagtgaaccggcctagaggaggcgacgacacgggctgtgtaccttntggtcgcgacgacgcccccacgtggacgggtcctacgtaggtgggacgcgtaacgtactttagacttaccggtgggggaccaaccggggaaccctggtacctacccgttccttccctcgacgccctcccgaaaccgacgggtcccctacgtcccgggttccctttcccccggtcggtacccaccccgtccctaccgaagaccgacctacccgtcggtcggggcctacgacggccggaccgtgggcctcgtctcgggtaacagtaccttactcgacgtcgatcggactgggaccgcgggtcaggaccgacggcacgtancgnngng

SEQ ID NO: 222469 - DNA, 611 bp, Homo sapiens
  misc_feature: GYAE6OF02FXCTN.38.4.A04.1.454.CMB.1.raw
  modified_base (285)..(285): a, c, t, g, unknown or other
  misc_feature (285)..(285): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggcattcgcatctcagagacaacgcaaagactcactgtgctgcacatgaacggcctgagaggcgacgacacggctgtgtacttntgtgcgagaccgccccagtggacggtctagaggtgggacgcgtacgtactttacgacgtaacggtcggggaccacggggtaaccctggtacctaccgtacttccctcgaccgtcccctacccgaacgaacggccctaacgtccggttcccttcccccgtcgcccctacccgtaccctaccgaacgccgtaccgtacctacgggtcggggaccacgacggtcccggccgtcggcgtcgccgttggacgtacgcctaccgtcacgtcgacgtcgtacgtcgggacgtccgggcgttacgggagaacggtcgacgtaacggtgcgatcg

SEQ ID NO: 222470 - DNA, 712 bp, Homo sapiens
  misc_feature: GYAE6OF02I824J.38.4.A04.1.454.CMB.1.raw
  modified_base (361)..(361): a, c, t, g, unknown or other
  misc_feature (361)..(361): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccagggaagggctggagtggtggccagcataaccaagatggacgtagaaaatactatgtggactctgtgaacgggccattcagcatctcagagacaacgccaagaattccctgtatctaacaaatacgaacaagtctacggagagtctaggaggaccgacgggcttttacggtattaactggttagactaaaagttattttgaaggttttagaagggtttagtaaacggggttnttaaacgttactttaacgggtacgttgggaccggttcggtcggggacccaaggggaaccgaccgggttccaacgttccctacctacacgttccccaccgaaccgaacgggtcccacgtccgttacccgtccccgtcggtccgccctcgacctaccggaggtccgaccgacccgtccggtacggacgacctacgaccgggcccgggtcccgtacgggtcctccgggttcccgtacggtaccgaacggttacccgttaaccgtttccgaacggtcgttacgttccgggaacgttagggccgggtacgggtaccggttcgggaccgtacgggaccggtcgacgtacggacngng

SEQ ID NO: 222471 - DNA, 708 bp, Homo sapiens
  misc_feature: GYAE6OF02GPGPK.38.4.A04.1.454.CMB.1.raw
  modified_base (119)..(119): a, c, t, g, unknown or other
  misc_feature (119)..(119): n is a, c, g, or t
  modified_base (188)..(188): a, c, t, g, unknown or other
  misc_feature (188)..(188): n is a, c, g, or t
  modified_base (218)..(218): a, c, t, g, unknown or other
  misc_feature (218)..(218): n is a, c, g, or t
  modified_base (642)..(642): a, c, t, g, unknown or other
  misc_feature (642)..(642): n is a, c, g, or t
tcagtcgatcacgtcacgaccggtgctcgatttagagtagtgatcaggggggggtccctgagactctcctgtcgcagcctctgcattcacctttagtaactatttaatgagctggtccncagcctcagggagggctggagtgggtgaccagcattaaccagatggacgtagaaaaatctatgtgactntgtggaacggcctattcgccatcgacaganacacgacaagactcactggtgctgcacgatcgaacggcctaggacgaggctacgacgacggctggttcgttacttcgtggtcggacgacgaccccggtacccccaggtaggtacgggtccctaaggacgggtcgggaacgtccgtaaacggtttaccgttagtaaccgttacggggtacggggacccgtaaccggggggtaacccttcgggttacccacccgttacttcccgtaaccgacggacccccttacccgaaacggtaaccggggaccctaacggttcccggttaccccttaccccgtacggacccctacccctccgtaacccgaacgtacggacctacccgtcggtcgggacctacgacggtccgccgttcgggactccgccgtacgtaccgtagtaaccctccgttaacgacgttanacgtccggtaacgtgggaccggaccgggtcgacgggagaccgggaccgagttacacgggtatcgag

SEQ ID NO: 222472 - DNA, 874 bp, Homo sapiens
  misc_feature: GYAE6OF02JG3JZ.38.4.A04.1.454.CMB.1.raw
  modified_base (124)..(124): a, c, t, g, unknown or other
  misc_feature (124)..(124): n is a, c, g, or t
tcagtcgatcacgtcacgaccggtgctcgatttagagtagtgatcgagggggggtccctgagactctcctgtgcagcctctgcattcaccttttagtaacttatttaatgagtcgtcgggtccnccagcctcgagggaaggggctggagtgggcgccagctattaaccagatggactagaaaatctatgtggactgtaggtgaacgggcctaattccggacctagttccaccgagacgaaccacgtaccgaaagactcgacgtggtcggctcgacacgtagtacgaaccggtcctaggaacgagggaccgaacgaccggcggtacgttggttaacgttacctttcgcggtaacggccgaacggacccggacccccgtaagggtggtaaccgggtaccttaacgggtaacgggtacgggtaaccgtaccgtttaacggtaaccggttttacgaaccggttacccgggtaacggggtacccgtaacggggttaacccgttcggtaccgtacccgttccgttcccgtaccgtaccgtacccggttaccaaacccgggttacggcccgttaacccggtttcccgttccccggtttacccccgtccggtaacccccgtacccgtttacccggacccgttaaaccggtccgtaaccccggtccggttaccgggttaccccgggaccgtaaccgtcccgggtacccgggtttcccggtaccggggtaccgtaccccggtttaccgggttaacggtaacccggttaaccgggttacccgttaacccgtacccggttcgtaccggtacgttaccggtaccgttcggaaccgggttccgccgggttaccgtacggaccggtccgacgtaccggtacgtggctgg

SEQ ID NO: 222473 - DNA, 636 bp, Homo sapiens
  misc_feature: GYAE6OF02GCOW1.38.4.A04.1.454.CMB.1.raw
  modified_base (270)..(270): a, c, t, g, unknown or other
  misc_feature (270)..(270): n is a, c, g, or t
  modified_base (385)..(385): a, c, t, g, unknown or other
  misc_feature (385)..(385): n is a, c, g, or t
  modified_base (460)..(460): a, c, t, g, unknown or other
  misc_feature (460)..(460): n is a, c, g, or t
  modified_base (634)..(635): a, c, t, g, unknown or other
  misc_feature (634)..(635): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtggaagggccgattcgccatctccagagacaacgccaagaactcactgtggactgacacatgaacggcctgagnggcgacgacgacggctgtcgtacttcgtgtgcgagaccgcccccagtggacgggctacgagggtgggacgtcgtacgtacttttggaactacgtgggggccaacgggtaacccgnggtcaccgtcctcctcgacgccctccgaccgtaacggccctacgtccggttccttcccctcggcccaccctcccnccaacggacgacctaccgtacggtcgggggaccaccgtacggccggtcccggtcgggcccttcggccgtagggtacctaacgggtaccttacccgttcccgtaccgttacggtacgtaccggtacgtagggacggtcggggaccgtcggacggaacggtcgaccgtagtagcgnng

SEQ ID NO: 222474 - DNA, 671 bp, Homo sapiens
  misc_feature: GYAE6OF02FP7XM.38.4.A04.1.454.CMB.1.raw
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtgccagcattaaccagatggacgtgaaaaatctatgtggactctgtgaagggccgattcgccatctccgagtagacaacgcaagactcactgtcgctagtacangaacgctgagtagcgtacgacncggctgttntacttctgtagcgagaccggaccccctagtacggagggtacctacgacggtagggtacgaccgttacgtacttttagggaccttacggtcggggtacgaacgggtaacccgtggtacccgtccggtactcccgttacgacccgtctacccgtaccggtacggtccctcgttaccggtcccgtttcccccggtacgtaccctaccccgttccgtaacccgaacgtacgtccgtaccgtacggtcgggcctaacgtcggaccggtccgtcggtcttacgccggtacgttaccgaagtaccgttacccgtcgtaccgtacgacttccgacgtacggtacggccgggtacgtacggtaccgtaacgggtacgcgtaacggtacgatacgcgtag

SEQ ID NO: 222475 - DNA, 842 bp, Homo sapiens
  misc_feature: GYAE6OF02IVTOT.38.4.A04.1.454.CMB.1.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (821)..(821): a, c, t, g, unknown or other
  misc_feature (821)..(821): n is a, c, g, or t
  modified_base (840)..(840): a, c, t, g, unknown or other
  misc_feature (840)..(840): n is a, c, g, or t
  modified_base (842)..(842): a, c, t, g, unknown or other
  misc_feature (842)..(842): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaagggctggagtggtgccagcattaaccaagatgacgtagaaaaatactaatgtggactctgtaggaaggccgtattcgccatcctccagagacgaacgaccaanactcnctgcgctgcacgatacgaccggtcgtagaggacggaccgaacgaccgacggtccttaggtcgttaccttcgtaggtccgacgacgacccgacccccgtagtacgggaaccggttacgtaacggtacgggtaccgggtaacgttaccgttaacggtcgttttacggaaccgttaacccggtaccgggggaaccccggtaaacgggttaaaccccgttcgggttacccctaacccggtttccgtttaccctacccgtaaccgtacccccgtaacccgaaacccggaccggggtaccctaaccggtttccccggttaccccgtttccccccgtacggtcccccttaaccccgttacccgtacccggaaacggtaaccgtccccgttaccgttacccggggtccgggtaacccgacgggtaccccgggccgggcccgggttaccggggtacccgacggttcccggttaaagggtacccgaaacggtttaacccgttacccgttaccgtaaccggtaccgttaccggaccgttaccgggtcgggaacggggtaccccggtggtaccggaacggtaacccggggnttaccggtaagtacggacngn

SEQ ID NO: 222476 - DNA, 815 bp, Homo sapiens
  misc_feature: GYAE6OF02JTHZM.38.4.A04.1.454.CMB.1.raw
  modified_base (344)..(344): a, c, t, g, unknown or other
  misc_feature (344)..(344): n is a, c, g, or t
tcagtcgatcacgtcacgaccggtgctcgatttagagtagtgatcaggggctctcagagaggagccttagccctggactccaaggcctttccacttggtgatcagcactgagcacagtagactcaccatggagttgggctggacgcgttgggttttccttgttgcttatttagaaggtcgtcagtgtgaggtcgactacgtggtaggagtcggtagggggacgtcgttacggccgtaggggcccggggggttcctggacggtaccttcgtcccgttggtcgaccacggtcccttcgtcgcttacgtttacctaaccgttttaacgttaaactttaagttttaanaggtacgtcggttcgggcccgaaccacggtccctacggaggggaagggcgtgggtaggtggggtcgacctaggacctaagtaacagtaacgtaggaaactaaacgtaaaacttacgtagttacggtacggtaacgttccgtaggtaaacgggaacccggggtacttacgtacccggtaccgtacgttaccgtaccgtaaggaaccgaaaccggaacccgtaaaccgtaaacgtaaccttaaccgaacgttcgtaacggtcgtcggtaaccacggttaacgaacggtacccgtacgaacgggtaccgggaaccgggaacccggacggtaaacccgggtcgggtacgttaaccgttaccggtttgtacccggttaggttaccggccggtaaaccggtcccggtacccccgtaaggaacccgggttacgggtaaccgttaacgggcggttaacggtaccgttaccggttaacgg

SEQ ID NO: 222477 - DNA, 571 bp, Homo sapiens
  misc_feature: GYAE6OF02F8LY3.38.4.A04.1.454.CMB.1.raw
  modified_base (330)..(330): a, c, t, g, unknown or other
  misc_feature (330)..(330): n is a, c, g, or t
  modified_base (550)..(550): a, c, t, g, unknown or other
  misc_feature (550)..(550): n is a, c, g, or t
  modified_base (569)..(571): a, c, t, g, unknown or other
  misc_feature (569)..(571): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaaatactatgtggactctgtgaagggccgattcgccatctccagagacaacgccaagaactcactgtggctgcacatgaacgctgagaggcgacgacacggctgtgtacttctgtgcgagacgcccccagtggagggctacgaggtgggacncgtacgtactttgactacgtggggaccaacgggaaccctggtcctaccggtctccgtcacgcctacccaacgaacgggccccagtccgtcccttccccgtcggcccaccctcctaccgaacgacgcctaaccgtcggtcggggaccacgacgccggcccgtggctcgccgtggtacaacggtacctacgttccgacgtagactcgacgtgacggcggcgnggacgaggtccgacagagnnn

SEQ ID NO: 222478 - DNA, 727 bp, Homo sapiens
  misc_feature: GYAE6OF02F9VV3.38.4.A04.1.454.CMB.1.raw
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
  modified_base (726)..(726): a, c, t, g, unknown or other
  misc_feature (726)..(726): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaagggctggagtgggtggccagcattaaccaagatggactagaaaaatctatgtggactctgtgaaggccgattcgccatctcagagacaacgccaagactcactgtggctgcacntcgaacggcctgagaggcgacgacacggntgtgtacttctgtcgcgagacgcccccagtggacgggtctacgaggtagggacgtcgtacgtacttgacctacggtcggggaccgaacggggtaacccgtggtcctaccggtcctcccgttacgaccggtcccctacccgaccgaccgggacccctacgttcccgggtttccccttaccccccggtcggtaccccgtaaccccctttcccgtaaaccccgtaaaccggtaccgcccgtaaccccggtttccggtaccgggggggtccctaaacccggaccgggtcccgggtacccccggtacggggtccgttcggtcccggttcgggtaaccgaaaccgggttaaccctacccggttacccgtaaccggttgtaccggtacgaaccggtcggtaaccggggtccgggtaccggtcgggaccggtacgggtccgaagtaccggtgcgtanc

SEQ ID NO: 222479 - DNA, 623 bp, Homo sapiens
  misc_feature: GYAE6OF02FQVMR.38.4.A04.1.454.CMB.1.raw
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (620)..(620): a, c, t, g, unknown or other
  misc_feature (620)..(620): n is a, c, g, or t
tcagtcgatcacgtcacgaccggtgctcgatttagagtagtgatcaggggggggtccctgagactctcctgtgcagcctctgcattcacctttagtaactatttaatgagctggtccgccagcctccagggaaggggctggagtgggtggccagcattaaccaagatggacgtagaaaaatctatgtggactctgtgaaggcatcgccatctcagagacacgcaagactcactgtgctgacanatgacgctgagagcgacgcacggntgtctacttntgtcgngagaccgccccagtggacggtctacgaggtgggntacgtacgtactttgaccgtacggcggggtacctaacgggacccgttggtacccgtaccgttccgtacccgtcaccggtccctacccgaaccggtaacgggccctaagtcccgggttcccttcccccggtagacccctacccttcccgtaccgaacgtacgaccgtccgtcgggcgggtaccacgcggacccgggtccgtcgggcctcggtccgtcggtaccgaacggtaccttacgtccgacgtcgtacgtcggtacgtcggacggtccgggtcgtcggacgtacggcgactacggcgtacntcg

SEQ ID NO: 222480 - DNA, 680 bp, Homo sapiens
  misc_feature: GYAE6OF02ILH9R.38.4.A04.1.454.CMB.1.raw
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
  modified_base (332)..(332): a, c, t, g, unknown or other
  misc_feature (332)..(332): n is a, c, g, or t
  modified_base (679)..(679): a, c, t, g, unknown or other
  misc_feature (679)..(679): n is a, c, g, or t
tcagtcgatcacgtcacgaccggtgctcgatttagagtagtgatcaggggggggtccctgagactctcctgtgcagcctctgcattcaccttttagtaacttatttaatgagctgggtccgccagcctcagggaaggggctggagtgggtggccagcattaaccaagatggacgtagaaaaatctatgtggactntgtgaaggccgattcgccatctccagagacaacgccaagactcactgtgctgcacagtgaacggcctgaagnggcaccgactacggctgtacgtacttctggtcgcgacgaccgccccccaagtggagggcctacgngggttacgggagctaacgtctttagaccgtacggtggggccaacggggtaaccctggtaccaccgttcgtcctgaccgtcccctacgacccgtaagggaccctacgttccgtccccgttacccccgtcggccctaaaccccctccgtacctaacggtccgcccgttaaccgtaccggttccgggggaccctacgaaccgggcccgggcccgttgggtccgtacgtccggttcggaaccgaacggttaccgttaccttaccggacgttaccgtacgtaccggcgttacgggcgtacccggggtcgtacggtacccggtaaggacccgttaggtaaacgtacgtcggcng

SEQ ID NO: 222481 - DNA, 592 bp, Homo sapiens
  misc_feature: GYAE6OF02G9PTR.38.4.A04.1.454.CMB.1.raw
  modified_base (108)..(108): a, c, t, g, unknown or other
  misc_feature (108)..(108): n is a, c, g, or t
  modified_base (120)..(120): a, c, t, g, unknown or other
  misc_feature (120)..(120): n is a, c, g, or t
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (534)..(534): a, c, t, g, unknown or other
  misc_feature (534)..(534): n is a, c, g, or t
  modified_base (585)..(585): a, c, t, g, unknown or other
  misc_feature (585)..(585): n is a, c, g, or t
  modified_base (590)..(590): a, c, t, g, unknown or other
  misc_feature (590)..(590): n is a, c, g, or t
tcagtcgatcacgtcacgaccggtgctcgatttagagtagtgatcagggggggggtccctgagactctcctgtgcagcctctgcattcacctttagtaactatttaangagctgggtccnccagcctccaggggaagggctggagtgggtcggccagcaattaaccaagatgggactagaaaaatctatggtggactntgtggaagggccgattcgccagtccncagacgacaacgccaaagactcactggngctgacacgangaacggccgtgaggnggcgacgacgacgctgtntacttngtcgcgagccnccccgtagcgacggtcacgacggtgggacgtctacggtcttaggacctacggtcggggaccgtaggaacccgttggtcctaccgtcttaccncncgtaccctccaacggacgtccctacgtcccgttaccctccccgtggcccaccctaccaccgaagtccgaccacgtcggtacgggcacgccggccgcgcgtcgtcgcgtggtaccgataccgttaccnccgtagtcacgttccgcgtacgggcggccgggtagtcggcgtaggccaganacgtnga

SEQ ID NO: 222482 - DNA, 844 bp, Homo sapiens
  misc_feature: GYAE6OF02H5GF7.38.4.A04.1.454.CMB.1.raw
  modified_base (319)..(319): a, c, t, g, unknown or other
  misc_feature (319)..(319): n is a, c, g, or t
  modified_base (840)..(840): a, c, t, g, unknown or other
  misc_feature (840)..(840): n is a, c, g, or t
tcagtcgatcacgtcacgaccggtgctcgatttagagtagtgatcaggggggggtccctgagactctcctgtgcagcctctgcattcacctttagtaactattaatgagctgggtccgccagcctccgagggaaggggctggagtgggtgccagcattaaccagatggacgtagaaaatactatggtggacttcgtggtaggaagggccgtatttaccaacctactcctaccaagtacgaactaacttacccgaaggacgacaaccgacttacttaactttacgaactaaagttacgaacacggtaccgtaggggaacnccggtaaggaacggtaacgaccggtcgttagttaaacgtttaaactttacggtaggtagaccggtaacggtaacggttaccgtaacccgggttccggtaccggtaccgttcgtaaccccggttacggttaccggggggaccctaaaccgggggtaaaccccgttcgggtacccgtaaccccggttcccttacccgttaccgacccggttaccccgtaaccccgaaacccgggtaaccggggtccccctaacggtttccccgggttacccccttccccgggtacgggtccccgtacccgttaccgcccgttacccggaaggtaacccgaccgtacccgtaccgggaacgaccgaaccgtaccggaccgggtaccgtcccggtcgggtaccgtccgtaccgtacggtaccggtaaacggaccttaccgtaccgtacggttactacgtacgtaccgtaggaccgggtcgggacgtacggaccgaacgggcctaacgggttaacacgtcgacgtactcgacgtcngacg

SEQ ID NO: 222483 - DNA, 739 bp, Homo sapiens
  misc_feature: GYAE6OF02G4EYR.38.4.A04.1.454.CMB.1.raw
  modified_base (186)..(186): a, c, t, g, unknown or other
  misc_feature (186)..(186): n is a, c, g, or t
tcagtcgatcacgtcacgaccggtgctcgatttagagtagtgatcagggggggtccctgagactctcctgtgcagcctctgcattcacctttagtaactatttaatgagctggtccgccagcctccgagggaagggctggagtgggtggccagcattaaccaagatggacgtagaaaatactatgngactctgtagaggcgattcgccatctcagagacaacgcaagactcacgtgtgctgcacatgaacggtcctgaggaggcgaacgacgacggtctggttcgtacttcgtagtggcgtaacggccgtacccccgagtagggacgggtactaacgagggtcgggacgtaccgtaaccggttactttacgaacgttacgggtacggggtacccgaacgggtaacccgttggtacccgaccggttacctccgtaccgacgtcccgtacccgaaccggtaaccggccgtaaccgtcccggttaccccgtttacccccgcggtaacccaccccgttcctaaccgaacgtacccgacccttaccggtccgggtacgggaccctaaccgaccggtacccgtcccggtacggccgttaccggtccgtaacggtacccgaaacggtaacccttaccgttacccggaaggttccgtaccgttacgtaaccggtcggtacccggggtacggaccggttaccgggaacgtacccgggtacgtaaccggttaagacgggtccaatccgg

SEQ ID NO: 222484 - DNA, 627 bp, Homo sapiens
  misc_feature: GYAE6OF02FP1Q3.38.4.A04.1.454.CMB.1.raw
  modified_base (262)..(262): a, c, t, g, unknown or other
  misc_feature (262)..(262): n is a, c, g, or t
  modified_base (567)..(567): a, c, t, g, unknown or other
  misc_feature (567)..(567): n is a, c, g, or t
  modified_base (623)..(623): a, c, t, g, unknown or other
  misc_feature (623)..(623): n is a, c, g, or t
  modified_base (625)..(626): a, c, t, g, unknown or other
  misc_feature (625)..(626): n is a, c, g, or t
tcagtcgatcacgtcacgaccggtgctcgatttagagtagtgatcagggggggggtccctgagactctcctgtgcagcctctgcattcacctttagtaactatttaatgagctggtccgccagcctcagggaaggggctgggagtgggtggccaggcattaaccaagatggacgtagaaaaatctatgtggactctgtgaagggccattcgccatctcagagacacgcaagactcactgtggctgcacatgaacggctgagnggcgacgacacggctgtcgtacttcgtgtggacgacgacgccccagtggacgggctaacgaggtaggggacacgtacgtacttttagaaccttacgggtggggcccaacgggtaacccctgggtacctaccggttcctcctacgacgtccctaccgaaccgacggaccctacgtccggttccctccccgtgaccctaccctcctaccgaacgtaccgcctaaccgtcggtacgggacaccgtacggcccggtccgttgggcctcggtcctagggtaccaacgggttacctacgttccgacgttanacgtcgtacgtcggacggtccgggtacgtaggaccgacggtcgaccgttagtacgngnng

SEQ ID NO: 222485 - DNA, 703 bp, Homo sapiens
  misc_feature: GYAE6OF02FY2A0.38.4.A04.1.454.CMB.1.raw
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (637)..(637): a, c, t, g, unknown or other
  misc_feature (637)..(637): n is a, c, g, or t
  modified_base (703)..(703): a, c, t, g, unknown or other
  misc_feature (703)..(703): n is a, c, g, or t
tcagtcgatcacgtcacgaccggtgctcgatttagagtagtgatcagggggggtccctgagactctcctgtgcagcctctgcattcacctttagtaactatttaatgagctcgggtccgccagcctccgagggaaggggctggagtggtgccagcaattaaccaagatggacgtagaaaaatctagtcgtggactctggtgaacgggccattccgcagtcctcagagacaacggccaaagaactcacgtgtggcngcacagtgaacgcctggagcgacgacgacacgntgtntactgtgngcgagccgccccagtggacgggctagacggtagggtacgaccgtacgtacgttcgtacgtaacggtcggggaccgacgggtaacccgtttcggacccgtaccgggtccttacccgttcgaccgtaccccgtacgaaccccggacggtaccccgtcggtttacccgttccccgttaaccccgtccggtacccctacccgttacccgtaacccggaagttccgaacctaccccggtttcgggcgggggtacccaacgggccgtaccccgggtccggtacgggttccggtaccgttacggtcggtaaccgtaccggacctttccgtaccgtaccgttacncgttaccgaggtacggtcgggaccggtagttcggaccgttaggaccgtaggttagcgttacgcgtn

SEQ ID NO: 222486 - DNA, 693 bp, Homo sapiens
  misc_feature: GYAE6OF02II46N.38.4.A04.1.454.CMB.1.raw
  modified_base (108)..(108): a, c, t, g, unknown or other
  misc_feature (108)..(108): n is a, c, g, or t
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (690)..(690): a, c, t, g, unknown or other
  misc_feature (690)..(690): n is a, c, g, or t
tcagtcgatcacgtcacgaccggtgctcgatttagagtagtgatcagggggggggtccctgagactctcctgtgcagcctctgcattcacctttagtaactatttaangagctgggtccgcagccctccgagggaaggggctgggagtgggtggccagcaattaaccaagatggacgtagaaaaatactatgtggactctgtgaaggccattcgcatcctcagagacaacgaccaagaactcactggtggctgcanatgaacggctagagaggcgacgacgagctgtgtactttngtgacggacgaccgcccccgtagtacggacggtacttaacggagggttacgggaactcgttaaccgtacgtttttaggaaccgtttacgggcgggggtaacccaaacgggggtaccccttagggtaccctacccggttcttacccgtcgaaccgtccctaccgaacccggtaaccgggccccttaggtccccgttcccgttacccccgtcggaccctaaccctccgtaccaacggacgacctaccgcggtacggggcctacgacggcccggccgtcgggactcgtccggtacggtaacgaacgtaccgttaaccttacccggagttacgacgttcggtacgtaacggaccgggtcggacgttcggaaccgtaacggccggtactaagggttcgangag

SEQ ID NO: 222487 - DNA, 637 bp, Homo sapiens
  misc_feature: GYAE6OF02HUH9P.38.4.A04.1.454.CMB.1.raw
  modified_base (105)..(105): a, c, t, g, unknown or other
  misc_feature (105)..(105): n is a, c, g, or t
  modified_base (235)..(235): a, c, t, g, unknown or other
  misc_feature (235)..(235): n is a, c, g, or t
  modified_base (460)..(460): a, c, t, g, unknown or other
  misc_feature (460)..(460): n is a, c, g, or t
  modified_base (632)..(632): a, c, t, g, unknown or other
  misc_feature (632)..(632): n is a, c, g, or t
  modified_base (635)..(635): a, c, t, g, unknown or other
  misc_feature (635)..(635): n is a, c, g, or t
tcagtcgatcacgtcacgaccggtgctcgatttagagtagtgatcagggggggtccctgagactctcctgtgcagcctctgcattcactttagtaactatttaangagtctgggtccacagcctcgagggaagggctgggagtgggtgccagcataaccaagatggacgtagaaaaatctatcgtaggactactgtggacggccattcgccatcctcagagacaacgccaagacncacgtgtcgctagcacatgaaccgctgacgaggcacgacacggctgtactacttctagtgacgagtacgcccccagtcggacgggctaacgaggttggggacgtaccgtacggtacttttagaacctacggttcggggaccgtacggggaaccctcgggtccaccggtctccgtacgacgccctaccaacgaacgggcccaagttcccgggttcctttcccccgnggtcccacccgttcctaccgaaagtacgccctaccggtcgggaccggggcaacggtcggacccggtccgttacgggctcggccgttcggaaccaacgggtaccttaccgtccgtacgtagtacgtacgacgttggacggcgggagttacgggacgacgggccgtagaagtangtncg

SEQ ID NO: 222488 - DNA, 734 bp, Homo sapiens
  misc_feature: GYAE6OF02HGXCS.38.4.A04.1.454.CMB.1.raw
  modified_base (733)..(733): a, c, t, g, unknown or other
  misc_feature (733)..(733): n is a, c, g, or t
tcagtcgatcacgtcacgaccggtgctcgatttagagtagtgatcagggggggtccctgagactctcctgtgcagcctctgcattcacctttagtaactatttaatgagctgggtccgcagcctccgagggaaggggctggagtgggtgccagcattaaccagatggacgtagaaaaatactatgtcggactctgtaggaaggccgtattcgcatcctcagacgacaacaccgaagactcgactggtcggctgcaacagtacggaacggtccgtagaggacgggacgaccgacgaccggcgttcggtattacgttcgtgtaggcgagacccgtcccccaagtggacgggtctaacgtggagggacgtcctacgttaccgtttacgaactacgggtccggggccgaacggggtaccctgggttacccaccgttccctcctcacgtacccctacccgaaccgaaccgggtccctacgttcccggtccccgttttacccccgccggtccctacccgtacccgttacccgaaacgggcctaacccgacccggttacccggggtcggggaccctaaccgggaccgggcccggttacccggtacgggtccgtaccggtcccgttaggtacccgaacgggttaccctaccgtaccgtaccgttcgaccgttaccggtaccgttcggaaccgggtcggggtacccgttaggaccggaacggccgaagtaatccggagtccnc

SEQ ID NO: 222489 - DNA, 758 bp, Homo sapiens
  misc_feature: GYAE6OF02IE7CF.38.4.A04.1.454.CMB.1.raw
  modified_base (336)..(336): a, c, t, g, unknown or other
  misc_feature (336)..(336): n is a, c, g, or t
tcagtcgatcacgtcacgaccggtgctcgatttagagtagtgatcaggggctctcagagaggagccttagccctggactccaaggcctttccacttggtgatcagcactgagcacagaggactcaccatggaattggggctgagcttgggttttccttgttgcttattttagaaggtgtccagtgtgaggtgacacgtggtggagtcgtgggggagtcgttggtccgacgggtcccgggggggttccctggacgaccttccgtccgtggtgccgacgcctctagctacttactacccttttaagtaaaccttatttaatgagtcgtcggtccgccngccgtaccggaggggacgggtcgtgggtaggtggggtcgacccgagtactaagttaaaccgaagtaagtagggaaccgtaaagaaaaacgtacgtaagtaggttacggtaacttcggtagtacgggtaacgggaccgtagttcccgaccacgttacctaccgaacgtacggaaacctaaccgaccgtaaacgtaacctacgtaacgtcgggttaggaccttagacctaacgtagtaaccgggaaccgggtcctagggaacgtacgggaaccgaaccggaaccgtaccgggtacgttacgggtttaccgtaaccgtttcggtcggttacggtccggaacccggtcccggtaccccccgtaggtacccgggtaacgggtaccgtaacggtaacggggtacggggtacgtacccggtttaaccgg

SEQ ID NO: 222490 - DNA, 750 bp, Homo sapiens
  misc_feature: GYAE6OF02HYIU7.38.4.A04.1.454.CMB.1.raw
  modified_base (202)..(202): a, c, t, g, unknown or other
  misc_feature (202)..(202): n is a, c, g, or t
  modified_base (632)..(632): a, c, t, g, unknown or other
  misc_feature (632)..(632): n is a, c, g, or t
tcagtcgatcacgtcacgaccggtgctcgatttagagtagtgatcaggggggtccctgagactctcctgtgcagcctctgcattcacctttagtaacttatttaatgagcgtggtcccgccaagcctccgagggaagggctgggagtgggtggccgagcaagttaaaccaagagtggaacgtagaaaaacgtctatgtgctntgtgaacggctattcgccatcctcagagacaacgaccaagactcacgtgtgctgcacatcggaacgtcctagacgtaggacgacgacgacggctgtacgttacttcgtgtcggacgtacggacccgccccccgtagtcgggacgggtctacggtagggttacgggacgtaccgtaacggtttactttcggaaccgttaccggtacgggggaccctaacggggtaaccccgttcggtacccgtacccggttacccttcccgacgtaccgtaccccgttaacccaacccgggtaacccggacccgtaccggttacccgtttccccccgtttacccccgtaccggaccccgtaccctcccgttaaccgaacgtaccgtaccctacccggtacgggttcgggaaccgtacggccgcccgggtcgcgggttaccncggtacccgttcggtaaccgtaacgtaccttaccgtaccgacggtcgtacgtacgtaccgtaggtaccggtcggccggttacggaccgtaacggtcgaaccgtaagtcgtacgcgtag

SEQ ID NO: 222491 - DNA, 680 bp, Homo sapiens
  misc_feature: GYAE6OF02FE691.38.4.A04.1.454.CMB.1.raw
  modified_base (117)..(117): a, c, t, g, unknown or other
  misc_feature (117)..(117): n is a, c, g, or t
tcagtcgatcacgtcacgaccggtgctcgatttagagtagtgatcaggggggtccctgagactctcctgtgcagcctctgcattcacctttagtaactatttaatgagctgggtccnccagccctccagggaagggctggagtgggtgccagcattaaccaagatggactagaaaaatctatgtgactctgtgacgggccattcgccatctaccagacgacacgcaagactcactgtgctgcacatcgacgcctgagagcgtacgacacggctgtcgtacttcgtgtcgcgacgtaccgcccccagtggacggtctacgaggtacgggagtaccgtacgtactttcgaccgtcggtcggggaccacgggtaccctggtaccctccgtactcctacgacgcccctaccgaccgaacgggtccctaggtcccggtttccctacccccgtcggtacccctaccccgtacctaccgaacgtaccgaccgtaccgtcgggtacggggacccaggtaccgggtcccggtcccggttgggaccgttccggtacccgtttacgggttaaccgtaaaccggttacccttacccgtttaccggaccgttacgtaccgtaccggaccgttaacgggccgggtcccggggttaccgagggacccgacgggttaccgacctaggtacgcactg

SEQ ID NO: 222492 - DNA, 572 bp, Homo sapiens
  misc_feature: GYAE6OF02HOMRF.38.4.A04.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
  modified_base (570)..(570): a, c, t, g, unknown or other
  misc_feature (570)..(570): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtggccagcaattaaccaagatggacgtagaaaaaatctatgtgactctgtgaaggccattcgccatctccaganacacgccaaagactcactgtgctgcacatcgaacgcctgagnggcacgacacggctgtcgttacttcgngtcgcgagaccgccccagtggacgggctagnggtggagcctacgacgtttcgactcgaggggccaaggggaccctgggtcaccgttcaccttcgacgtccctcgaacccgaggccctacgtcgttccctccccgtcgccctccctccaccgaacgcgcctaccgtcgtcggggaccncgacgtccggccgtcgggtcncggcctggtacgtaacgtccttaccgtcgtacgtagactacgacgtggcgccggtcgtcggacgacgggcaccgagtacgagncg

SEQ ID NO: 222493 - DNA, 696 bp, Homo sapiens
  misc_feature: GYAE6OF02FZ639.38.4.A04.1.454.CMB.1.raw
  modified_base (692)..(692): a, c, t, g, unknown or other
  misc_feature (692)..(692): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaaccgccaaagaactcactgtggctgcacatgaacggcctgagaggcacgacacggctgtgtacttctgtgcgagaccgcccccagtggacggcctacgaggtgggagcctacgtactttcgactacgtcggggtaccgacgggtaacccgtggtaccacccgtccgtccctactacgcccctcccgaaccgacggccctaacgtccggttcccttccccccgtcggaccctaccccgttccctaccgaacgaccgtaccctaccgtccggtaggggacccacgaccggtcccgggccccgtacggggtcccgtccggtacccgttacggtaaccgtaaccgggtaccctttaacccggtttccaacgggtttaccgtacgtacccggtaccggttacgggtaccggggtcccgggtaccgtaccggggaaccgggtaaccgggcccggttacgaacggttacgggntgac

SEQ ID NO: 222494 - DNA, 688 bp, Homo sapiens
  misc_feature: GYAE6OF02FJ2A8.38.4.A04.1.454.CMB.1.raw
  modified_base (684)..(684): a, c, t, g, unknown or other
  misc_feature (684)..(684): n is a, c, g, or t
tcagtcgatcacgtcacgaccggtgctcgatttagagtagtgatcagggggggggtccctgagactctcctgtgcagcctctgcattcacctttagtaactatttaatgagctgggtccgccagcctccgagggaagggctggagtgggtgccagcattaaccaagatggacgtagaaaaatctatgtggactctgtagaacgggccgattcgccatcctccagacacacgcaagactcactgtggctgcacatcgaacggcctgacgaggcgacgacgacggtctgtagtacttcgtgtgcgagacgccccagtggacggtctacgtaggtgggacgtcctacgtacttttagacgttacgtcgggggaccacgggtaacccgtggtcccaccggttcctcctcgaccgtccctacccgtaaccgacggtacccacgtaccgggttccccgttcccccgtacggtcccgaccccgtacccgtacccgaacggaccgaccgtaccgtcggtacgggggtacctaccgacggtcccgggtacccgttcgggtaccgttacggtaccggttacgggtaaccgtaaacggtacccgttacccgttccgtaccggttacgtactaccggtacgtcggtacgggtaccgggccggtacggaccggaacggttcggacgttaacacggtngacg

SEQ ID NO: 222495 - DNA, 1032 bp, Homo sapiens
  misc_feature: GYAE6OF02FO086.38.4.A04.1.454.CMB.1.raw
  modified_base (110)..(110): a, c, t, g, unknown or other
  misc_feature (110)..(110): n is a, c, g, or t
  modified_base (158)..(158): a, c, t, g, unknown or other
  misc_feature (158)..(158): n is a, c, g, or t
tcagtcgatcacgtcacgaccggtgctcgattttagagtagtgatcgaggggggggtccctgagactctcctgtgcagcctctgcattccacctttagtaactatttaangagctgggtccgacctagccctccgaaggggtaaggggtctggtaggnggggtacggcccaaggtactaaagtttaaaccgaagagtacgggaaccgtaagtaaaaaattacgttaagttggtacggtaaccttcgttaggttaggaaccggggtccctaacgtttcccggacccaacgtttcccgttaccgaaagggaaccgtaaaccgaaacccgaccgaaaaacggacccttaccgaaccgttggtccggtaccttacggaccaacgttagtaacggaaccggtccgttaagggaacggacgggtacccggaaaccgacccggtacggtcggtttacggttaccgtttaccgttttccggtaggttacgggacccggaacggtaacccccggtaccccccgtaaggtacggggaccgggtaacgttaaccgggtagggttaccggggaaccgtaccgttaaccggtttaacgtttacggtaaccgttacccggggtacgggggtaacccggtaaaccggggtacccgtttaaggtaccccggttacccgtacccgtttacccaccgtccggtaaccccctaacccgggtaacccggaccggaccccgtacggttcccggttacccccgttccccggtaccggtaccctaacccccggtttccaaccccggaacgtacccgtaacccgttaccggtacggggtacccgggtaccgaaccgggtacccggtcccgggtcccgggttagggacccttccgggtacggtttcccggaaccggtttaaccgttacccggttaaaccgttacccggtaacgttaccggtacccgtaccggttacccggaagggtaccgggttacccggtaacggtcgggaaacccggtacggtcccgtaaacgggttaaccgtggtccgagtacg

SEQ ID NO: 222496 - DNA, 765 bp, Homo sapiens
  misc_feature: GYAE6OF02H5Z9E.38.4.A04.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (574)..(574): a, c, t, g, unknown or other
  misc_feature (574)..(574): n is a, c, g, or t
  modified_base (753)..(753): a, c, t, g, unknown or other
  misc_feature (753)..(753): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
tcagtcgatcacgtcacgaccggtgctcgatttagagtagtgatcaggggggggtccctgagactctcctgtgcagcctctgcattcacctttagtaactatttaatgagctgggtcccgccagcctccgaggggaaggggctgggagtgggtggccagctattaaccaagatgggacgtagaaaaatactatgtggactctgtggagggccattcgcatctcaganacaacgccaanactcactggtgcngcanatgaccggtccaggagacggcgacgacgacggacttggtacgttaccttcgtggtcggacggacggaccccgacccccctacggtcgggaacgggtctaacggtaggttgggacgtacgttaccggttacgttttacgacgttacgggtacggggacccggaacggggtaaccccgttgggtaccctacccggtttcccgttacccgtacgtacccggtccccctacccgaaacccggtaccggggtaccccacgtttcccggtttcccccgttcccccgtccggacccctaccccgtaccctacccgtaacggtaccnccggtaacccgtccgggtaccggggaccgaccgtacgggcccgggtacccggtccggtcccgtacggtacccggtcggtaccgtaaccgggtacccttaccgtacccgtacgttacgacgtaccgtacggtcggaccgggtcccgggtaccggtaccggacgtaacggggcgtaaccgnggttacgcgntn

SEQ ID NO: 222497 - DNA, 752 bp, Homo sapiens
  misc_feature: GYAE6OF02I9UJW.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaaccaagatggacgtagaaaaatactatgtgactctgtgagggccattcgccatctcagagacaacgccaaagactcactgtggctgcacatacgaacggcctggagaggccgacgacgaccggcttagtcgtactttcttggtcgacgacggacccgtaccccccgaacgtcggaaccgggtaccttaacgagggtgggaccgtacgtaacgttccgttttaggacccgttacggtcggggacccgaaccgggtaacccgtcgggtccgtaacccgtcctacccgtccgacccgtacccctacccgaaccggaaccggtcccgaccgttacccgggttccccctttacccccgtacggtcccctaccccctcccgtaccccaaacggcccggtaccctacccgttcgggtaccggggacccgtaccgaccgggtccccgggtccccggtacgggtccttcccgggtccgttaccgggtacgtaaccggtacccgttaccgttaacccgcggtttacgaccgttacggtaaccgttgggaaccgggtcgggccggttaacgggaccgacgggaccgttcgaaatcggtatggc

SEQ ID NO: 222498 - DNA, 717 bp, Homo sapiens
  misc_feature: GYAE6OF02GHGBO.38.4.A04.1.454.CMB.1.raw
  modified_base (167)..(167): a, c, t, g, unknown or other
  misc_feature (167)..(167): n is a, c, g, or t
  modified_base (177)..(177): a, c, t, g, unknown or other
  misc_feature (177)..(177): n is a, c, g, or t
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
  modified_base (702)..(702): a, c, t, g, unknown or other
  misc_feature (702)..(702): n is a, c, g, or t
  modified_base (713)..(713): a, c, t, g, unknown or other
  misc_feature (713)..(713): n is a, c, g, or t
tcagtcgatcacgtcacgaccggtgctcgatttagagtagtgatcaggggggtccctgagactctcctgtgcagcctctgcattcacctttagtaactattaatgagctggtccgcagcctccgagggagggctggagtggtggccagcattaaccagatggacgtnaaaaatctangtggactcgtgtgaagggccattcgccatcgtccagcgacacgtccaaagactcatgtcgctgactacatcgaacgcctagacgaggtcgaacgacacgtcgngttacgtacgttcaggtcgcgaggaccgacccccngtacggaggccttacgaggttacgggacgttactacggtacgttttaggacccttaggcggggaccgaacggggtaaccctggtaccgaaccgttcctacccgttacgaaccgtcgtcccccgaaacgtaccgggaccctaacgttcccggtacccttcccccggtacggtacccctacccgttccccttaaccggacggtaaacccggccttaacccggtttacccgggaccggggtaccctaacggtaccggcccgggtaccccggttacgggccgttacccgggtccccgttacgggtaccgtaaccgggtaaccttcccgttaaccgtcggtacgtaccgtacggtcggtacgacggttccgggacgtcggacgtaaccggtnacggaactgcncgtg

SEQ ID NO: 222499 - DNA, 715 bp, Homo sapiens
  misc_feature: GYAE6OF02I4M2D.38.4.A04.1.454.CMB.1.raw
  modified_base (361)..(361): a, c, t, g, unknown or other
  misc_feature (361)..(361): n is a, c, g, or t
tcagtcgatcacgtcacgaccggtgctcgatttagagtagtgatcgaggggggggtccctgagactctcctgtgcagcctctgcattcacctttagtaactatttaatgagcgtgggtccgccagcctccgagggaaggggctgggagtgggtggccagcaattaaccaagatggacgtagaaaaatctatggtggactcgtgtaggaacgggccgattccgccatcctaccgaagacgaaccaaccgaccaaaagaacctcacgtggtcggctgacacagtaggaaccggcctaggagacggcgacgacgacggctgtgtacttgtggtgcgagaccgcccccagtcggacggcctacgnggtgggagcgtacgtagtttcgacgttacggtcggggaccgacgggtacccgtcggtaccgtaccgtctcccacgaccgtccctacccgaaccgaccggccctacgtcccggtcccttcccccgtcggtaccctacccctccgtaccgaacgaccgtacccgtaccgtccgggtaccggggacctaaccggccgggtccccgggtacccgggttcgggtcccgttccggtacccggttacgggtaaccgtaaaccgggtacctttacccgtaccgacgggttacgaccgttaccgtacggtcggaacgggtccgggtacggtcggaaccggacggccgtacgacgtagcagtag

SEQ ID NO: 222500 - DNA, 747 bp, Homo sapiens
  misc_feature: GYAE6OF02FZJBW.38.4.A04.1.454.CMB.1.raw
  modified_base (744)..(744): a, c, t, g, unknown or other
  misc_feature (744)..(744): n is a, c, g, or t
  modified_base (747)..(747): a, c, t, g, unknown or other
  misc_feature (747)..(747): n is a, c, g, or t
tcagtcgatcacgtcacgaccggtgctcgatttagagtagtgatcagggggggggtccctgagactctcctgtgcagcctctgcattcacctttagtaactattatgagctgggtccgccagcctccagggaagggctggagtgggtggccagcatttaaccaaggatcgggacgtagaaaaaacttctaatcggtggaacttcgtgtaggaacggggtccgattccgaccagtctaccgagacgaaccaacgccaaagtaactcaactgtggctgacacatcgaacggcctaggagacggacgacgacacggcttggtcgttacttactcggttacgcggtacgacgtcccccacgtggagggctaacgtggtacgggagtccgtaacgacgttttgaccgttacggtcggggaccgtacgggaaccctggtccacccggttctcccgctacggaccctacccgaacggtaacggccctaacgtccggtttaccccttcccccggtacgtcccgtaaaccccgttcccgaaacccgtaaacgaacccggtaccgttaccggtcccgggttacggggtacccgaaacgttaccgggccccgggtaccggtacggggttaccgtttccggaccggttagggtaccgaaaacgggttccctaaaccgtttccgacggtacctacgccgtacggtaacggcgggtaccgtcggttcggaacgttaccggaccggtacacgtagtacnctn

SEQ ID NO: 222501 - DNA, 753 bp, Homo sapiens
  misc_feature: GYAE6OF02FYP8P.38.4.A04.1.454.CMB.1.raw
  modified_base (245)..(245): a, c, t, g, unknown or other
  misc_feature (245)..(245): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatctatgtggactctgtgaagggccgattcgccatctcagagacaacgccaagactcactgtggcngcacatgaacgctgagaggcgacgacacggctgtgtacttctagtcggcgacgaccgacccccagtcgggacgggcctacgagggtacggggactaccgttaacgtacgttttaggaccgttaccgggttcggggacccgtaacggggtaaccccgtggtacccgtaccggtcccttacccgtacaccggtacccctacccgaacccggtaacggggtccccctaacggtttcccgggttacccccgtttacccccccggttaggtacccccttaacccccgttccccgtaacccgaaacggtacccgacccgttaacccggttcccgggtacgggggtacccaacggtaccgggtacccgggtcccgttacggggtcctaccggtccgtacgggtaccgtaaacgggtacccttaccgttaccgaaccggttagtaccgtcggtacgtgggaccgggcgggtaccggtcggaaccggacgggtaccgaccgtaaggtacgcgagtcg

SEQ ID NO: 222502 - DNA, 554 bp, Homo sapiens
  misc_feature: GYAE6OF02GGWR9.38.4.A04.1.454.CMB.1.raw
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (552)..(553): a, c, t, g, unknown or other
  misc_feature (552)..(553): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgaacgcacggctgtgtacttctgtgcgagacgcccccatggagggctacagtgggnctacgactttgactanggggcagggaacctggtcaccgttctcctcacgcctccaaccgaacgggcccagtcggtccttcccccgtgccaccctcctccgaagcncaccctcgnggggccacgacggcggccctgggctcgaccttggacaaggacctaccttaccgacgtcgacgtccgacgtcggaacggtccgggccgtacgggcgaacggccgactaagtacggnnc

SEQ ID NO: 222503 - DNA, 609 bp, Homo sapiens
  misc_feature: GYAE6OF02IT38S.38.4.A04.1.454.CMB.1.raw
  modified_base (300)..(300): a, c, t, g, unknown or other
  misc_feature (300)..(300): n is a, c, g, or t
  modified_base (421)..(421): a, c, t, g, unknown or other
  misc_feature (421)..(421): n is a, c, g, or t
  modified_base (606)..(607): a, c, t, g, unknown or other
  misc_feature (606)..(607): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgagggaaggggctggagtgggtggccagcaattaaaccaagatggacgtagaaaaaatactatgtggactctgtagaagggccgattcgccatctccagagacaacgccaaagaactcactgtggctgcacatgaacggctgagaggcgacgacacggctgtcgtactttcngtgacgacggaccgcccccagtggacgggtcttaacgagggtgggactaccgtacggtactttgaaccgttacggcggggacctaacggggtaaccctgggtaccaccgtctacctcgacnccctaccaaccgacggacccacgtccgttcccttccccgtcgacctcccgtcccaccgaacgacgacctaccgtacggtcgggcaccgcggccgccgtcggctcgaccgtggacgaacgtacctacttccgacgtctacgtcgacgtcggacggcgggtcgacggacggacgcgtacgacgtagnntg

SEQ ID NO: 222504 - DNA, 733 bp, Homo sapiens
  misc_feature: GYAE6OF02HWHH4.38.4.A04.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
tcagtcgatcacgtcacgaccggtgctcgatttagagtagtgatcaggggggtccctgagactctcctgtgcagcctctgcattcacctttagtaacttatttaatgagctgggtccgccagcctccgagggaaggggctggagtgggtcggccagcaattaaccaagagtggacgtagaaaaatactatgtggactctgtagaaggccgattcgccatcnccagagacaacgcaagaactcactgtgctgcanangacgctgagnggcgacgacacggctgtagtacttctgtgcgagaccgccccagtgacggtctacgaggtcgggacgtcttaacgtacgtttacgaccgtacgggtaccggggaccgtaaccggggtaacccgttcggtacccaacccggttccttaccccgtacgacccgtccctaaccgacccggaaccgggtaccctacgttcccgttccccgtttacccccgtcggtaccccctacccgttacccgtaaccgaaacggccgtaacccgtacccggttccgggtacggggaaccctacggaccgggacccgggtcccggtcgggtaccgtccgggtaccgttacggtaaccgaaaccggttacccttaccggtacccgtacggttacggttaccgtcgggtaaccgtacgggtaccgggtccgggtacggtaacccgggacggaccggtaccggaaccgttaacggtgacgtggc

SEQ ID NO: 222505 - DNA, 849 bp, Homo sapiens
  misc_feature: GYAE6OF02FGVYV.38.4.A04.1.454.CMB.1.raw
tcagtcgatcacgtcacgaccggtgctcgatttagagtagtgatcaggggctctcagagaggagccttagccctggactccaaggcctttccacttggtgatcagcactgagcacagaggactcaccagtggaattggggctggagtcgtggttttccttgttgctattttagaaggtgtccagtgtgaggtgactacgtggtggagtcgtggggaggtcttcggtccgacgggcccggggggttccctggacgccttccgtaccgtggtcgcacgtcctacgtcgcgtattcctaacctttaacgttaacttagtttaactaggtacgtccggttaccgggtcccgtaccgacgtcccgtacggaacgggggtagggtcgttaggggtaacgggtggggtaccggacaacggtacgttaaacttaaaccgaagtacgtacgggtaacgttaaacgaaaaacgttccgtaagtaggttacggtaacctcgtaaggtacggaaaccggggtccctaacgttcccgaaccctattcccgaaccgaacggtaaccgaaaccgtaacccgaaccgtaaaacgtaacccgtacgtaaccggttaggtccggtacctacggacccgaacgttaggtaacccgggaaaccgggtccggtaacggaacgggtaaccgggacccggaaccggtaaccgggtaacccggttccgggttagtttaaccggtttccggttttcgacgggttccgggtaaaccggtaccggacccccggttaacccccggtacggtaacggggtaccgtaacccggtaacggttacggggtaccggggttacctacccgggttttaaaccgg

SEQ ID NO: 222506 - DNA, 608 bp, Homo sapiens
  misc_feature: GYAE6OF02F70MI.38.4.A04.1.454.CMB.1.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagtcgatcacgtcacgaccggtgctcgatttagagtagtgatcagggggctcgtcagagaggagccttagccctggactccaaggcctttccacttggtgatcagcactgagcacagaggactcaccatggaattgggctgagctgggtttcctgttgctatttagaaggtgtccagtgtgaggtgcaacgtggtggagtcgtgggggaggcgttcggtccaggccgggggggtccctggacgactctaccgtgtgcagcctctgctagttcactttagtactattaangagcgtggtccncgacgtccgtcgagggacgggctaggagtgggtcgccagactacgtaaccaagtagtggacgtagaaaatactagtgtggactgtgtaggaacgggcctagttccgactagtccgtacagtacgaacaacgccgaaagaacctaccacgtcggtcgacgtacgacacgtagtacggaacgcccgtagacgtacggccgaacgaccgaacggcgtagtacgttaccgttcgtaggcgtacggaccggtacccgacccccgtagtcggacgggtactaccggacggtcgggtaccgtaccgttaacg

SEQ ID NO: 222507 - DNA, 621 bp, Homo sapiens
  misc_feature: GYAE6OF02IXNAV.38.4.A04.1.454.CMB.1.raw
  modified_base (192)..(192): a, c, t, g, unknown or other
  misc_feature (192)..(192): n is a, c, g, or t
  modified_base (250)..(250): a, c, t, g, unknown or other
  misc_feature (250)..(250): n is a, c, g, or t
  modified_base (618)..(618): a, c, t, g, unknown or other
  misc_feature (618)..(618): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccagatggacgtagaaaatctatgtggactntgtgaacggcctattcgccatctccgagagacacgcaaagactcacgtgtgctagcanatggaacgcctgagaggcgacgacacggctgtgtacttcgtgtgacgaggaccgcccctagtggaggtacctagaggtgggacgactacggtacttgaccgttacggtggggaccacgggtaccctggaccctacgtctcctacgacgtaccctaccaacgacggccctacgtttcccggtccttacccccgtcggccctacccgtccctaccgaacgacgccgtacctcgggtcgggacaaccgtacgccgggtccgtcggacgtcgccgtgtacgaacgttacctaaccgttccgacgtcgtacctacggtaccgtacgggaccggcgggtaccgtcggacgtacggcggtaccgagtacgacgtnacg

SEQ ID NO: 222508 - DNA, 710 bp, Homo sapiens
  misc_feature: GYAE6OF02GGVIZ.38.4.A04.1.454.CMB.1.raw
  modified_base (673)..(673): a, c, t, g, unknown or other
  misc_feature (673)..(673): n is a, c, g, or t
  modified_base (703)..(703): a, c, t, g, unknown or other
  misc_feature (703)..(703): n is a, c, g, or t
  modified_base (706)..(706): a, c, t, g, unknown or other
  misc_feature (706)..(706): n is a, c, g, or t
tcagtcgatcacgtcacgaccggtgctcgatttagagtagtgatcgagggggggtccctgagactctcctgtgcagcctctgcattcacctttagtaactatttaatgagcgtggtccgccagcctccagggaaggggctggagtgggtggccagctattaaccgaagactggacgtagaaaaattactatgtcggactctggtgaacgggccgtagttccgccattcctaccagacgaaccaacgaccaaagaactcaactgcggctagcacagtacggaacggccgtagaggaggcgacggaccacggactgtcgtacttcgtgtggcgacgaccgccccgtagtcggacgggtactacgaggtgggacgtcctaacgtactttacgacgtacggtacggggaccgtaacgggtaacccgtggtacccgaccgttacctacctaccacgtacccaccgaaccggaaccggtcccctaacggttcccggtacccgttacccccgcgaccccttaccccgtcccgtaaaccgacgtacgaccctaccggtccggtacgggcctaacgaccggtcccggtaccgttccgggccttcggtaccgttacggtacgaaacgttaacccgttacctaccgtaccgtagacgttaccggacggtcggacgggtaccggngtacggaaccgtacggaccgtacgacgtancgntacg

SEQ ID NO: 222509 - DNA, 786 bp, Homo sapiens
  misc_feature: GYAE6OF02HZTNK.38.4.A04.1.454.CMB.1.raw
  modified_base (733)..(733): a, c, t, g, unknown or other
  misc_feature (733)..(733): n is a, c, g, or t
tcagtcgatcacgtcacgaccggtgctcgatttagagtagtgatcaggggctctcagagaggagccttagccctggactccaaggcctttccacttggtgatcagcactgagcacagaggacctcacagtggtagttggggctggacgcgtttgggttttccttaggttagtctttaagttttaaggaaggttcgtacctaggtagttggaggttagacgtaaccggttgggtggaagttcgggtacggggggacgttccgttacggggcgtaccggggccggggggtccctaggacgaccttcgtccgtgtcgccgtcgtcctaacggttcaccttacgtttacccttaccggtttaaattaacgttaagtttaagtacgacgttacggtcgggttcccacccggtcgtaccgtacccgggaagggggtacgggccgtagggacgggtttcggggaccgcgttaaggaaccttaaaggtaaccgaaggttgaacggtaaccgtaaataaaataccgttaggtagtaacggtcctgaagggtacgggacggttacgtctcccgtagtacttacgcgtaaggaaccgtaaacgaccgtacgaaactctacccggtattggactaccggcgacaaaccgtgggaccaccggttagtaaccgggacggtaccggaccgaaccgtggaccctggtttaattcacgttttcgcgggtacgaccgcccggttaaccccncccgttaaggcgggttacgtaacaaccgggtgggacctaaggttccttaacgg

SEQ ID NO: 222510 - DNA, 768 bp, Homo sapiens
  misc_feature: GYAE6OF02GHIIW.38.4.A04.1.454.CMB.1.raw
  modified_base (311)..(311): a, c, t, g, unknown or other
  misc_feature (311)..(311): n is a, c, g, or t
tcagtcgatcacgtcacgaccggtgctcgatttagagtagtgatcaggggctctcagagaggagccttagccctggactccaaggcctttccacttggtgatcagcactgagcacagaggactcacccatggaagttggggctgagctgggttttccttgttgctattttagaggtgtccagtgtgagtgcaacgtggtggagtcgtgggggaggtcgttggtcccgagggcccgggggggtaccctgacggaccgtcctcctggtctcacgtcctcgtgctattcctaaccttttagtaacttatttaangagtcgtggtccgcctacgccgtccgaaggggaacgggtcgtgggaggtgggttcggcccgaaggtcctaacgttaaaacccgaaggtagttacgggaacgttaaggtaaaaacttacgttaaagttcggtacggtaccttacggtaggttaagggacggggtacccgtaacgttcccgtaaccgtacttacccggtaccgaagggtaacgaacccgtaaaccgaccgtaaacggtaaccttaccgaccgtgggttaccgcgtacggtacacgtaacgtacggaaccggccgtaggtaccgggacggtaccgaccgggtaaccaccgggtaccgtttggttaaccgttaccgtttccgtagggttaccggtaaccggaccggtaaccccggtcccccgtaaaggttcgggaaccgggttcctaccggaagggtcgggtaccggtacccgttaaccgg

SEQ ID NO: 222511 - DNA, 764 bp, Homo sapiens
  misc_feature: GYAE6OF02F3XU7.38.4.A04.1.454.CMB.1.raw
tcagtcgatcacgtcacgaccggtgctcgatttagagtagtgatcgaggggggtccctgagactctcctgtgcagcctctgcattcacctttagtaactatttaatgagctggtccgcagcctccgagggagggctggagtgggtgccagctaattaaccaagatggaacgtagaaaaattactagtggtggtacttctagtggaaggccgtattcgcctatcctccgagtagaaccacgacctaaagacctcacgttggtaggctcgacacgagtcggaacggtcctaggacgaggaccgacgtacgacggtcttgtacgttactttcgtcggtggaccggacgcccgaccccctagtacggtacgggacctacgtacgggtagggacgtaccgttacgttacgttacgaccgttcgggtacggggccgtaaaccggttcccgtacggtacccgtaccgtcccgttccgaccgtacccgacccgttaccccgaaccggtaacccgggccctaaccgtttcccggtacccctttccccggcggttcccccaaccccgttaccgttacccgaaacggcccgttaaccctacccggttcggtaccggggaccaacggtccggacccggtcccgggtacggccgtttcgcccggttacggtaccgaacgttcccgttactaccggtacgtaccgttacgtccgtacggttaacgggcgtaccgggtcgacgggtaccgacgggtacctagtaccgtagacgtgaccg

SEQ ID NO: 222512 - DNA, 750 bp, Homo sapiens
  misc_feature: GYAE6OF02I44XH.38.4.A04.1.454.CMB.1.raw
  modified_base (433)..(433): a, c, t, g, unknown or other
  misc_feature (433)..(433): n is a, c, g, or t
  modified_base (745)..(745): a, c, t, g, unknown or other
  misc_feature (745)..(745): n is a, c, g, or t
tcagtcgatcacgtcacgaccggtgctcgatttagagtagtgatcaggggggggtccctgagactctcctgtgcagcctctgcattcacctttagtaactatttaatgagctgggtccgccagcctccgaggggaaggggctgggagtgggtggccagcattaaccaagatggacgtagaaaaaatctatggtggactcttggtggaacgggccgtattccgccatctccgagagacaacgccaaagtactcactggtcggctgacacataggaacggcctagaggacggcgacgaccgtaggcttgtacgttacttcgtggtcgcgacgaccaccccgagtgggacgggactacgaggggtacgggacgaccgttacgtacgtttacgaacgttacgggcggggaccgaacggggttaccctcgggttaccncccgtctacccctacgtaacctccccgttaccgaacccgtaaccgggggacccctacggttcccggtttaccccttcccccggtacggccctaccccctcccttaacgaacgccgaccttacccgtcgggttacggggccaccggtaccgggccccgggtcccggttcggggtacccgttccggccgttaccgggaaccggtaaacggtacccttaccgttccggtaacggttcgacgtccggttaaacgttcgggcccgggtacggggtccgtaccgggtaaccggtaccgggcccgtaggtaacgtcggngtctg

SEQ ID NO: 222513 - DNA, 746 bp, Homo sapiens
  misc_feature: GYAE6OF02FV7AQ.38.4.A04.1.454.CMB.1.raw
  modified_base (163)..(163): a, c, t, g, unknown or other
  misc_feature (163)..(163): n is a, c, g, or t
  modified_base (262)..(262): a, c, t, g, unknown or other
  misc_feature (262)..(262): n is a, c, g, or t
  modified_base (327)..(327): a, c, t, g, unknown or other
  misc_feature (327)..(327): n is a, c, g, or t
tcagtcgatcacgtcacgaccggtgctcgatttagagtagtgatcagggggaagaccgatgggcccttggtggaggcttggtccagccggggggcccctgagacctctccctgtgcagcctctgcattcacctttagtaacctatttaatcgagctgggtccnccagcctccagggaagggctggagtgggtgccagcattaaaccagatggacgtgaaaaactctatgtgactctgtgaagggccatcgccatctcccagngacgtaacgccagaacctcactgtggctgcacatcgaacgcctgagagcgacgacacggtctgtntacttcgtgtcgcgtagacgcccccgatggacggtcctacgacgtgggacgcgtacggactttgaccgttaccgtcggggacccgtaacggggaaccccgttacgggtcccaaccccgttaccttacccgtacccgtaacggaccccgttccccgaaacccgaacggggttacccccacgttcccgggtttaccccttaccccccgtcgggtaaccccgtacccccgttcccgttaacccaaacggtacccggtaacccgtaacccgttcccggttaacgggggtccctaaccgacccgggtacccggtacccgtcggggtacccttcgggtacccttaccggggtaccctaaccggggtaccttaacccggtttccggtaacccggtttccggaaccgttaccggtacccgtaacggg

SEQ ID NO: 222514 - DNA, 671 bp, Homo sapiens
  misc_feature: GYAE6OF02FLG93.38.4.A04.1.454.CMB.1.raw
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
tcagtcgatcacgtcacgaccggtgctcgatttagagtagtgatcagggggggtccctgagactctcctgtgcagcctctgcattcacctttagtaactatttaatgagctgggtccgccagcctccagggaagggctggagtgggtgccagcattaaccaagatggactgaaaaatctatgtggactctgtgaaggccattcgccatctccagacgacaaccnccaaagaactcactgtggctgcacatcgaacggcctagaggaggcgacgcgacggctgtgtaccttntcgtgcgagccgtcccccagtggaggtctacaggtgggactccgtaacgtctttagaaccgtacggnggggacccgaacgggtaaccccgtggtccctacccggtccttcccgtacacggtcccctaccgaacccgtaccgggaccctcgtaccggttccccttacccccgtcggtaccccgtaccccttcctacccgaaagaccaccgttacccgtccggggtacggggccaaaccgcgggtcccggtacccggtgggtcccgtcggtaccgttacggtacgaaacccgtacctttaaccgttaccgtacgttacgacgtaccgtagtccggacggtccgggtcgtaccgggacgtacggcgtaacgtacgcgatacgc

SEQ ID NO: 222515 - DNA, 800 bp, Homo sapiens
  misc_feature: GYAE6OF02GXWL9.38.4.A04.1.454.CMB.1.raw
  modified_base (281)..(281): a, c, t, g, unknown or other
  misc_feature (281)..(281): n is a, c, g, or t
  modified_base (796)..(796): a, c, t, g, unknown or other
  misc_feature (796)..(796): n is a, c, g, or t
tcagtcgatcacgtcacgaccggtgctcgatttagagtagtgatcagggggggggtccctgagactctcctgtgcagcctctgcattcacctttagtaactatttaatgagcgtcgggtccgccagccctccgaggggaaggggctgggaggtggggtggccagcaattaaaccaagagtggacgtagaaaaatactatggtggactctgtaggaagggcctattccgccatctaccgagacgaaccgaaccgaccgaaagaactacactggtggctgcanagtagacggtcctggaggacggaccgacgacgacggcgtgtacgttacttcgtgtcggcgacggtacccgcccccgtaggtcgggacggtactaacggtagggtacgggacggtaccgttaaccggtaccgtttacggacgtaccggggtaccggggtacccggaaccggggtacccgttcgggtacccgtaccccggttcctacccgttaccgaccgtccccgtaacccgaaccgggtaacccggacccgtaccggttccccggttacccccgtttcccccggtcccggtacccctaccccgttacccgaacccgtaaccgggtacccgtacccgtaacccgggtaccgggtaccggggtaaccgaccggacccgggtcccggtcccggtacgggtcccgtcggtaccgggtcggtaacggtaaccgtaccgtaacccgtccgtacggtacgtacggttcggaccggtagggtaccgggtccgggcggtacgggacggacggaccgcgtagcgngctg

SEQ ID NO: 222516 - DNA, 839 bp, Homo sapiens
  misc_feature: GYAE6OF02JWU15.38.4.A04.1.454.CMB.1.raw
  modified_base (269)..(269): a, c, t, g, unknown or other
  misc_feature (269)..(269): n is a, c, g, or t
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtggtggccagcattaaccagatggacgtagaaaatactatagtggactctagtgaagggcctattcgaccattccgtaccagacgaacacgtaccaagaacctcgaactggtacggccttaggcctanacgtacggaaccggtccttagggaacgtaccgggacggaaccgggaccgaaaccggtcgtggttacgtaccgttttactcgggttacggaccgtacggacccggtacccccaggtttacggacggggtaaccttaccggaggtacgggacggtacctaacggttaccgtttaggacccgtttaacggaccgggggtaccgtaaccgggggtaacccctagggtaaccccgtaaccgtccgtacccgttaccggacgtaaccctaccccggaacggaacccgggtacccgaaccggttacccggttcccgtttacccccggtaaccggtcccggaccccgtttaccccgaaccggtaacccggtaccgtaccgttaacccgtcccggtaccggggttacccgacgggtacccgaccgggtacccggttaccggggtccggtaccggtaccggtacgggaccgtaacgggtactaccggttaccgtacggtactacggtacgtaccgttggaccgggttacggccggttacggacggtaaccggtccggtaacgcgtaacggtaccgagtac

SEQ ID NO: 222517 - DNA, 755 bp, Homo sapiens
  misc_feature: GYAE6OF02G4BRT.38.4.A04.1.454.CMB.1.raw
tcagtcgatcacgtcacgaccggtgctcgatttagagtagtgatcagggggggtccctgagactctcctgtgcagcctctgcattcacctttagtaactatttaatgagctggtccgccagcctcagggaagggctggagtgggtgccagcgacttaaccaagatggacgtagaaaaatctatcgtggactctgtgaaggccattcgccatctccgagagaccacgccaagaactcactgtggctgcacagtcgacggcctggagacggcgtacgaccgacggtctaggttactactttcgtaggtggacgacgaccgtacccccagtcggtacggcctaacggacggtcgggacgtaccgttacgtacgtttcgaaccttacggcggggtaccgaccgggtaaccctcggtactaacccggttcctccgtacgaccgtccctacccgaaccggaaccggggtccctacggtaccggttcccctttcccccgttacggaccccgtacccttcccgttacccgaaacggacccgaccggtacccgttccgggtacgggggaccacccggaaccgggttccggacccggtaggggtcccgtacggcccggtttacggtaccgtaaaccgggtaacccgttaccggttacctaaccgggttccggacgttaccggtaccgtcgggtaccccgggtgggaccccggttacggaaccgggtaaccggtccgtaccggttaacgaacgggtcaccgtaacg

SEQ ID NO: 222518 - DNA, 690 bp, Homo sapiens
  misc_feature: GYAE6OF02I2KLU.38.4.A04.1.454.CMB.1.raw
  modified_base (430)..(430): a, c, t, g, unknown or other
  misc_feature (430)..(430): n is a, c, g, or t
  modified_base (614)..(614): a, c, t, g, unknown or other
  misc_feature (614)..(614): n is a, c, g, or t
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
tcagtcgatcacgtcacgaccggtgctcgatttagagtagtgatcagggggaagaccgatgggcccttggtggaggcttggtccagccgggggggtccctgagactctcctgtgcagcctctgcattcacctttagtaactatttaatgagctgggtccgcagcctccgaaggggaaggggtctagggaggttgggtcggccgagactaacgtttaaaccgaaagagttgggaacgtaagtaaaaaacttactaagttggtacggacttcgtaggttaggaagggtcccgattccgacctagtctaccagaacaccaacgaccaaagactctactgaggctggacacagtacgaacggcctaggaacggaggaccggaccgacgaccgggtctcggtcttacgttcgtgtcgacgacggacccgaccccngtacgggacggcgtacgagggtcgggagaccgttacgtatttcgtaccgtacggtcgggaccgacgggtacccgtcggtaccgtaccttccgtccctcgaaccgtccctacccgaaccggaccggcctacggttccgttccccgttcccgtcgaccctacccgttccacgacgtacaccgtccncgggtagccgtaacgcgtccgtacgcgcgtccgacgtgtacgacgtctactccgtaacgngtacgngacggtacgg

SEQ ID NO: 222519 - DNA, 171 bp, Homo sapiens
  misc_feature: GYAE6OF01D9B7A.28.89.I01.1.454.CMB.1.raw
  modified_base (166)..(171): a, c, t, g, unknown or other
  misc_feature (166)..(171): n is a, c, g, or t
tcagagtacgctatcacgaccggtgctcgatttagtatgctagtatcgcggggtgttcggcggagggaccaactgaccgtcctaggtcagcccaaggctgcccctcggtcactctgttcccgccctcctcatagcgtactctgagcgggctggcaaggcgcatagnnnnnn

SEQ ID NO: 222520 - DNA, 169 bp, Homo sapiens
  misc_feature: GYAE6OF01B851P.28.89.I01.1.454.CMB.1.raw
tcagagtacgctatcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatag

SEQ ID NO: 222521 - DNA, 171 bp, Homo sapiens
  misc_feature: GYAE6OF01EUJUD.28.89.I01.1.454.CMB.1.raw
  modified_base (171)..(171): a, c, t, g, unknown or other
  misc_feature (171)..(171): n is a, c, g, or t
tcagagtacgctatcacgaccggtgctcgatttagtatgctagtatcgcgggggggtgttcggcggagggaccaaactgaccgtcctaggtcagcccaaggctgccccctcggtcactctgttcccaccctcctcatagcgtactctgagcgggctggcaaggcgcatagn

SEQ ID NO: 222522 - DNA, 171 bp, Homo sapiens
  misc_feature: GYAE6OF01C3D2F.28.89.I01.1.454.CMB.1.raw
  modified_base (171)..(171): a, c, t, g, unknown or other
  misc_feature (171)..(171): n is a, c, g, or t
tcagagtacgctatcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagn

SEQ ID NO: 222523 - DNA, 172 bp, Homo sapiens
  misc_feature: GYAE6OF01CRRCK.28.89.I01.1.454.CMB.1.raw
  modified_base (170)..(172): a, c, t, g, unknown or other
  misc_feature (170)..(172): n is a, c, g, or t
tcagagtacgctatcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagnnn

SEQ ID NO: 222524 - DNA, 172 bp, Homo sapiens
  misc_feature: GYAE6OF01BZ0OU.28.89.I01.1.454.CMB.1.raw
  modified_base (171)..(172): a, c, t, g, unknown or other
  misc_feature (171)..(172): n is a, c, g, or t
tcagagtacgctatcacgaccggtgctcgatttagtatgctagtatcgcgggggggtgttcggcggagggaccaaactgaccgtcctaggtcagcccaaggctgccccctggtcactctcgttcccgccctcctcatagcgtactctgagcgggctggcaaggcgcatagnn

SEQ ID NO: 222525 - DNA, 181 bp, Homo sapiens
  misc_feature: GYAE6OF01CBHGK.28.89.I01.1.454.CMB.1.raw
  modified_base (171)..(181): a, c, t, g, unknown or other
  misc_feature (171)..(181): n is a, c, g, or t
tcagagtacgctatcacgaccggtgctcgatttagtatgctagtatcgcgggggggtgttcggcggagggaccaaactgaccgtcctaggtcagcccaaggctgccccctcggtcactctgttcctaccctcctcatagcgtactctgagcgggctggcaaggcgcatagnnnnnnnnnnn

SEQ ID NO: 222526 - DNA, 170 bp, Homo sapiens
  misc_feature: GYAE6OF02HNYL1.28.89.I01.1.454.CMB.1.raw
  modified_base (168)..(170): a, c, t, g, unknown or other
  misc_feature (168)..(170): n is a, c, g, or t
tcagagtacgctatcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatagnnn

SEQ ID NO: 222527 - DNA, 169 bp, Homo sapiens
  misc_feature: GYAE6OF02G8OV7.28.89.I01.1.454.CMB.1.raw
  modified_base (168)..(169): a, c, t, g, unknown or other
  misc_feature (168)..(169): n is a, c, g, or t
tcagagtacgctatcacgaccggtgctcgatttagtatgctagtatcgcgggggtgttcggcggagggaccaaactgaccgtcctaggtcagcccaaggctgcccctcggtcactctgttcccaccctcctcatagcgtactctgagcgggctggcaaggcgcatagnn

SEQ ID NO: 222528 - DNA, 171 bp, Homo sapiens
  misc_feature: GYAE6OF02GV7LK.28.89.I01.1.454.CMB.1.raw
  modified_base (170)..(171): a, c, t, g, unknown or other
  misc_feature (170)..(171): n is a, c, g, or t
tcagagtacgctatcacgaccggtgctcgatttagtatgctagtatcgcggggggtgttcggcggagggaccaaactgaccgtcctaggtcagcccaaggctgccccctcggtcactctgttcccgccctcctcatagcgtactctgagcgggctggcaaggcgcatagnn

SEQ ID NO: 222529 - DNA, 170 bp, Homo sapiens
  misc_feature: GYAE6OF02IAO80.28.89.I01.1.454.CMB.1.raw
  modified_base (169)..(170): a, c, t, g, unknown or other
  misc_feature (169)..(170): n is a, c, g, or t
tcagagtacgctatcacgaccggtgctcgatttagtatgctagtatcgcggggggtgttcggcggagggaccaaactgaccgtcctaggtcagcccaaggctgcccctcggtcactctgttcccgccctcctcatagcgtactctgagcgggctggcaaggcgcatagnn

SEQ ID NO: 222530 - DNA, 170 bp, Homo sapiens
  misc_feature: GYAE6OF02ISW8I.28.89.I01.1.454.CMB.1.raw
  modified_base (170)..(170): a, c, t, g, unknown or other
  misc_feature (170)..(170): n is a, c, g, or t
tcagagtacgctatcacgaccggtgctcgatttagtatgctagtatcgcggggggtgttcggcggagggaccaaactgaccgtcctaggtcagcccaaggctgccccctcggtcactctgttcccaccctcctcatagcgtactctgagcgggctggcaaggcgcatagn

SEQ ID NO: 222531 - DNA, 172 bp, Homo sapiens
  misc_feature: GYAE6OF02FVT77.28.89.I01.1.454.CMB.1.raw
  modified_base (171)..(172): a, c, t, g, unknown or other
  misc_feature (171)..(172): n is a, c, g, or t
tcagagtacgctatcacgaccggtgctcgatttagtatgctagtatcgcgggggggtgttcggcggagggaccaaactgaccgtcctaggtcagcccaaggctgccccctcggtcactctgttcccgccctcctcatagcgtactctgagcgggctggcaaggcgcatagnn

SEQ ID NO: 222532 - DNA, 170 bp, Homo sapiens; identical to SEQ ID NO: 222530
  misc_feature: GYAE6OF02G95HR.28.89.I01.1.454.CMB.1.raw
  modified_base (170)..(170): a, c, t, g, unknown or other
  misc_feature (170)..(170): n is a, c, g, or t

SEQ ID NO: 222533 - DNA, 187 bp, Homo sapiens
  misc_feature: GYAE6OF02GBYUA.28.89.I01.1.454.CMB.1.raw
  modified_base (164)..(164): a, c, t, g, unknown or other
  misc_feature (164)..(164): n is a, c, g, or t
  modified_base (170)..(187): a, c, t, g, unknown or other
  misc_feature (170)..(187): n is a, c, g, or t
tcagagtacgctatcacgaccggtgctcgatttagtatgctagtatcgcgggggggtgttcggcggagggaccaaactgaccgtcctaggtcagcccaaggctgccccctggtcactctgttcccaccctcctcatagcgtactctgagcgggctggcaaggcncatagnnnnnnnnnnnnnnnnnn

SEQ ID NO: 222534 - DNA, 173 bp, Homo sapiens
  misc_feature: GYAE6OF01BBHOG.42.12.B01.1.454.CMB.1.raw
  modified_base (113)..(115): a, c, t, g, unknown or other
  misc_feature (113)..(115): n is a, c, g, or t
  modified_base (117)..(173): a, c, t, g, unknown or other
  misc_feature (117)..(173): n is a, c, g, or t
tcagtgacgtatgtcacgaccggtgctcgatttagtagtgtagattccgcgggcacggaccggtgctcggatttagacgacagctctgagccgggctggcaaggccgcatagnnngnnnnnnnnnnnnnnnnnnnnnnnnnnnnnnnnnnnnnnnnnnnnnnnnnnnnnnnnn

SEQ ID NO: 222535 - DNA, 116 bp, Homo sapiens
  misc_feature: GYAE6OF01C994Z.42.12.B01.1.454.CMB.1.raw
  modified_base (116)..(116): a, c, t, g, unknown or other
  misc_feature (116)..(116): n is a, c, g, or t
tcagtgacgtatgtcacgaccggtgctcgatttagtagtgtagattccgcgggcacgaccggtgctcgatttagatcgtctgtgttgggtttgagcgggctggcaaggcgcatagn

SEQ ID NO: 222536 - DNA, 117 bp, Homo sapiens
  misc_feature: GYAE6OF01DQP6I.42.12.B01.1.454.CMB.1.raw
  modified_base (108)..(117): a, c, t, g, unknown or other
  misc_feature (108)..(117): n is a, c, g, or t
tcagtgacgtatgtcacgaccggtgctcgatttagtagtgtagattccgcgggcacgaccggtgctcgatttagtagtgtagattcgcgggctggcaaggcgcatagnnnnnnnnnn

SEQ ID NO: 222537 - DNA, 817 bp, Homo sapiens
  misc_feature: GYAE6OF01CKMDH.42.12.B01.1.454.CMB.1.raw
  modified_base (190)..(190): a, c, t, g, unknown or other
  misc_feature (190)..(190): n is a, c, g, or t
tcagtgacgtatgtcacgaccggtgctcgatttagtagtgtagattcggcggggagttacggacccagagggaaccatggaaaccccagcgcagcttctcttcctcctgctactctggctcccagataccaccggagaaattgtgttgacgcagtctcaggctatcctgttcttgtctccgaaggggaanacgcccaccctctccgtgcgacgggacctaggtcgtacggggttgttacgacgaagtaacctaacgtttaaccgttacggcccgttacggtaccaacgacgaaaccggtaaacccgtcgggccggacggtccctacccgtaacggtcccttccctaccgttaactttccttacggtccgtcgttaacgtccctaaccctacccgaaccgaccgggtaccacggtaccaccaccgtacccgaaggtaccgtacggtttacgacggttcgggccggtttacggtggggttaccggtaagggaccttaaccgtacccttcgtaccctcgtacctaaccgtacgtacggacctacgtacggtcggaacgttcgtaagtcttacgttagtttacgtcgtagttcgtacgttactacggtacgtacgtaggactagttacgttaccgtactttaacccgtactaccgtttaaccggttacggttacccgggtaacgggtaccggtacgggtaacggtacggtaaacgtaccgtaaccgtaaacgttacggttaccggtcgtaccgtaccgtccgtaaccgttacgtttcgttaccgtttacccttacgtcccgttaaccctccccggttaacg

SEQ ID NO: 222538 - DNA, 164 bp, Homo sapiens
  misc_feature: GYAE6OF02ITXZA.42.12.B01.1.454.CMB.1.raw
  modified_base (149)..(164): a, c, t, g, unknown or other
  misc_feature (149)..(164): n is a, c, g, or t
tcagtgacgtatgtcacgaccggtgctcgatttagtagtgtagattccgcgggcacgaccggtgctcgatttagtagtgtagattccgcgggcacgaccggtgctcgattttagagtgtagattcgaggcgtgcgaaggacgcatagannnnnnnnnnnnnnnn

SEQ ID NO: 222539 - DNA, 110 bp, Homo sapiens
  misc_feature: GYAE6OF02GJ83O.42.12.B01.1.454.CMB.1.raw
  modified_base (108)..(110): a, c, t, g, unknown or other
  misc_feature (108)..(110): n is a, c, g, or t
tcagtgacgtatgtcacgaccggtgctcgatttagtagtgtagattccgcgggcacgaccggtgctcgatttagtagtgtagattcgcgggctggcaaggcgcatagnnn

SEQ ID NO: 222540 - DNA, 550 bp, Homo sapiens
  misc_feature: GYAE6OF01CVKPC.40.33.C11.1.454.CMB.1.raw
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcgtggtttcgtgtaggctatttaaagtagtcagtgtgaggtgcagttggtggagtccgggggaggcttagttcagcctggggggtccctgagactctcctgtgcagcctntggagtcactctctccgcctactgggtactcgtgggtccgccaagctccgaggggaaggggctggagtgggtcgcacggtattttanaaagatggatccanagcgtacgcggactccgtgaagggccgattcaccatctccagagacaacgccaagaacacagtgtctctagcaaatggacagtctgagcgccgaggacgacgggtgtactagttattagtaacaaaggtgggaactaagtgaattagtggtagtggacgttcgtaggggaccaaggggacccagggttcgtcgccgttcg

SEQ ID NO: 222541 - DNA, 540 bp, Homo sapiens
  misc_feature: GYAE6OF01BMWYI.40.33.C11.1.454.CMB.1.raw
  modified_base (335)..(335): a, c, t, g, unknown or other
  misc_feature (335)..(335): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcgtggtttcgtgttagctatttaaaaggtgtccagtgtgaggtgcagttggtggagtccgggggaggcttagttcagcctggggggtccctgagactctcctgtgcagcctctggagtcactctctccgcctactgggtactctgggtccgccaagctccgaggggaaggggctggagtgggtcgcacgtatttanaaagatggatccacagcgtacgcggactccggtgaacgggccgattcaccatctccagacgacaacgccaaagaacacagtgtctctgacaaatggacagtcagagngccgaggaccgagggtntactattattagtaacaaaggtgggaactaagtgaatgtggtgtggcgtgtgggaccaagggaccaggtcgtccgcttacg

SEQ ID NO: 222542 - DNA, 624 bp, Homo sapiens
  misc_feature: GYAE6OF01C3CD9.40.33.C11.1.454.CMB.1.raw
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
  modified_base (485)..(485): a, c, t, g, unknown or other
  misc_feature (485)..(485): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctaattttaaaaggtgtccagtgtgaggtgcagttggtggagtccgggggaggcttagtcagccgtgggggtccctgagactctcctgtgcagcctctggagtcactctctccgcctactgggtactcgtgggtccnccaagctccgaggggagggctggagtggtcgctacgtatttaanaaagatggatccagagcgtacgcgactcgtgaacggccgattcacactctccaagacgacaacgaccaaagaaccactagtcgtactacgtagactaaagtcggaactagtctaggaacgacggaccggaagggaaccgtacgggttnttaaccttaagttaagttaacggtaaacgtaaaagggtgggtaaacttaagtagtaaagttggtgggttagtgggtaccgtacgggtacgggggaacccgtaacggggaaccgtaccgggtccgtccgtcccgtttacg

SEQ ID NO: 222543 - DNA, 546 bp, Homo sapiens
  misc_feature: GYAE6OF01BBDAJ.40.33.C11.1.454.CMB.1.raw
  modified_base (545)..(546): a, c, t, g, unknown or other
  misc_feature (545)..(546): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaagggctggagtgggtcgcacgtatttataaagatggatccacagcgtacgcggactccgtgaagggccattcaccatctccagagacaacgccaaagaacacagtgtctctgcaaatggacagtctgagagccgaggacacgggtgtctattattgtacaaaagtgggaactaatgaatatggtgtggacgtctggggcaagggaccaggtcgtcgcctcttatcgcctccaaccgaagggcccacgtccggtccttcccccgtggccgcccctgcctccaggcgcaccgtccgagacgcacacgccggcccgtgggctcggcctgggtcaacggtactaccttccagtcgactagctggacggcgggctggactaagggcagatagnn

SEQ ID NO: 222544 - DNA, 568 bp, Homo sapiens
  misc_feature: GYAE6OF01BNFLA.40.33.C11.1.454.CMB.1.raw
  modified_base (294)..(294): a, c, t, g, unknown or other
  misc_feature (294)..(294): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (477)..(477): a, c, t, g, unknown or other
  misc_feature (477)..(477): n is a, c, g, or t
  modified_base (520)..(520): a, c, t, g, unknown or other
  misc_feature (520)..(520): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggagcttagttcagcctggggggtccctgagactctcctgtgcagcctctggagtcactctctccgcctacgtgggtactcgtgggtccnccaagctccgaggggaaggggctgggagtgggtcgctacgttatttaagtaaagatggatccacagcggtacgcggactccggtaggaacgggccgtattccaccatctaccaagacgaccaacgccaaagaacacagtntctctnacaaatcggacagtcngagagccgaggaccgagggtntcttattattagtaacaaagtgggaataatgaatagtggtagnggtacgtcggtggggacctaagggacccgagggtcgtccgccgttacg

SEQ ID NO: 222545 - DNA, 609 bp, Homo sapiens
  misc_feature: GYAE6OF01DHQC8.40.33.C11.1.454.CMB.1.raw
  modified_base (253)..(253): a, c, t, g, unknown or other
  misc_feature (253)..(253): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (453)..(453): a, c, t, g, unknown or other
  misc_feature (453)..(453): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggagcttagttcagcctggggggtccctggagactctcctgtgcagcctntggagtcactctctccgcctagtgggtactcgtgggtccgccaagcctccgaaggggaagggctgggagtcgggtcncacgtatttaanaaagntaggactccaacagcgtaacgcggaacttccgagaacgggccgaattccaacatctccagagaacaacgccaaagaacacagtcgtctactgacaaatggacagtntgagagccgaaggcgaacgggtgtacttaattagttagtaacaaaaggtggggtaacttaagtagaaagttagttcgggtaggttacgggtaaccggtcgttaccgggggaccgtaaaagggggaccccaaggggttcccgttacgcccgtttaac

SEQ ID NO: 222546 - DNA, 585 bp, Homo sapiens
  misc_feature: GYAE6OF01BNEJD.40.33.C11.1.454.CMB.1.raw
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (461)..(461): a, c, t, g, unknown or other
  misc_feature (461)..(461): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtggggggtccctgagactctcctgtgcagcctctggagtcactctctccgcctacgtgggtactcgtgggtccgccaagcctccgaggggaggggctgggagtgggtcgctacgtatttataaagatggatccacagcgtacgcggactccgngaacgggcatcacntcncaganacaacgcaagaacacagtgtctctagacaagtgacagtctagagacgccgaggacgacgggttntcttaattagttagtaacgtaaaagggtcgggaataagtgtaaagttagtgggttaggtagggtaccggttcggtacgggggaccctaaacgggggccctaacgggtccgtacgtcccgttacg

SEQ ID NO: 222547 - DNA, 541 bp, Homo sapiens
  misc_feature: GYAE6OF01DLEQF.40.33.C11.1.454.CMB.1.raw
  modified_base (290)..(290): a, c, t, g, unknown or other
  misc_feature (290)..(290): n is a, c, g, or t
  modified_base (450)..(450): a, c, t, g, unknown or other
  misc_feature (450)..(450): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccggggaggcttagttcagcctggggggtccctgagactctcctgtgcagcctctggagtcactctctccgcctactgggtactctggtccncaagctcgagggaagggctggagtgggtcgcacgtatttataaagatggatcacagcgtacgcggactccgtgaagggccgattcaccatcctacagagacaacgaccaagaacacagtgtctctgacaatggacagtctgagagccgagacgacgggtntcgtattattgtaacgaaaggtgggaactaagtgtaatagtgggtagtggtacgcgtggggaccaaggggaccacgggtcgtcgccttacg

SEQ ID NO: 222548 - DNA, 584 bp, Homo sapiens
  misc_feature: GYAE6OF01EX06A.40.33.C11.1.454.CMB.1.raw
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagccgtggggggtcctgagactctcctgtgcagcctctggagtcactctctccgcctactgggtactcgtcgggtccgccaagctccgaggggaaggggctgggagtgggtcgcacgtatttanaaagatggatccanagcgtacgcggactccggtgaacgggccattcaccatctaccagagacaacgaccaagaacacagtcgtctctgacaaagtggactagtctagaggacgccggaagaccgtacgggtgtacttatttaagttacgtaacgaaaaggtgggtaactaaagtacgaaagttagtggtaggtggacggttcgtggggaccgtaacgggacccaacgggttcgtcgccgttacg

SEQ ID NO: 222549 - DNA, 659 bp, Homo sapiens
  misc_feature: GYAE6OF01AG3TJ.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttattttaaaaggtgtccagtgtgaggtgcagttgggtgggaggtccgggggaggtcttagttcagccgtgggggtccctgagactctcctgtgcacgcctcgtggagtcactcctcctccgcctacgtgggtacctcgtcgggtccgccaagcctaccggagggggaggggctgggagtgggtcgcacgttatttaagtaaagagtggatccgacacggacgtacggccgggacgtccggtaggaacgggccgattcaccatcctacagacgaacaacgaccaaagaacacgagtgtctacgtgacaagtcggactagtcgtagagacgaccggaggaccgagggttcttacttaattagtttaggtaaacgtaaagggtacggggtaactaagtacgtaaagttaggttgggtgggttagggacccgttacggggtacgggggaacccggtaaacgggggacccggaaccgggttcccggttacccggtcccgtttacg

SEQ ID NO: 222550 - DNA, 541 bp, Homo sapiens
  misc_feature: GYAE6OF01AG63U.40.33.C11.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (507)..(507): a, c, t, g, unknown or other
  misc_feature (507)..(507): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccgaggggaggggctggagtgggtcgcacgtatttanaaagntggatccacagcgtacgcggactccgtgaagggccattcaccatctcagagacacgccaagaacacagtntctctgacaaatggacagtctagagagccgaggacacgggtntctattattgtaacaaaggtgggaactaagtgtaatgtggtgtcggacgttcgnggggaccaacggggaccacgggtctcgccttacg

SEQ ID NO: 222551 - DNA, 611 bp, Homo sapiens
  misc_feature: GYAE6OF01C07UR.40.33.C11.1.454.CMB.1.raw
  modified_base (192)..(192): a, c, t, g, unknown or other
  misc_feature (192)..(192): n is a, c, g, or t
  modified_base (469)..(469): a, c, t, g, unknown or other
  misc_feature (469)..(469): n is a, c, g, or t
  modified_base (611)..(611): a, c, t, g, unknown or other
  misc_feature (611)..(611): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccgagggaaggggctggagtgggtcgcacgtatttataaagntggatccacagcgtacgcggactccgtgaaggccgattcaccatcctccagagacaacgccaagaacacagtgtctctgacaaagtggacagtctgagagccgaggacgacgggtgtctatttattagtaacaaaaggtgggaacttaatgaatagtggtgtggacgtcgtggggaccgaagggaccacggtcgtcgccttcttagtcgcctccaccgaacgggcccagttccggtcccttccccgtcggcccgtccccgtcgcctaccgagggacnccgacccgtaccgagaccgccacgaccggccggtccccgtgggcctcggtcccgtggtacccgtaacgggtaccttaccgttccgtacggtccgacgtaacgcgttggacggtcggggctgggaccgaacgggcacgaatgn

SEQ ID NO: 222552 - DNA, 587 bp, Homo sapiens
  misc_feature: GYAE6OF01CU5T8.40.33.C11.1.454.CMB.1.raw
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
tcagtctagcgactcacgaccggtgctcgatttagagtgagctcgtttgggtttgggggccccagccctgggattcccagctgtttctgcttgctgatcaggactgcacacagagaactcaccatggagcttgggctgagcttgggttttccttgttgctaattttaaaaggtgtccagtgtgaggtgcagttggtggaggtccgggggaggcttagttcagccgtgggggtccctgagactctcctgtgcagcctcgtggagtcactctctccgcctacgtgggtactcgtgggtccncaagcctccgaggggagggctggaggtgggcgctacgttatttaagaaagatggactccanacgcgtacgcggactccggtaggaacgggccattccacctatcctccagacgacaacgccaaagaacacagtcgtctcagacaagtggacagtcngagacggccgaggaccgacgggttntacttattagttacgtaacgaaaggtgggaacttaagtgtaaattagtgggtaggtacggtcggtcggtagggacccgaagggccctacgggtcgtccgtccttacg

SEQ ID NO: 222553 - DNA, 585 bp, Homo sapiens
  misc_feature: GYAE6OF01A4MYE.40.33.C11.1.454.CMB.1.raw
  modified_base (409)..(409): a, c, t, g, unknown or other
  misc_feature (409)..(409): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttattttaaaaggtgtccagtgtgaggtgcagttggtgggaggtccgggggaggcttagttcagccgtggggggtccctgagactctcctgtgcagcctcgtggagtcactctctccgcctacgtgggtactcgtcgggtccgccaagcctccgaggggaggggctgggaggtgggtcgcgacgttatttaataaagagtggactccacaggccgtacgcggactccggtagaacgggccattcaccatcnccagacgacaacgcaaagaacacagtgtctctgacaagtggaacngtcngagcgaccgaggacgacgggtntactattagtagtaacgaaaggtgggaactaagtagtaataggtggtaggtacggacgtcggtacggggacccaaggggacccaagggttccgtccggtccttag

SEQ ID NO: 222554 - DNA, 751 bp, Homo sapiens
  misc_feature: GYAE6OF01ETJBA.40.33.C11.1.454.CMB.1.raw
  modified_base (521)..(521): a, c, t, g, unknown or other
  misc_feature (521)..(521): n is a, c, g, or t
  modified_base (591)..(591): a, c, t, g, unknown or other
  misc_feature (591)..(591): n is a, c, g, or t
tcagtctagcgactcacgaccggtgctcgatttagagtgagctcgttgggtttgggggccccgacgccctgggattcccagctgtttctgcttgctgatcaggacctgcacacgagagaactcaccatggagcgttgggctgagcgtggtttcgttgttagctatttaaaggtgtccagtgtgagtgctagttggtggagtcccgggagcttagtcagtccgtgggggtccctagagtaccgtcctccgtggtcgcacgccttcgtggagtccactctcctccgcctactggtacctcgtcggtccgccaagtcctaccgaggggaacgggcctgggaggtcggggtaccgacgtacggttaattttaacgtaaaagtagttaggtaactcccgaacgtacggtcccggttaacggaccggtaacgttccggtaggaaacggggtcccgtaagttccgtaacccgtagttccgtaccgagtaacgaactaaccggacccgtaaaagaaccgtctaacggtntaccttcgaggaaccctaaagttcggaacctgttcgagagaccggtcccggaagtaccgtaccggggttntacctttaagtttaccgtttacggaaacgtaaacgggttcggggaacctttaaagggtacgtaaaagtttcggttggggtagtacggggtaaccgttcggacgggggaaccctaaagggggaccccttaacgggtttcccggttaaccgcctttaaacgg

SEQ ID NO: 222555 - DNA, 565 bp, Homo sapiens
  misc_feature: GYAE6OF01BE2TU.40.33.C11.1.454.CMB.1.raw
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactcgtgggtccgccaagctccgaggggaaggggctgggaggtgggtcgctacgtatttaagaaagatggatccacagcgtacgcgactccgtgaacggccgattcaccatcctccagacgaacaacgaccaaagaacacagtgtctctgacaaanggacagtctagagagccgaggacgacgggtntcttaattagttgtaacaaaggtgggaactaagtagaatagtgggtaggtaggtaccgtggtcgggaccgaaggggaccacgggtcgtccgcgttacg

SEQ ID NO: 222556 - DNA, 779 bp, Homo sapiens
  misc_feature: GYAE6OF01EKUVC.40.33.C11.1.454.CMB.1.raw
  modified_base (635)..(635): a, c, t, g, unknown or other
  misc_feature (635)..(635): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggtttttccttgttgcttaagttttaaaggtgtccagtgtgaggtgcgtaggttggtgggaggtccgggggaggtctttagttcacggtccggtgggggtccctggacgacttctcctgtgcacgcctcgtggagtcacctctcctccgcctacgtcgggtactcgtcgggtcccgaccgagccgtaccggagggggaacggggtcgtggggacgggttcggggtccgacgtaacggtttaattttaaagtaaaggtagttagggaaccttaccgaacgacggtaccggtaaccggacgggtacccgttacccgggtagggaaaccggggtcccgtaacgttacccgaacccgtacttcccgtacccgaaaggaaccgaaccaaacccgaacccgaaaacgaaccgaacgtaaggttccgttacctacgttagaactaaagttcggaaactagttctaggaacgacgacccgggaaggaaccgtacgggttnttacgttaagttttagttaacggtaaacgtaaaagggttgggaaacttaaggtagtaaagttggtagggttaggtacgggtacggttcggacgggggaacccgtaaaggggtacccgtaacgggtttccgtcgtcccgtttacg

SEQ ID NO: 222557 - DNA, 581 bp, Homo sapiens
  misc_feature: GYAE6OF01CZKG1.40.33.C11.1.454.CMB.1.raw
  modified_base (189)..(189): a, c, t, g, unknown or other
  misc_feature (189)..(189): n is a, c, g, or t
  modified_base (238)..(238): a, c, t, g, unknown or other
  misc_feature (238)..(238): n is a, c, g, or t
  modified_base (283)..(283): a, c, t, g, unknown or other
  misc_feature (283)..(283): n is a, c, g, or t
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
  modified_base (578)..(578): a, c, t, g, unknown or other
  misc_feature (578)..(578): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccgaggggaagggctggagtgggtcgcacgttatttaanaaagatggatccacagcgtacgcggactccgtgaaggccattcacatcncagagacaacgccaaagacacagtgtctctgcaaatggacagtcngagagccgaggacacgggtgtctattattagtacgtaaaaggtgggaactaagtagaatagtggtgtggacgtcgtggggaccaagggaccacggtcgtcgcctcttatcgcctccacgacggcccagtccgtcctccccnggccgccctcgctcccgaggacncaccgtccgagacgcacgacgccggcccgngggcctcgccgtcggtacgaaacggaccttaccgttccacggtccgaccgtaggacctgggacggcggggtccgagggaccgaagggcccacgtagtaggnacg

SEQ ID NO: 222558 - DNA, 877 bp, Homo sapiens
  misc_feature: GYAE6OF01DHTS3.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctaattttaaaaggtgtccagtgtgaggtgcagttggtggaggtccgggggaggtcttagttcagccgtgggggtccctgagctctcctgtgcagcctcgtggacgtcactcctctccgcctacgtgggtacctcgtcggtccgaccaagtcctaccggaggggaacgggcgtaggacggtcgggtacgacgtaacggttaatttaaagtaaaaggtagttacgggaacttacccgaacgaacgggtacccggttaaccggacccggggtaacccgttacccgggtaacggtaaaccgggggaccccgttaacgtttacccgaacccgtaaccgttcccgttaacccgaaacggaaaccggtaaacccgaaacccggtaacccgtaaaaacggaaaccccgtaacgtaacggtttaccgttaccgtaccgttacggaaactaaacggtcgggtaaaccgtaacggttacgtagggaacgggaaccgggtacccggtaaacggggtaccgtaaccgggggttgttaaccgtttaaagttttaacggtttaacgttaaacgggtaaaacgggttacgggggtaaaacttaaaggtaaggtaaaacgtttagggttacgggttagggtacgggtaacccggttaccgggtaacgggggaaacccggttaaacggggaccccggttacggggtttacccggtaccggttccccgttttaacccgg

SEQ ID NO: 222559 - DNA, 533 bp, Homo sapiens
  misc_feature: GYAE6OF01C21J6.40.33.C11.1.454.CMB.1.raw
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaaagaacacagtgtctctgcaaaatggacagtctgagagccgaggacacggggtgtctattattgtaacaaaagtggggactaaatgaaatatggtgtggacgtctggggccaaagggaccaggtcgtcgcctcttatgcctccaaccaagggcccatcgtccttccccctggccgcccctgctccaggagccaccctccgagacgcacacgcggccctgggctgcctggtcaaggctacttccagtccgntagctgagcgggctggcaagggcncangnn

SEQ ID NO: 222560 - DNA, 758 bp, Homo sapiens
  misc_feature: GYAE6OF01BEXOS.40.33.C11.1.454.CMB.1.raw
tcagtctagcgactcacgaccggtgctcgatttagagtgagctcgttgggtttggggccccagccctgggattcccagctgtttctgcttgctgatcaggactgcacacagagaactcaccatggagcttgggctgagctgggttttccttgttgctatttaaaaggtgtccagtgtgaggtgcagttggtggagtccggggagcttagttcagccgtgggggtccctgagactctcctgtgcagcctcgtggagtcactctcctccgcctacgtgggtactcgtcgggtccgccgaagcctccggaaggggaaggggtcctgggaggtcgggtcgacgacgttaattttaagaaaaggattagggacttaccaacgaggtaccggtacgccgggtaactcccggtaggaaacgggccgtaattcccaaccgtacgtctacccgaaggacgaaccgaaccgaccgaaagaaccaacgacgttcgtactctacgacgtaaagtcggaactacggtacgtacggaacggacggaccgggaacggtaccggtaacggggttacgttaccgtttaagtttaacgtttaacgggttaaaccgtaaaaacggggttcggggtaaaaccgttaaagttacggtaaaagtttaacgggttggggttaggttacggggttaacggtaccgggtacgggggtaacccggtaaaacggggtaccccggtaacggggttcccggtttaacccgggtcccgttttaaccgg

SEQ ID NO: 222561 - DNA, 912 bp, Homo sapiens
  misc_feature: GYAE6OF01EFMIB.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcgttgggctgagtcgttgggttttccttgttgtacttaagttttaaaaggtgtccaggttgtggaggtgcgtaggttggtgggacgggtccgggggaggtctttaggttcgaggtccggtcgggggtccctgacgtactctccgtgtcgcgacgccgtcgtggacgtcctacttcctccgtccgtaccgtacgttcgggttacctcggtcgggtccgaccgtaacggccgtaccggaagggggacgggtcgttagggtacggttcgggtccgacgtaacggtttaattttaaagtaaaaggtagtacggtactacccgaacgtacggtaccggtaacggaccggtaccgttccggtagggaaaccggggtccgtaacttacccgaacccgtacgttacccgtaccgaaaggaaccgaaccgaaacccggaacccgtaaaacggaacctacggttaacggttccgttaccttacggtacggtaaaccgtaaaaggttcgggaaactacggtttaccgaaggaaacggtaccgggacccggaaacggggtacccgttacggggttactttaccgtttaaaggtttaacggttaacgggtaaaacgtaaaaggggttcggggttaaaaaccttaaaggttacgggtaaaagtttacgggttcggggtttaagggtaccggggttaaacccgggtttcggggaaacccggggggaaaccccgtaaaacgggggggtttaccccctaaccggggggtttaccccttccgggtaaacccccgtttttacg

SEQ ID NO: 222562 - DNA, 596 bp, Homo sapiens
  misc_feature: GYAE6OF01EW4SB.40.33.C11.1.454.CMB.1.raw
  modified_base (202)..(202): a, c, t, g, unknown or other
  misc_feature (202)..(202): n is a, c, g, or t
  modified_base (490)..(490): a, c, t, g, unknown or other
  misc_feature (490)..(490): n is a, c, g, or t
  modified_base (594)..(595): a, c, t, g, unknown or other
  misc_feature (594)..(595): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgctacgtattttataaagatggatccanagcgtacgcggactccgtgaagggccgattcaccatctccagagacaacgccaagaacacagtgtctctgcaaatggacagtctgagagccgaggacacgggtgtctattatgtaacaaaaggtgggaactaagtgaaatagtgggtgtaggacgtcgtaggggaccaaggggaccacggtcgtccgtcctacttagtcgccctccaaccgaacgggccctagtccggttccttcccccgtggcccgtcccctcgcctaccgaggacgccaccctccgagacgcacgngccggtccctcggggctcggccgttgggtacaacggtacctaccgttccgacgttccgactagacttaggacggccgggtcgtgggaccaagggcgacgagtgnng

SEQ ID NO: 222563 - DNA, 760 bp, Homo sapiens
  misc_feature: GYAE6OF01D6R9K.40.33.C11.1.454.CMB.1.raw
tcagtctagcgactcacgaccggtgctcgatttagagtgagctcgttgggtttggggccccagccctgggattcccagctgtttctgcttgctgatcaggactgcacacagagaactcaccatggagcttgggctgagctgggttttccttgttgctattttaaaggtgtccagtgtgaggtgctaggttggtggaggtccgggggaggtcttagttcaggccgtggggggtccctgagactctcctgtcgcagcctcgtggacgtccacttcctcctcccgtccttacgtcgggtacctcgtcgggtcccgaccgaagcctaccggaagggggaacggggcgtgggaggttcggggcgtaccgtaacgttaattttaagaaaagtagtaggtactaccgaacgacggtaccggtaaccggccgggtaccgtccgggtagggaacgggtccgtaacgtttaccaaccctacgttacccgtaccgaaacggtaacgaaccaaaccggacccgtaaaagaaccgaacgtacggttcgtacctacgtagaacctaaagtacggactacgtcgtaggacgacggaccgaggtaacgtacgggtacgttacttaagtttaagttacgtaaacgtaaaggtacggggtaaattaaacggtagtaaagttaggttagggttaggtagggtaccgggttaccggtacgggggaacccggtaaacggggtacccgtaacccgggttcccgggttcgtcccgtttaaccg

SEQ ID NO: 222564 - DNA, 582 bp, Homo sapiens
  misc_feature: GYAE6OF01BC8E3.40.33.C11.1.454.CMB.1.raw
  modified_base (239)..(239): a, c, t, g, unknown or other
  misc_feature (239)..(239): n is a, c, g, or t
  modified_base (334)..(334): a, c, t, g, unknown or other
  misc_feature (334)..(334): n is a, c, g, or t
  modified_base (385)..(385): a, c, t, g, unknown or other
  misc_feature (385)..(385): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccgagggaagggctggagtgggtcgcacgttatttaataaagatggatccacagcgtacgcggactccgtgaagggccgattcacatcncagagacaacgcaagaacacagtgtctctgacaaatggacagtctgagagccgaggacagggtcgtctattattagtaacaaaggtgggaataangaatagtggtgtgacgtcgtggggacaagggccacggtcgtcgcctcttancgcctaccgaccgacggccctacgtccggttccttcccccgtcggtcccgccccgtagtccgtaccgaggacgaccaccgtcggacgacgacgacgagccggccgtcggccgtcgccgttacgggtacaacgtactacgttccgacgtcgacgtagcgtaggacggcgggacgtgggacgtaagggcganagtgngn

SEQ ID NO: 222565 - DNA, 860 bp, Homo sapiens
  misc_feature: GYAE6OF01A3SZS.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcttgggtttttccttgttgtcttaatttttaaaaggtgtccagtgtgaggtgcgtaggttgggtgggaggtccgggggaggtcttagttcgaggccggtgggggtccctgagactctcctgtcgcacgcctcgtggacgtcactcctcctccgtcctacgtcgggttaccttcgtcggggtcccgacctaacggccgtacccggaaggggggaacgggggtcgttaggggacgggttcggggtccgacgttaacggttttaagttttaaagtaaaaggtagttacggaacttacccgaacgtacggacccggttaaccggaccgggtaacccgttccccgggtaagggaaaccgggggtccctaacgtttacccgaaacccgtacttcccgtaacccgaaaggaaccgaaaccgaaccccgaaccaaaacggaacctaacgtacggtttcgtacctacgtacgaactaaacggtcggaactacggttacgtagggaacggaccgggaacccgggaagggtaacccggtaggggtttacttaaccgtttaagttttaacgtttaagggaaaccgtaaaagggggttcgggtaaaacttaaaggtggtaaaagtttgggtaggggtttagggtacgggtacccggttacggggtacgggggaacccgtaaaccggggggtacccgttaccggggttccggttaccccgttccgtttaaccgg

SEQ ID NO: 222566 - DNA, 681 bp, Homo sapiens
  misc_feature: GYAE6OF01A25DF.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgctattttaaaaggtgtccagtgtgaggtgcagttggtggaggtccgggggaggcttagttcagccgtgggggtccctgagactctcctgtgcagcctcgtggagtccactctctccgcctactgggtactcgtcggtccgcaagcctccgaggggaagggctgggaggtgggtcgcacgttatttaataaagatggactccacgagacgtacgcggacgtccggtagaacgggcctattcaccatctccagacgacaacgcaaagaacacgagtgtctctgaccaaagtcggaactaggtcctaggacggacggaccggaagggaaccgtacggggttattacctttaagtttaagttaacggttaaacgaaaaggggttcggggtaaaacttaaagtacggtaaaagttagggttagggttagggttacgggtaacccgggttcgggtaacgggggggaaccccgtaaacggggggtacccccgtaaccgggggtttcccggttacccggtcccgttttaacg

SEQ ID NO: 222567 - DNA, 781 bp, Homo sapiens
  misc_feature: GYAE6OF01DIXA3.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgcttaattttaaaaggtgtccagtgtgaggtgcaggttggtggaggtccgggggagcttagtcagccgtgggggtccctgagactctcctgtgcagcctcgtggagtcactctcctccgcctacgtgggttacctcgtcgggtcccgaccaacggccgtaccggagggggaacggggcgtggggaggttcggggtaccgacgtaacggtttaattttaaagtaaaaggagttacgggaacttacccaacgacggtccggttaaccggccgggtaacccgtcccggtagggaaacgggtccgtattacccgacctactcctaccgagaacgacaaccggaccaaagaaccactaggtctctacgtagaacctaaagtcgggaactaggtcgtaggaagacggaccggaagggaccgtacggggttattacctttaagtttaacgtttaacgggtaaacgtaaaagggggttcggggttaaaaccttaaagggttaggtaaaacgtttagggtttagggggtacggtttagggggaacccggtttcggggttacgggggggaaaccccgtaaacggggggtaaacccccgtaccgggggtttcccgtcccgggttcccctttaacggg

SEQ ID NO: 222568 - DNA, 590 bp, Homo sapiens
  misc_feature: GYAE6OF01BGQHJ.40.33.C11.1.454.CMB.1.raw
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggagcttagttcagcctggggggtccctgagactctcctgtgcagcctctggagtcactctctccgcctactgggtactcgtgggtccnccaagctccgagggaggggctgggagtgggtcgcacgttatttaataaagagtggatccacagcgtacgcggactccgngaacgggccagttccacatctcagagacaacgaccaaagaaccacagtcgtctctgacaaagtcggacagtctagagngccgaggacacggggtntacgttattagttagtaacgtaaaggtgggtaactaaagtgaaattggtgggttagtacggggtacgtcgggttaggggacccgtaaggggaccctaacggggtcccgtacggtcccgttaacg

SEQ ID NO: 222569 - DNA, 595 bp, Homo sapiens
  misc_feature: GYAE6OF01CKFG7.40.33.C11.1.454.CMB.1.raw
  modified_base (221)..(221): a, c, t, g, unknown or other
  misc_feature (221)..(221): n is a, c, g, or t
  modified_base (260)..(260): a, c, t, g, unknown or other
  misc_feature (260)..(260): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
  modified_base (593)..(594): a, c, t, g, unknown or other
  misc_feature (593)..(594): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccgagggaaggggctggagtgggtcgcacgttatttaataaagatggatccacagcgtacgcggactccgngaaggccattcaccatctcagagacaacgccaaagaacncagtgtctctgacaaatggacagtctagagagccgaggacacgggtgtactattattagtaacgaaaaggtggggaactaagtagaaatagtggtgtggacgtcgtcggggaccaagggaccacggtcgtcgcctctatcgcctcccaacgaacgggcccacgtccggtcccttcccccgtcggcccgtcccgtcgcctccgaggacgccaccgtccgacgacgccacgcggccgggcccgtcgggctcggtccgtcggtacgaacggtccttaccttccgagtccgactacgactggacggtcgggcgtcggacgaacgggccganacgngnng

SEQ ID NO: 222570 - DNA, 579 bp, Homo sapiens
  misc_feature: GYAE6OF01DWSMP.40.33.C11.1.454.CMB.1.raw
  modified_base (316)..(316): a, c, t, g, unknown or other
  misc_feature (316)..(316): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcggtggtttcgtgtaggcgtatttaaagtgtcagtgtgagtgcagttggtggagtcggggagcttagtcagccgtgggggtccctgacgctctcctgtgccagcctgtggactcactctctccgctacgtgggttacctcgtgggtccaccaaggtccgtccgaagggggaaggggnttagggaggtgggtcgactaggttattaagtaaagcgtggactccgacaggcgacgcgactcggagaacggcatcactnctcanacgacacgacaagacanagtctctcagacaagtcggactagtcgagagcggaccgtagaacgtgggtactagttattattagaagaaggtgggaactaagtgtaaagtcggtgggtagtcggtacggttcgggacgggtaaccgaacggggaccacggtttcgacccgtgtttaacccg

SEQ ID NO: 222571 - DNA, 798 bp, Homo sapiens
  misc_feature: GYAE6OF01E3CFN.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcttgggttttccttgttgtcttaattttaaaaggtgtccagtgtgaggtgctaggttggtgggaggtccgggggaggtcgttaggttcgacggccggttcggggggtccctggacgtactctccgtgtcgcacgccttcgtggacgtctacctcctcctccgtcctacggttcgggtacctcggtccggtccgaccgacgtccgtacgggagggggacgggtcggtagggtaggtcgggtccgtacgttaacgtttaagtttaaagtaaagtacgtacggtacctaccgaacgtacggaccggtaccggaccggtaccgtacgggtacgggaaccggtaccgtactaccgacctacgtaccgtaccgaagaacgaaccaaccgaaccgaaaacgacctaacggtcggttacctctacgtaacgaacgtaaacgtcggaactaggttcgaacgggaacgcgggacccggtaacgggtcggtaacgggttctttaactttaaagtttacggtaaacgaaaacgggttaaggggtcggtaaaacttaagtacggtaaatttcgggggttcggttaacgggtacgggtaccggggtttaccgggacccgggggaaaccgtaacggggcccgttaacccgggtttcgtccccgttcgttacgg

SEQ ID NO: 222572 - DNA, 844 bp, Homo sapiens
  misc_feature: GYAE6OF01A832P.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcgttgggtttttccttgttgcttaattttaaaaggtgtccagtgtgaggtgcagttggtgggaggtccgggggaggtcttagttcgacggccgtggggggtccctgagactctccgtgtgcacgcctcgtggagtccactcctcctccgcctacgtcgggtacctcgtcggtccgaccaaggcctaccggaagggggaacggggcgtgggaggtgggtcgcgtacgttatttaagtaaagagtaggactccgacgacggtacggtaccggccggtaccgtccggtaggaaacggggtcccgtaacgttcccaaccctactaccgtacccgaacggaaccgaaccgaaaccgaacccaaaaggtaaccaacgtacggttacgttccctaacgttaggaaccctaaaaggtcgggtaaacctaggttaccgtaagggaacggaaccggcccgggaaaggggtacccgtaagggggtttcttaacgtttaagtttaacgtttaacggtaaaacggtaaaaacggggttggggaaaccttttaaaggtaaggtaaaacgtttagggttacgggggttacggttaacgggggtaaccccgggtttcgggggtaacccgggggggtaaccccccggaaaaacggggggttccccccgggtttaaaccggggttccccgggttttaacccccgggaccctttttaaaccggg

SEQ ID NO: 222573 - DNA, 684 bp, Homo sapiens
  misc_feature: GYAE6OF01A38IL.40.33.C11.1.454.CMB.1.raw
  modified_base (385)..(385): a, c, t, g, unknown or other
  misc_feature (385)..(385): n is a, c, g, or t
tcagtctagcgactcacgaccggtgctcgatttagagtgagctcggttgggttgggggccccagccctgggattcccagctgtttctgcttgcgtgatcaggattgcacaccagagaactcaccatggaggcttgggctgagcgttgggtttccttgttgacttattttaaaaggtgtccgtagtgtggaggtgcgtaggttggtgggaggtccggggaggtcttagttcgacgtccgtgggggtccctgacgtactcgtcgtgtgcagtcctgtggacgtcacgtctctccgcctacgtcggtactcgtcggtccgactaacgtcgtacggagggaacgggtcgtagggtacggtcggtcgacgtaacggttatttagtaaagngtcgatccgacgacgtcgacggcggtacgtaccggtaggacgggtccgtactaccgactacgtctaccgagacgacgaacgacgaacgaacgacgacgtacgtactacgtcgtacgaacgtacgacgtacgtacgtaggtacgacggacgggacggtaacggacgggtacgtacgttacgttagttaacgtaacgtaaggtaacgggtaacgtaagtagtaagtacgtacggtaggtaggtcggtactcggggggggggggtacctacgggaccggtacggtacggtccgtcgttaccg

SEQ ID NO: 222574 - DNA, 551 bp, Homo sapiens
  misc_feature: GYAE6OF01DE6KQ.40.33.C11.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
tcagtctagcgactcacgaccggtgctcgatttagagtgagctcgttgggtttgggaggcttagttcagccgtggggggtccctgagactctcctgtgcagcctctggagtcactctctccgcctacgtgggtactcgtgggtccgccaagctccgaggggaaggggctgggagtgggtcgctacgtattttaataaagntggactccacagcgtacgcgactcgtgaggccattcaccntcncagacgaccaacgcaaagacacagtgtctctgcaaatgacagtctgagacgcgaggacgtacggtntactaattattgtaacaaaggtgggactaatgaatatggtgngcgtgtacggggacaagggaccgtacgtcgtcgtcctattancgcctcacgaacggcctacgtcgtcctcccgngcctcctgctacgagcgaccnccgtcgacgcgacacncggtcgaccgtggctcgtcgtagtacgagaccttctacgngtacacgtgacgtaggaggccggcgtggacgcggtacgnaagtcgngac

SEQ ID NO: 222575 - DNA, 592 bp, Homo sapiens
  misc_feature: GYAE6OF01EKX3B.40.33.C11.1.454.CMB.1.raw
  modified_base (191)..(191): a, c, t, g, unknown or other
  misc_feature (191)..(191): n is a, c, g, or t
  modified_base (590)..(591): a, c, t, g, unknown or other
  misc_feature (590)..(591): n is a, c, g, or t
tcagtctagcgactcacgaccggtgctcgatttagagtgagctcgttgggtttgggaggcttagttcagcctgggggggtccctgagactctcctgtgcagcctctggagtcactctcctccgcctactgggtactctgggtccgccaagctccgaggggaaggggctggagtgggtcgcacgtatttaanaaagatggatccacagcgtacgcggactcgtgaagggccattcaccatctccagagacaacgccaaagaacacagtgtctctgacaaaatggacagtctgagagccgaggacgacgggtgtctaatttattgtaacgaaaaggtggggaacttaatagaaatagtgggtgtggacgtcgtggggaccgaaagggccacggtcgtcgcctcttatcgcctccaccgacgggccactccggtccttcccccgtggcccgccctcgcctccgacggacgccacccgtccgagacgcaccgacggccgggccccgtgggccgtcgtccgttaggtaccgaacggtaccttacttcccgagtccgactaggctaggcggcgggcgtggacgacgggcacatagnng

SEQ ID NO: 222576 - DNA, 716 bp, Homo sapiens
  misc_feature: GYAE6OF01B6OMN.40.33.C11.1.454.CMB.1.raw
  modified_base (212)..(212): a, c, t, g, unknown or other
  misc_feature (212)..(212): n is a, c, g, or t
  modified_base (378)..(378): a, c, t, g, unknown or other
  misc_feature (378)..(378): n is a, c, g, or t
  modified_base (549)..(549): a, c, t, g, unknown or other
  misc_feature (549)..(549): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctacgtgggtactcgtgggtccgaccaagcctccggaagggggaacggggcgtagggaggtgggtcgctaacgttattttaaagaaaagngttaggactaccaacgaggccggtacggccggacctccggtaggaaacgggcctattccaacctatcctaccgaagaacgaaccaaaccggccaaaagtaaccacgtagttcgtcctcgtagactaaagtggactagtctaggagacggacggaaggacgtaggtntacttattagtagtaaacgtaaaggtggaactaagtagaatgtggtgaggtacgtcggtacgggacgaacgggaccgtacggtcgtccgtctcgttacgccgcctaccgaaccggaccgcctacgtcccgtcccttcccgcggccgtccctcgtaccgaccgagggtaccncccgtaccgtacgacgaccgccgacgtaccgccggtaccgtcgggcctcgggtcccgtacgtaccgtaacggtacccttacgtccgtaacggtccgtaccggagtaaccggtagggacggccgggcggttaccgggaaccggtacgggaccctaagaaggcgtcgag

SEQ ID NO: 222577 - DNA, 737 bp, Homo sapiens
  misc_feature: GYAE6OF01BCZLH.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttattttaaaaggtgtccagtgtgaggtgcagttggtggaggtccgggggaggtcttagttcagccgtgggggtccctgagactctcctgtcgcagtcctcgtggacgtccactcctcctccgtcctacgtcgggtactcgtcgggtccgaccgaagtcctaccggagggggacgggtcgtgggacggtcgggtcgacgtacgttaatttaagtaaagtagtacggactaccgacgtacggacggtaccggcggtaccgtccggtaggaacgggtccgtaacttccaaccgtactccgtaccgaaggacgaaaccaaccggacccaaaagaaccaacgtagttacgtacctacgaaggtaactaaacggtcggaaacctacggttacgtaggaacgggacggtacccgggtaaaggaacccggttacggggttacgttactttaacgtttaggttaacggtaaaacggtaaaggggttacggggtaaacttaagtaggtaacttagggttcggtaggtacggtaccggtcgggacgggggtaaaccaacggggtacccaacgggtcgtccgtccttacg

SEQ ID NO: 222578 - DNA, 548 bp, Homo sapiens
  misc_feature: GYAE6OF01BMSJM.40.33.C11.1.454.CMB.1.raw
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (401)..(402): a, c, t, g, unknown or other
  misc_feature (401)..(402): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagtctagcgactcacgaccggtgctcgatttagagtgagctcgttgggtttggggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggagcttagttcagccgtgggggtccctgagactctcctgtgcagcctcgtggagtcactctctccgctacgtcggtactcgtcggtccnccaagcctccgaggggacggctgggagtgggcncacgtattanaacgntggatccangacgtgcgtctcgngacggcnctcacntcacganacgacaacgcaanacnngtncntagacaagtgacngtctagngagcgagacgcggtnttcttaagttcgtaagaacgtaaaggtcgggaataagtagaattggtgggttagngggttacncgggtacgggacgacgggacccgtacggtctccgtgttaaccc

SEQ ID NO: 222579 - DNA, 892 bp, Homo sapiens
  misc_feature: GYAE6OF01C03W1.40.33.C11.1.454.CMB.1.raw
tcagtctagcgactcacgaccggtgctcgatttagagtgagctcgttgggtttgggggccccagccctggattcccagctgtttctgcttgctgatcaggactgcacacagagaactcaccatggagcttgggctgagcgttgggttttccttgttgcttaattttaaaggtgtcagtgtgaggtgcgaggttggtggaggtccggggagtcttagttcagccgtgggggtccctgacgactctcctgtcgcacgtcctcgtggtacgtccacttcctctcccgtccttacgtcgggttactcgttcgggtcccacaacgccgtacggagggggaacgggcgtgggaggtcggggaccgtacgttaaggtttaatttaaagtaaacgtagtacgggaacttacccgaacgtacggtccggttaaccgggaccggtaccgttcccggttaaggggaaccgggtcccgtaacgttttacccaccgttaacgttaccgttaccgaaacgggaaacgaacccaaacccggaacccgtaaaccggaaaccgaaccggttacgttaccgttacccttacggtaacttaacccggaaaggttcggaaacgttacggtacgttacgggaacggaccggaccgggtaacgggtaaaccggtcgggggttttaacgttacgtttaacgtttttaagttaacggttaaaccggtaaaaggggttacgggggtaaaactttaaagggtaaggttaaaccgtttagggttacggggtttacgggtacggggtttaacccgggttacccgggggttaacggggaaccccgggtaaaacccgggggggttaacccggtacccgggggtttaaccccggttcccgttaccccggtttttaaacccggg

SEQ ID NO: 222580 - DNA, 602 bp, Homo sapiens
  misc_feature: GYAE6OF01BENXY.40.33.C11.1.454.CMB.1.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (502)..(502): a, c, t, g, unknown or other
  misc_feature (502)..(502): n is a, c, g, or t
  modified_base (600)..(600): a, c, t, g, unknown or other
  misc_feature (600)..(600): n is a, c, g, or t
tcagtctagcgactcacgaccggtgctcgatttagagtgagctcgttgggtttgggaggcttagttcacgcctggggggtcccctgagactctcctgtgcagcctctggagtcactctctccgcctactgggtactctgggtccgccaagctccgagggaagggcttggagtgggttcgcacgttatttataaagatggatccanagcgtacgcggactccgtggaaggccattccaccgatctccagacgaccaacgccaagaacncagtgctctgacaaatggacagtctgagacgccgaggacacgggtntctagttagttagtaacgaaaaggtgggaacttaatgtaaatagtgggtagtagggaccgttcgtaggggacccaaaggggccctacgggtccgtcgccttcttatcgccctaccgaccgaacgggcccacgtccgttcccttcccccgtggcccgcccgtcgcctccgagacgcctaccctcgagtcnccacacggcgcccgtgggcctcgcgtggacgaacgactactcgagtccgtcgtacgcgtggagggtccggacgtcggcgtaacgggcgtagacgtggncg

SEQ ID NO: 222581 - DNA, 766 bp, Homo sapiens
  misc_feature: GYAE6OF01C1GTI.40.33.C11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (760)..(760): a, c, t, g, unknown or other
  misc_feature (760)..(760): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactcgtgggtccgccaagcctccgaggggaagggctggagtgggtcgcacgttatttaataaagntggatccanagcgtacgcgactcgngaggccatcacntcncaganacaacgccaagaacncagtgtctctgacaatggacagtctgagacgccggaggacgacgggtgtctagtttagtacgtaacaaaggtgggaactaaagtgaaatagtgggtgtaggtacgtcggtacgggggaccgaaacgggacccgtacgggtccgttccgacctttacgttacgtcgccccttaccgaaccgaacgggtcccctaaggttccccggtttccccgtttcccccccggtgggtacccccgtcccccgttcggtacccgttacccggagggtacccgtacccgtaccccgttcccggaaggtaccgacccgaaccgtacccgggacccgggtcccccggttagggggtcccttaccgggtacccgttacggggttaacccgtaaacggggttaccccttaacccgtttacccgaacgggtttcccgaaccgttaaccgggtaccggtagggaccgggtcccgggggtacgttacgggaccggtaaaccggggcctaaccggaattaggngtaccg

SEQ ID NO: 222582 - DNA, 915 bp, Homo sapiens
  misc_feature: GYAE6OF01EA92C.40.33.C11.1.454.CMB.1.raw
tcagtctagcgactcacgaccggtgctcgatttagagtgagctcgttgggtttgggggcccccagccctgggattcccagctgttttctgcttgctgatcaggactgcacacagagaactcaccagtggagcgttgggctggagtcgtttgggtttttccttgttgtactttaagttttaaaaggtgtccgtaggtgtggaggtgcgtaggttgggtgggacgggtccgggggaggtctttaggttcgacggtccgggttcgggggggtccctaggacgtaccttccttccgttggtcgccgacgtcccgttcggtacggtacgttcctaccgttcccttcccgttcccggtaccgttacggttcgggttaccgttccggttccggggtccccgaccgacggtccgtaccgggaaggggggtaacggggtcggtagggggacgggttcggggtccgtacgtaacggtttaatttaaagtaaaaggtggtacggtacctaccgaacgacggtaccggtaccggaccgggtaccgtaccgggtagggaaccgggtcccgtaacgtacccgaacccgtacgtacccgtaaccggaaacggaaaccgaacccgaaccgaacccgaaaagacccgtaacgttacggtttctaccgtacgtacggaaacctaaacgggtcggaactacgttaggaaggaacggaccgggacgggtaacgggtccggttaacggggtttactttaacgtttaaagttttaaggtaaccggtaaaacgggtaaacggggttcggttaaaacttaaagggtacgtaaaggttttcggggtgggttacggttacgggggtcccgttacggggacccgggggaaaccgtaaccgggtaccccgggttacgggttcccgttaccggtcctttaacgg

SEQ ID NO: 222583 - DNA, 922 bp, Homo sapiens
  misc_feature: GYAE6OF01C73Q5.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcgttgggtttttcctttgtttgtacttaaagtttttaaaaggtcgtccgtaggttggtgaggttgcgtaggtttgggtgggacgggtccgggggtagtctttaggtcgacggtccggtcgggggtccctggacgtacctccgttcgtggtcgccgtacgtcctcgtaggtacgtcctaccttcctccgtacccgtccgttacggttcgggttaccgttccggtcggggtcccaccgaacggtccggtacccgggaaggggggaacgggtcgtaggggtacggttcggggtaccgacgttaacggtttaattttaaaggtaaaggtagttacgggtaacctacccgaacggtacggtaccggttaccggaccgggttaacccgttaccgggtaacgggaaaccgggtccgtaacgtttacccaacccgttacgtacccggaactaaacggaacgaacccaaccggacaaaacgtaaccgacggttagttacgtccgtaatacggtaaacgtaaggtccggtacgtaacggtttcgaaggaaccggttaacggggaccggtaaacggtccggttaacggggttttactaagttttaaacgtttaacgggtaagtttaaaacccggaaagggggttcgttaaaactaaggttagtaaacggttttgggtacgggttacggggttaacggttacccggggttacccggggtaaccgggggttaaacccaacccgggggttttacccgtaccgggtttaacccgtcccgggtttaaacctttacggg

SEQ ID NO: 222584 - DNA, 845 bp, Homo sapiens
  misc_feature: GYAE6OF01B4QMQ.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcgttgggtttttccttgttgtacttaagtttttaaaaggtgtccagttgtgaggttgcgtaggttgggtgggaggtccgggggagtcgtttagttcgacggtccggtcggggggtccctgacgtactctccgtgtcgcacgcctcgtggacgtctactctcctccgtccgtacgtgggtactcggtcggtccgccgaacgccgtaccggagggggacggggtcgtagggtaggttcggggtaccgacgttacgtttaattttaaacgtaaaggtcgttaggacttacccgaacggacggttacccggtaccgggtaccgggtaccgttacccggagggtaaacccggggtcccttaacgttacccaacccttacgttacccgtaacccgaaacgggaccgaaacccggaacccgtaacccaaaaagggtaaccctaaccgttaagggttcccgtttaccttacggacgtaaaacgtaaacggttccggaacttaggggtttcccgtaagggacccggaccggacccgggtaaagggtcccggttaagggttacgtttactttaagtttaacggttaacggtaaaccggtaaagggtttccgggaaacttaaggttagtaagtttggtcggggttagtacgggtaccggttcgggacggggaacccgtaacggggtacccgacgggtttcccgtcgttcccttaag

SEQ ID NO: 222585 - DNA, 956 bp, Homo sapiens
  misc_feature: GYAE6OF01CMQ7V.40.33.C11.1.454.CMB.1.raw
tcagtctagcgactcacgaccggtgctcgatttagagtgagctcgttggggtttgggggccccagccctgggattcccagctgtttctgcttgctgatcaggactgcacacagagaactcacagtggagtcgttgggctggagtcgtttcgggtttttccttggttgtaccgtttaaagttttaaaaggtcgttaccgtaggttggtgggtaggtcgacggtaggttggggtagggtacgggtccgggggagttcgttaggttacgacggtccgggttcgggggtaccctagtacggtacctccgttccgtagtcgaccgtacgtccgttcgtacggtacgttacctaccgtcccttcccgtacccgtaccgttaaccgggttcgggttacccgttccggggtacccggtaccccggaccgtaaccggtaccggtacccggggaaaggggggtaccgggtcggtacggggtacgggttccgggtaccgtacgttaacggttaaatttaaacggtaaagtacggtacggtaacgtacccgaacggtaaccggtaccggtaaccgggtaaccgttaccgggtaccggtaacggggtaacccgggaccttaaccgttaccctaaccgtacccgttacgaacccggaacgggaacccgaaacccgtaaaccggaaccaaacggaaccgtaaacggtacggttaccggtaacttacgaacggtaacgtaacgtaacggaaccgttagtacggtaacggaaccggtacggtaaccgggaccgggttacggtacgggttagtttaaccgttaggttaaggtaacggttaaaggtaaaccggtaggttaaagttaacgagggttaaagttcgggttaagggtaggtaccgggtaaccggttcggggtaaccggggaaccgtacgggtaacccggtagggtcccggttaccgttcgtttacccgg

SEQ ID NO: 222586 - DNA, 716 bp, Homo sapiens
  misc_feature: GYAE6OF01AMVUN.40.33.C11.1.454.CMB.1.raw
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (559)..(559): a, c, t, g, unknown or other
  misc_feature (559)..(559): n is a, c, g, or t
tcagtctagcgactcacgaccggtgctcgatttagagtgagctcgttgggtttgggggccccagccctgggattcccagctgtttctgcttgctgatcaggactgcacacagagaactcaccatgggagcttgggctgagcttgggttttccttgttgtcttaattttaaaaggtgtccagtgtgaggtgctaggttggtggaggtccggggggaggtcttagttcaggccgtggggggtccctggagctctcctgtgcagcctctggntcactctcctccgctacgtcggtactcgtcgggtccnccgaagcgtccgagggggaggggctgggaggtcgggtcgtacagttattaagtaaagagtggactccgaacgcggacgtaccggcggaccgtccggtacggaacgggccgtacttccaaccgacttccaccgaacgaacgaaccaacgaccgaaagaccaacgtacgtcttaccgtactacggtaacaaggtccggaacttacggttcgtaaggacgggacggacccggaacggggtacgttaacgggggttnttaccttaagtttaaccggttagtaaacgtaaaggggttagggtacttaaaggtagtaaggtaggttcggggttaggtagggtacccgggttggtaacccggggggacggtaaacccgggtaccccggtagggttcccggtcccgttcggttacccg

SEQ ID NO: 222587 - DNA, 900 bp, Homo sapiens
  misc_feature: GYAE6OF01ANHQ5.40.33.C11.1.454.CMB.1.raw
  modified_base (483)..(483): a, c, t, g, unknown or other
  misc_feature (483)..(483): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcgttgggctgacgtcgttgggttttccttggttagtacttaagttttaaaggtcgtacctaggtggtagaggtgcgtaggttgggtacgggtaggtccgggggagttacgtttagtcgacggtcccgggttgggggtacccttggacgtaccttcgttccgtcggtagccgtacggtccctggtagggtacctctaccttccgtaccgtccggtacccgttacggttcgggttacctcgggttccggtaccgaccgtaacggtaccggtaaccggggaagggggaccgggtcgtaggggtacggttcgggtaccgtaacgttaacgtttaagttaacgtaaaacgtggtaaccgntacccgtaaggtccggtaaccggtaccgggtaacggttaccggtaacggacgggaaacccgggttcctaaaccgtacccgtaaacgtcgttaccccggtaaaccggtaaccgtaaacgaaccccgtaaacgaacccgttaaaccgaaacgttaccgtaacggttcgtaaccccggtacgtaacgggtaacctaaacgggttcgggtaaacctcgggttaaacgcgggtaaaccggtacccggtaaaccgggtacggtacggttaaccggtagtttaaccgttagtttaccgtaaacgggaactaaaggggtcgttaaactaaggtaggtaacgttacgggtggttaccgggtaccggtcggttaaccgggacggaaccggttacggtaccggttacccggtgttccccgagttaccg

SEQ ID NO: 222588 - DNA, 876 bp, Homo sapiens
  misc_feature: GYAE6OF01CZFKE.40.33.C11.1.454.CMB.1.raw
  modified_base (565)..(565): a, c, t, g, unknown or other
  misc_feature (565)..(565): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttaattttaaaaggtgtccagtgtgaggtgcagttgggtggaggtccgggggagcttagtcagccgtgggggtccctggacgacttcctcctgtcgcacgcctcgtggacgtcactcctctcccgcttacgtggtactcgtcgggtccaccgaacgccgtaccggaagggggaacggggtcgtgggacggtcggggtccgacgtaacggtttaagttttaaaagtaaaaggtaagttggaacgtacccgaacgtaacggccggttaaccgggaccgggtacccgtacccgggtaagggtaaacccggggacccgtaacgtttacccaccccgtaacttcccgtaacccgaaaggaaccgtaacccgaaaaccggaacccgaaacgtaaaccaaccggtaacgggttnttacccgttacgtaaccggtaactaacggtaacgggaaccgttacggtaccggttaaggaaccggaacggacccggggtaaacggaacccgggtttacggggttacgtttaaaccgtttaagtttaaaggtttaacggtaaaacgggtaaagggggttacgggggtaaaacttaaaacggtagggttaaaacgttgggttacgggtaggggtttacgggtaaaccgggtttaccggggtaccgggggaaaccggtaaacccgggggtaacccccgttacggggttaccggtccccgtcccggtttaaaccg

SEQ ID NO: 222589 - DNA, 731 bp, Homo sapiens
  misc_feature: GYAE6OF01BN90Q.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcgttggtttttccttgttgtcttaattttaaaggtcgtccagtgtgaggtgctaggttggtgggacggtccgggggaggtcgtttagttcgacggtccggttcggggggtccctggacgaccttctccgtgtcgcctacgcctgtggactcacttctcctccgtccttacgtggtacctcgtcgggtcccacacgctccggaggggaacgggcgtgggtaggtggggtccacgtacggttatttaacgtaaagtagtaggtactaccgtaacaggtccggtacggccgtaccgtcggtacggtaacgggccgtaacttccaacccgtactccttacccgaaaggtacgaaccaaaccggaacccgaaaacggtaaccaacgtacggttacgtacccttacgtaacggtaactaaacggttacggtaaccgtagttacggtggaacggtaccggaccggaacgggacgtaacgggtgttacctaagtttatagtaacgaaaggttggtaactagtagaagtttacgtggttggtacggtggtccgtaggggacccgtaagggacccgttacgggttccggtcgtcgttaccg

SEQ ID NO: 222590 - DNA, 755 bp, Homo sapiens
  misc_feature: GYAE6OF01A2P36.40.33.C11.1.454.CMB.1.raw
  modified_base (364)..(364): a, c, t, g, unknown or other
  misc_feature (364)..(364): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcgtggttttccttgttgctattttaaaaggtgtccagtgtgaggtgcagttggtggaggtccgggggaggtcttagttcaggccgtggggggtccctgacgactctcctgtgcagcctcgtggagtccactcctctccgcctacgtgggtacctcgtcggtccgccaagcctaccgagggggaacgggctggaggtcgggtcgtacgacgttatttaagtaaagngtggactccgacgtacgccggtacgaccggtaccgtccggtagaaacggggccctaattacccgacctaacttcccgacccgaagaaccgaacccgaaccgacccaaaaggaaccctacgaggtttcgtaccttacgtgaaccaaagttccgggaaacctggttacctggaacgggaacggcccgggtaacgggaacggtccggggtttagttacttaaggttttaactttacgggaaaaccgttaaaggggtacggggttaaacttaaacgtttagggaaaagtttcggtaaggggtttacggtacgggtacccggtttaccggggtagggggacccccgtaaagggggtccccctaacggggttccgttaccccggtcccttttaacgg

SEQ ID NO: 222591 - DNA, 888 bp, Homo sapiens
  misc_feature: GYAE6OF01CBU9J.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagaagaactcaccatggagtcgttggctgagtcgttgggttttccttgttgtacttaagttttaaaaggtcgtaccgtagtgtggtaggtcgcgtaggttgggtgggacgggtccgggggagtcgttagttcgacggtccggtcgggggtccctggacgtactccgtcgtgtcgcgtacgtccgtgtggacgtcaccgtcctccgtccgtcgtacggttcggtaccgtcggtcgggtcccgacgtacgccggtacgggagggggtaacggtcggtagggtacggtcgggtaccgtaacgttaacgttttaaagtttaaacgtaaagtaacggttacggtaaccgtaccgaacgggtaccggtaccggtaaccggacccgggttaaccggttacccggtaacgggaaccgggtaacccgttaacgttaccgaaacccttcgtaacccgtacccgaaaggaacccgtaaaccgaaacccgtaacccgaaaacgaaccgtacggtacgtaccgttacctacgtaacgtaaccgtaagtaccggtaacgtacgttacgtacggaacggaccgaaccgggaacgggtaccgttacggggtttctaacgtttaacgttaaggttaacggtaaacggtaaacgggtaagggtaaacttaacgtaaggttaaagttcggggttacgggttagggacgggttacccgggttacgggtaacccgggggaacccggttaaccggggtacccggttaaccggttaccccggttccgtcccgtttaaccgg

SEQ ID NO: 222592 - DNA, 693 bp, Homo sapiens
  misc_feature: GYAE6OF01BQIG2.40.33.C11.1.454.CMB.1.raw
  modified_base (301)..(301): a, c, t, g, unknown or other
  misc_feature (301)..(301): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagcttgggttttccttgttgctattttaaaaggtgtccagtgtgaggtgcagttggtgggaggtccgggggaggcttagttcagccgtggggggtccctgagactctcctgtgcagcctcgtggagtcactctcctccgcctacgtggtactcgtcgggtccnccaagcctccgaggggaacggggctagggaggtggggtcgacgtacgttaatttaagtaaagataggtactccgaacaggcgtacgcggactccggtaggaacgggtcctattaccaacctactctaccgaagacgaaccgaaccgaccaaaacgaaccaccgtaggttcgtcctacgtacgaacaaagtcggaactaggtctaggacggacggaccggaaggaccggtagggttgtacttaagtttagttaacgttaaacgaaaagggttacggggtaaacttaagtacggtaaattaggttcggggttagtacggggtacggttacgggtacgggggaacccgtaaacgggggtaccctaaccggggttcccgtccggtccctttaccgg

SEQ ID NO: 222593 - DNA, 893 bp, Homo sapiens
  misc_feature: GYAE6OF01DB5J9.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaacctcaccatggagcttgggctgagtcttgggttttccttgttgcttaagttttaaaggtgtccagtgtgaggtgctaggttgggtggaggtccgggggagtcgttagttcgaggtccggttcggggggtccctgacgtacctccgtccgtggtcgacacgtccttcgtgggtacgtcctaccttccgttccgtcccgtccgttaaccgttcggggttaaccttcggtccggggtccccgaccgtaacggtccgtaccgggaaggggggaacggggtccgtaggggtaggtcggggtccgacgttaacggtttaagttttaaagtaaaggtacgttcggaaacttcccgaacgtacggtaccggttaccggacccgggtaaccggttcccgggtagggaaacccggggtcccgtaacgtttcccaacccgtacgtccccgtaaccgtaagggaaccgaacccgaaaccgtaccgaaaacggaaccacgtacggttcgttacctacgtaggaaccctaaaggtaccgggtaactagtaccgtaggaaccgggaaccggtccgggtaaagggtacccggttacggggttactttaagttttaacggttaagtttaaacgggttaaacggtaaaggggttcgggtaaaaccttaggtaaagggttaattacgggttggggtaaccggttacgggggttcccggttaaccggggtcgggggtaaacccgtaaaccgggggttacccgtaaccggggttttccgcccggtttaccttaccggg

SEQ ID NO: 222594 - DNA, 929 bp, Homo sapiens
  misc_feature: GYAE6OF01DZ1ZY.40.33.C11.1.454.CMB.1.raw
  modified_base (215)..(215): a, c, t, g, unknown or other
  misc_feature (215)..(215): n is a, c, g, or t
tcagtctagcgactcacgaccggtgctcgatttagagtgagctcggtttgggtttgggggcccccagccctgggattcccagcttgttttctgcttgctgatcaggactgcacacagacgaacctcaccagtggagtcgttgggctggacgtcgtttgggttttttcctttgtttgtactttaaagtttttaaaagggtctcgtaggttgtaggngggtgacgtagggtttgggtacggggacgggtccggggggtagtcgtttacggttcgacggtccggtcggggggtaccctggactaccttctccgtgtcgaccacgtccgtcggtaggtctcctacctccgtacccgtcccgtaccgttccggttacgggttaccgttcggttccggggacccccgactaacggtccccggtacggggaagggggggtacggggtacgtgggggtaggttcggggtaaccgtacgttaaggtttaatttaaaggaaacgtgtacgtacctaccgagaccggtcgtaccgggcgtaccgtcggtaggaaccggtacttacctacaccgtactcctaacgaggaaccaccgtaaccgaacccaaacgaaccgtagtaccgttacgtacgtacgtaacacggtaacgggcgtacgtagtacggtacggtaacggaccggtaaccgggaggggtaaccgtttacggggtttactttaaccgtttaaggttttaaacgttaacggggttaaaacggtaacggggttaacggggttaaattaaaacggttaggggttaagttttaacggggttacggggtttagggtaaccgggggtttcccggggttaacccggggggtaccggggtaaacccggggtaacgggggttaacccccgggttggggtttacccccggtcccggttaccggttttaccccgg

SEQ ID NO: 222595 - DNA, 590 bp, Homo sapiens
  misc_feature: GYAE6OF01AKPUX.40.33.C11.1.454.CMB.1.raw
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtccctgagactctcctgtgcagcctctggagtcactcctctccgcctacgtgggtactcgtcggtccgccaagctccgaggggacgggctggngtgggtcgcgtacgttatttaanaaagagtggactccagagcgtacgcggactcggtagacgggcatcaccntctccgagacgacaaccgaccaaagaacacgngtntctcgtagacaaagtggacagtctagagacgcggagacgtacggtgtattattagttagtaacgaaaggtgggtaactagtacgtaagtaggtgggtagtacgggtcgtacgggtggggacccgtaacggggaccccgtacgggtcgtcccgtacgttaccg

SEQ ID NO: 222596 - DNA, 879 bp, Homo sapiens
  misc_feature: GYAE6OF01ANH5J.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttggggctgagtcgttgggttttccttgttgtcttaagtttttaaaaggtgtccagtggtggaggtgcgtaggttgggtgggagggtccggggggaggtcgttagttcgaggtccggtcggggggtcccgtgagtacttccttccgtggtgccgtacgtccttcgtggtacgtccaccttcctcctccgtaccctaccgttcgggttacctccggtcgggtcccgaccgaacggccgtaccgggaaggggggaacggggtcgtaggggacggttcggggtccgtacgtaacgtttaagtttaagtaaaaggtagtaggtaactaccgaacgacggtaccggtaaccggaccgggtaccgttccgggtagggaacgggtaccgtacgttacccgaacccgtatccgtaccgacggaacgaacccgaaccgtaacccgaaaacgaacccaacggttacggttactccgtactacggtaaccgtaaaggtcggtaacgtacggttacgtagggaacgggaccggtacccggggaaggtacccggtaaccgggggttattaacggttaattttaacgggttaacgttaaaaccgggtaaaggggttccgggtaaaatttaaggtaggttaaagtttaacggggtggggtttagggtaaaccggggtccggtttaccgggggtaacggggaaaccccgggtaaagggggtacccccggtacccgggggtttcctcccgggtttaccctttacggg

SEQ ID NO: 222597 - DNA, 763 bp, Homo sapiens
  misc_feature: GYAE6OF01BUC13.40.33.C11.1.454.CMB.1.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaggtgtccagtgtgaggtgcagttggtggnggtccgggggagcttagttcagccgtgggggtccctgagactctcctgtcgcacgcctgtggagtcactctctcccgcctacgtcgggtactcgtcgggtccnccgagcctccggaggggaggggcctgggtaggtgggtcgcgtacgttatttaagtaaagagtggactccgacgacggtccggtacgcggtaccgtccggtaggaaccgggtccgtagtttacccaacctacgttaccgtacccgaaaggaccgaaaccgaaccgacccgaaacggtaaccaacgtaaggtttccgtaccgttacgtacgtaacgtaaagttacgggaactaggttaccgtaggaacggacggtacccgggaagggaccgtacggggttacgttaccgtttaagtttaacgtttaggtaaacggtaaacgggtaggggttaaaaccttaaggtacgtaaagtttcgtaggggtttaggttacggggtaaccggtttacggggtaccgggggtaaaccccgtaaacggggggtacccggtacccggggttcccggttcccgtcccggttttaacccg

SEQ ID NO: 222598 - DNA, 999 bp, Homo sapiens
  misc_feature: GYAE6OF01BF8JZ.40.33.C11.1.454.CMB.1.raw
tcagtctagcgactcacgaccggtgctcgatttagagtgagctcgttgggtttggggccccagccctgggattcccagctgtttctgcttgctgatcgaggactgcacacagagaactcaccatggagccttgggctgagtcgttgggttttccttgttgtcttaagttttaaaaggtgtcctagtgtgaggtgcgtaggttgggtggacggtcgggggagtctttacgttcgaggtccggtcgggggttaccctggacgtaccttccgtccgtggtcgacctacggtcccgttcgtaggtacgttcctacctccttccgtcccggtccttacggttcgggtacttcggtcgggtacccgaccgaacgtccgtaccgggaagggggtaacggggtccgttggggtaacggttcggggtaccgtaacgttaaccggtttaaagttttaaagaaacgttacgtacggtaacctcccgaacggtacggtacccggtaaccgggtcccgggtaaccgttcccggtaacggggtaaccgggtacccgttacgtttaaccccggacctacggttaccccgtaaccggtaacggaaccgaaaaccccgtaacggaacccaaaacggtaaacctacggtagggtttacctaccgttacggtaacgaaccgtaaaacgggttccggaaaccgttcggttacgacggaacggaccggtaacccggggaacgtaccgggttaaccggtttacgtttaaaccgtttacgtttaaacggtttaacggtaaaacccgggttaaaaaggggttcccgggtaaaaactttaacggttaaacgggttaaaggttttacccgggtttaaacggggtttggggtttaaaaccccggggtacccgggtttttaaaccggggggaaaccccgggggtttaaccccggggaaaaacccgggggttaccctttcccgggggggttaaacccccttcccggggttttaacccccgttaacggg

SEQ ID NO: 222599 - DNA, 663 bp, Homo sapiens
  misc_feature: GYAE6OF01D5ED9.40.33.C11.1.454.CMB.1.raw
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttattttaaaaggtgtccagtgtgaggtgcagttggtggagtccgggggagcttagtcagccgtgggggtccctgagactctcctgtgcagcctcgtggtagtcactctcctccgtcctacgtgggttactcgtgggtcccncaacgcctccggaggggaacggggctaggggagtcggggtcnctacggttattttagaaagntaggactccagacgtcgtacgcggtactcggtaggaacggccattcacctntctacagacgacacgacaaagacatagtctctactgacaaagtcggaacacgttctaggaacgacggaccggaacgggaccgtacggggttacttaccgtttaagtttacgtttaacggtaaaccgtaaagggttcggggtaaacctaagttacggtaaagtttaggtacgggttaggtacgggtacggttacggtaccgggggaaccgtaacggggacccgtaacggtccggttaccgtccctttacgg

SEQ ID NO: 222600 - DNA, 863 bp, Homo sapiens
  misc_feature: GYAE6OF01B51AO.40.33.C11.1.454.CMB.1.raw
  modified_base (181)..(181): a, c, t, g, unknown or other
  misc_feature (181)..(181): n is a, c, g, or t
  modified_base (851)..(851): a, c, t, g, unknown or other
  misc_feature (851)..(851): n is a, c, g, or t
  modified_base (861)..(861): a, c, t, g, unknown or other
  misc_feature (861)..(861): n is a, c, g, or t
tcagtctagcgactcacgaccggtgctcgatttagagtgagctcgttgggtttgggaggcttagttcagccgtggggggtccctgagactctcctgtgcagcctctggagtcactctctccgcctactgggtactcgtgggtccgccaagctccgaggggaaggggctgggaggtgggtcnctacgttatttaataaagagtggatccaacgagtcggtacggcggacctccggtaggaacgggccattccacctatcctaccgagacgaaccgaaccgaccaaagaccacgagttctactctagacaaacgtaggactagtcttagaggacggaccggaggaaccggtacgggtgttactttaagttttacgtttaggtaaacggtaaaaagggtcggggtaaacttaaagtaaggtaagttaagttgggttgggttacgggacgggttcggtacgggggacgtaaacggggacccgtaaccggggttccggtcccggttacccgtttaccgtttacgttacccggtacccgttaacccccggaaaccccggtaaacccgggggtacccccgttaaccgggtttccccggggtttaccccccgttttaccccccccgtcgggggttccccccggttcccccggtcccggtccccgttacccgggaggacccgacccgtacccccgtacgggaaccgtacggacccgacccgggaacgggtccccgggccccggttacgggtcccgtcggtacccggttacgggtacgaaccgggttacctaccggttaccgacgtccggtacctaggccggtagacgggtccgggaggtacggacgggtacggaccgtanaacggtagcngg

SEQ ID NO: 222601 - DNA, 858 bp, Homo sapiens
  misc_feature: GYAE6OF01B7XGW.40.33.C11.1.454.CMB.1.raw
tcagtctagcgactcacgaccggtgctcgatttagagtgagctcgttgggtttggggcccccagccctggattcccagctgtttctgcttgctgatcgaggactgcacacgagaacgaactcaccagtggagtcgttggctgagtcgttggttttccttgttagtactttaaagttttaaaggtcgtaccgtagtggtggtaggtgtacgttaggttgggtacggtacggttccgggtaggggtacgttacgtttaacggttccgtacggtcccgggttcgggggttacctacggtaacgtccgttccgtccgtggtacgccgtccgtccgtcgttacgggactaccttccttccgttcccgtacccgttaccggttacggttccgggttaccgttcccggtacccggtacccgaccgtacggtacccggtaacgggacggggtacgggtcgtaggggacggtcggtaccgtacgttaagtttaagttaaacgtaagtacgacgtacctacgacgtcggtaccggttaccggcgtaccggtacggacggtacggtacctacgtacccaaccgttctacccgaacgtaacgaccgtaaacccgtaaaccgaacgaaaccgtaacgtacgttacggttccgttaacgtacgaaggtaaaccgtaggacccgtaagttacgagggaacggtaagacccgggtacgaagggttaacccgtggtttcttaagtaagtttacgtaaaccggggtaagtaaggggaacgttaagtataggttaacggtcggtggttaaacggtcgacggggttaccgggtacgggaaacccggttacccgaggttcccggttcgtacccttaccg

SEQ ID NO: 222602 - DNA, 807 bp, Homo sapiens
  misc_feature: GYAE6OF01BQEZB.40.33.C11.1.454.CMB.1.raw
  modified_base (584)..(584): a, c, t, g, unknown or other
  misc_feature (584)..(584): n is a, c, g, or t
  modified_base (603)..(603): a, c, t, g, unknown or other
  misc_feature (603)..(603): n is a, c, g, or t
tcagtctagcgactcacgaccggtgctcgatttagagtgagctcgttgggtttggggccccagccctgggattcccagctgtttctgcttgctgatcaggaatgcacacagagaactcaccatggagcttggctgagcgtggtttctgtagtctatttaaaggtgtccagtgtgaggtgcgaggttggtgggacggttccgggggagtcgttacgttcgacggtccgtgggggtccctagacgcttccgtccgtgtcgcgagtccgttgtacggtacgtcaccttcctccgtacccgtccttacggtacgggttacctcggttccgggaccgaccgaaacggtcccgtaaccgggaagggggtaacgggtcggtaacgggtagggttcggggtacgtacccgttaacgtttaacgtttaagtaaaacggtgttacggacctaccgacgtaaccggtacgttaccggaccggtaacccgttccgggaaggaccgggtacccttagtacccgaccgtacttaccgaacgaacggaacgtaacccgaaccggaccttaaaggacctagtacgttcgtactcggtaanacgtaagcgtaactcgagngaaacgccggaacgtacggaccgtagggtttactaccgtttaagtttaaccgtaaagggttaaaccgaacggggtttaacgtacggttaaactaggttaaagttgtccgggggtttaagtccgggggtaaaccgcgggttaaccggggaaccgtaacccggggttacccggtaaccgttccggtaaccgtttcccgtaaacggg

SEQ ID NO: 222603 - DNA, 857 bp, Homo sapiens
  misc_feature: GYAE6OF01D518P.40.33.C11.1.454.CMB.1.raw
  modified_base (395)..(395): a, c, t, g, unknown or other
  misc_feature (395)..(395): n is a, c, g, or t
tcagtctagcgactcacgaccggtgctcgatttagagtgagctcggttggggttcgggggcccccagccctgggacttcccagtcttgtttctgtcttgctgatcgaggtactgaccacacgaaggaacaacctaccgacgagtgggagtcgttcgggctaggtcggttcggttttcggttttttaccgttggtttattaacgttttaaaagttttaaaggtcgttaccggtaggtttggggtacggtacgggttcgtagggttaggggttttagggagggggttacccgggggtaccggggttagttaccgttttagggttccgggaccgggttcccgggggttacgggttccctaggaccgttccgttccgtacgtgtccgcgtacgtcgtgngtacctctacctctccgtacgtacgtcggtcgtcctacgggccgtacacgcggtaccggtacggggaagggccggtgggtcggtccggtcggtactacgtttaacgttaagttaaagacctaggtacaccggtacacgaccgggcgtaccggacgtaacccggtcggacgggtactccgtacgtccacgtaccgtcgaaccgaaataccggacccgaacgaaccgaaacgaccgtaacttcggtactacggtaacgtacggtaacgtacgtacggtacgtaagtcggaacggtacgacgggaccggtaacgtcgggttaagtcgttagtacgttagtaaacgtaacggtagggtaacgtaatacgttaggaacgttagggtcgttagggccggttaggtacccggggacccggtaacggggtacccgacgggttacccgtcccgttagtcccggttacccgg

SEQ ID NO: 222604 - DNA, 985 bp, Homo sapiens
  misc_feature: GYAE6OF01BYQGB.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcgttgggttttccttgttgtcttaagttttaaaaggtcgtccaggtgtgaggtgcgtaggttgggtgggacgggtccggggagtcgttagttcgaggtccggtcgggggtccctggtacgtactcgtccgtggtcgcgtacgtcctcgtaggacgtacctacttccgtcctacccggccttacggtcgggttaccttccggtcgggtcccgactaacggtccgtaccggaagggggacgggtcggtggacgggttcggggtaccgtacgtaacggtttaacgtttaaagtaaaggtagtacggtaccttacccgaacggtaccggtaccggtaaccgggtaccgggtacccgtaccggggttaacgggaacgggtaccccgttaacgttaccccgtaaacccgttcgtaaccccgtaaccggaaccgaaacggtaaccccggaaaccgaaacccgtaaaaaccggaaccgttaaccggtaccggggtttaacccttaccgttaaccggtaacggtaaacccttaaacggggtacggtaacccggttaggtttacccggtacggaaacggggtaccgggtaaaaccccgggtaggggtaaacccggttacgggggtttaacccttagggttttaacggttaaaacggttttaacggttaaaacccgggtaaagggggttacgggttaaaaccttaagggttaaaccgttaaagggttttcggttaacgggggttgggttaaaccgggtccggtttaaccgggggtaacccgggggaaccgggtaaacccggggttaaccccggttaccggtcccgggtttaaccccggtcgttttaaacccccggg

SEQ ID NO: 222605 - DNA, 971 bp, Homo sapiens
  misc_feature: GYAE6OF01AVKYN.40.33.C11.1.454.CMB.1.raw
  modified_base (675)..(675): a, c, t, g, unknown or other
  misc_feature (675)..(675): n is a, c, g, or t
tcagtctagcgactcacgaccggtgctcgatttagagtgagctcgttgggtttggggcccagccctgggattcccagctgtttctgcttgctgatcaggactgcacacagagaactcaccataggagcttgggctgagcttgggttttccttgttgcttaagtttaaaaggtgtacgagttgtggaggtgcgtaggttggtagggacgggtccgggggacggtcgtttaagttccgacggtccggtcggggggttacccttggaacggtaccttcttccgtggttacgaccgaacgtccgttcgtggtacgttaccgtaccgttccgttccgttcccgtacccgtttaagttccggggttaccttcggtccgggttacccgtacccgaaacggttccgtacccgggtaaggggggtaacggggtccgttacggggtacggtcgggttaccggtaccttaacgggttttaatttaaacggttaaaaggcgttacgggaacttaccggaacggtacggtaaccggtacggtccgggtaacccgttcccggggaaggtaaccgggtaccttaacgtacccgtaaccgtacgttaccgtaccggaacgtaacgaaccggaaacccggttaccaaaggtaacccaagttacgttacgttccgacgtacgacgtaaacggnggaaccgtagtttacgacgggaaggtaacgggcccggtaaagggaccgtttaccggggttagtttaaccggttaaacgttttcggttaaacgggtaaacgttaaaaacggggtcggggttaaactttaaacggaggtttaaaacccgggttagggtttaacgggggtcccggttaacggggttaacccggggtttcccggggtaaacccggggggaccccggttaaaaaccgggggtaccccttaaacccgggggttttccgttaaaccccccgggtaacgtttttaaaccccggg

SEQ ID NO: 222606 - DNA, 793 bp, Homo sapiens
  misc_feature: GYAE6OF01CBWOE.40.33.C11.1.454.CMB.1.raw
tcagtctagcgactcacgaccggtgctcgatttagagtgagctcgttgggtttggggccccagccctgggattcccagctgtttctgcttgctgatcaggactgcacacaagagaacctcaccagtggagcgttgggctgagtcgttgggttttccttgttgtacttaagttttaaaaggtgtccagttgtgaggtgcgtaggttggtgggacggtccggggagtcttagtcgaggccggtcgggggtcctgacgctctccgtgtcgcacgtcctcgtggactcacttcctacctcccgtacctacgtcgggttacctcggtcgggtccgacgtaacggccgtaccgggaagggggtaacggggcgtaggggtcggttcggggtccgtaccgttaagttaagttttaaagaaaagtcgttaggaacctccgaacgacggccggtaacggcgaccgtcgtagggaaccggcctacgtccaactacttccacgaacgaacgaaccgaaccgaaccaaagtaaccacgtaagttcgtacctacgaagtaacaacggtcggaactggtacgtgggaaccgtacgggaccggaacggaccggttaacgggttaccgttaagttttaacgttaacggttaaagggttaaaaccgtaaagggtacggggttaaaacttaaggtaggttaaactggggttaaacggggttgggtaacggttaaccgggttccggggaaacgggaaccccggtaaagggtacccgttacccggggtcccttaaccggttcccctttaaccgg

SEQ ID NO: 222607 - DNA, 1197 bp, Homo sapiens
  misc_feature: GYAE6OF01EXCBA.40.33.C11.1.454.CMB.1.raw
  modified_base (215)..(215): a, c, t, g, unknown or other
  misc_feature (215)..(215): n is a, c, g, or t
  modified_base (384)..(384): a, c, t, g, unknown or other
  misc_feature (384)..(384): n is a, c, g, or t
tcagtctagcgactcacgaccggtgctcgatttagagtgagctcgttgggtttgggggcccccagccctgggattccccagctgtttctgcttgcctgatcaggactcgcacacagacgaacctcacccagtcggtagcgtttgggctggacgtcgttgggtttttccttgtttgaccttaagttttaaaacggttcgtccaagtgtggtaggtnctaggttggtcggaggtccggggtagtctttagttcacgtccgtgggggtccctgacgtctcgtctgtcgcacgcctcgtcgtacgtcctactcttcccgtccgaccttacgtcgggtaccttcgcggtacccgtaccacgtcgtaacccgggtacggggtacgggtcngggtacggttcggggtacggtaccgttaccgttaacgtttaagtttaacggtaagttacggtacgtaccgtaccgtaacggtacggtaccggtaccggtaccgtacccgggtaccggtaacgggtaccggtaaccgtttaaccgtaacccgtacctacccgttacccgtaaccggtaacccggaacccgaaaacccgggtaacccggtaaaacccggtaaaacccgtaaacccggttaacccggtttaaccggtttacccggttaccccgaacgtttaaccgggtttaacccggtaaaaccggtctttaaacccggggtttaaccccgggtaaaaccggggtttaaacccggggtttaccccgggggttaaaccggggggtaaaacccggggttaaaccccccggggggttaaaccccgggggtttaaaacccgggggtttaaaccccggggggtttttaaacccggggtttttaaccccggggtttttaaaaccccgggttttttaaaaaaccggggtttttaaaacccgggggttttaaaaacccggggttttaaaaaaaacccgggttttaaaaaacccgggggggtttaaaaaccccgggggttaaaaaacccggtttttaaaacgggggttttaaaaccgggggttttaaaaaccggggtttttaaacccggggggtttttaacccggggggttttaacccgggggggttaaacccggggggtttaaacccccggggggttttaaaccccgggggggttaaacccccgggggggttttaaaacccccgggggggtttaaaaacccccc

SEQ ID NO: 222608 - DNA, 852 bp, Homo sapiens
  misc_feature: GYAE6OF01B6P3Z.40.33.C11.1.454.CMB.1.raw
  modified_base (554)..(554): a, c, t, g, unknown or other
  misc_feature (554)..(554): n is a, c, g, or t
tcagtctagcgactcacgaccggtgctcgatttagagtgagctcgttgggtttggggccccagccctgggattcccagcttgtttctgcttgctgatcaggactgcacacagagaactcaccagtggagcgttggctgagtcgttgggttttccttgttgtcgtttaaagttttaaaggtcttaccagttgtagaggtgcgtaggttgggtggacggttccggggacgtcgtttacgtcgacggtccggtcgggggttccctaggagtccttcgtccgtgtcgcgagtcctgtcggtgtcctacgtcctccgtacccgtaccgtacgttccgggttactccggttccgggtccctaccgacgtaccgtaccgggacggggtaaggggtcgtagggacggttacgggtaccggtacgtaagtttaactttaaaggtaaacgtaggtaggtaacctacccgaagacggttcgtaccggacggtaccgtcgggtaggaccggacttactcccgtaccgtcgtcaaccgtaaggaactaaccgaacgtaccaaaacgntaaccggttagttctccgtaacgtacgaacgacgtaacggtacctagtacccgtaggaacgtaccgggggaacctacgggtaaccggtttacgggtgtttaaacccgttttaagggtttacgtaaaacgggttaacggttaaaacgggttcggttaaaacgttaacgttagggtaaacggtttttagggtccgggtagggtttaacccggggtaaccggtcccggggttaaaggggaacccccggtaaccgggggtacccccgttagggttaccggtccccgtttgtttaaaccccgg

SEQ ID NO: 222609 - DNA, 903 bp, Homo sapiens
  misc_feature: GYAE6OF01CO5LJ.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaacctcaccagtggagcttgggctgagtcttgggtttttccttgttgtacttaagtttttaaaaggtgtccaggttgtggaggtgacgtaggttgggtgggagggtccgggggtagtctttagttcgacggtccggttggggggtccctaggacgtaccttccttccgtggtcgctacgcccgtgtggtcgtctaccgttcctccgtcccgtccttacgttcgggttaccttccggtccgggtaccccaccgtaacggccgtacgggaagggggtaacgggcgtaggggacggtcgggtaccgacgtaacgttaatttaaagaaagtagtcggacttaccgacgtacggtaccggtacggaccggtaccgtaccggtaggaaccggtcctaacgttcccgaccctaacgttcccgtaccgaacggaaacgaacccgaacccggaaacccgaaaacgtaaacccagtaacggttccgttaccgttagaaccgaaccgtaaagtacgggtacctagttacgaacggaacggaaccgggtaccgggaacgggtaaacccgggtaggggtttaccttaaacgttttacggtttaaaacgttaacgggtaaaaccgttaaaaggggtaccggggttaaaaacttaaacttaagggtaaaacgttttcggggtaaggggtttccgggtaacggggttacccggttaaccgggggtaacccggggtaaacccggaaacccgggggtttaaccccgtaacccggggttttccccggtaccgttaccccggtttaacg

SEQ ID NO: 222610 - DNA, 853 bp, Homo sapiens
  misc_feature: GYAE6OF01BLJZZ.40.33.C11.1.454.CMB.1.raw
  modified_base (334)..(334): a, c, t, g, unknown or other
  misc_feature (334)..(334): n is a, c, g, or t
  modified_base (758)..(758): a, c, t, g, unknown or other
  misc_feature (758)..(758): n is a, c, g, or t
tcagtctagcgactcacgaccggtgctcgatttagagtgagctcgttgggtttggggccccagcccgtgggattcccagcttgtttctgcttgctgatcaggactgcacacagacgactcaccgagtggagtcgttcgggctgagtcgttggttttccttgtagtacttaagttttaaaggtcgtccgtagtggtacgaggtcgtacggtggtttgggtagggtacgggttccgggggtaacgttcgtttacgtccgtacggtccgggttcggggtacctggacgtactccgttccggtgtacgacctacgtcccgtaggtcggtacttacccncgtttccgtcccgttaccgtacccgttacggtccggttacgttccggtcggtaccccgaccgtacggtccggtacccgggaggggtaacggcggttacggtacggtcgggtctaacggttagttttaaacttaagtaaagccggttacgtaccgtaccgtaacggcgtaacccggttaccggacggtaacccgttaccgggtaacgggaacgggtacccctttaagtaccccctaaccggtacctaaccggtaaccggaaacggtaaccgtaaacccgaaacccgtaacggaaaccgtactaaacgggttaccgtcgttaaaccttacggaacgtaacgtagggaccaaccgtttgacgtcggaacgacggcgaacgggtacgtggttctacgttaagtacgttaacgaagttacgaacgggtntacgtaggtaagttccgggttataccgggacgttacggtacggggcccggttaaaacggcccgggtttaccggcgtcccggggtctttcgaaccg

SEQ ID NO: 222611 - DNA, 549 bp, Homo sapiens
  misc_feature: GYAE6OF02IJOT5.40.33.C11.1.454.CMB.1.raw
  modified_base (288)..(288): a, c, t, g, unknown or other
  misc_feature (288)..(288): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
  modified_base (460)..(460): a, c, t, g, unknown or other
  misc_feature (460)..(460): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaggtgtccagtgtgaggtgcagttggtggagtccggggaggcttagttcagcctgggggtcctgagactctcctgtgcagcctctggagtcactctctccgcctactgggtactctgggtccnccaagctccgaggggaaggggctgggaggtggggtcgcacgttatttaataaagntggatccanagcgtacgcggactccgtgaagggccgattcaccatcnccaganacaacgccaagaacacagtgtcnctgacaaagtgaacagtctagagagccgaggacacggggtntctaattatgtaacaaaggtgggactaagtgaatagtggtagtggtacgtcgtaggggaccaaggggcccagggtcgtccggccttacg

SEQ ID NO: 222612 - DNA, 573 bp, Homo sapiens
  misc_feature: GYAE6OF02GYDWU.40.33.C11.1.454.CMB.1.raw
  modified_base (142)..(142): a, c, t, g, unknown or other
  misc_feature (142)..(142): n is a, c, g, or t
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (166)..(167): a, c, t, g, unknown or other
  misc_feature (166)..(167): n is a, c, g, or t
  modified_base (169)..(169): a, c, t, g, unknown or other
  misc_feature (169)..(169): n is a, c, g, or t
  modified_base (171)..(173): a, c, t, g, unknown or other
  misc_feature (171)..(173): n is a, c, g, or t
  modified_base (323)..(323): a, c, t, g, unknown or other
  misc_feature (323)..(323): n is a, c, g, or t
tcagtctagcgactcacgaccggtgctcgatttagagtgagctcgttgggtttggggccccagccctgggattcccagctgtttctgcttgctgatcaggactgcacacagagaactcaccatggagcttgggctgagcggngttcgtntaggcgnttaagtagcnntngnnngtgtgagtcgggagctagtcagcctgggggtcctgagactctcctgtgcagcctctggagtcactctctccgcctactggtactctgggtccgccaagctccagggaaggggctggagtgggtcgcacgtatttataaagatggatccanagcgtacgcgactcgtaggacggcatcactatctcagacgacaacgaccaaagaacactagtctctcgtagacaaagtggaactgtacagagacgccggtaaggaccgtacgggttgttacttaagtttagttagtaaacgtaaaaggtcgggtaacttaagtagtaagttaggtgggttacggtacgggtacgttcgggtacggggacccggaacgggtacccgtacgggttccgtaccgtaccgttcg

SEQ ID NO: 222613 - DNA, 611 bp, Homo sapiens
  misc_feature: GYAE6OF02F9QQQ.40.33.C11.1.454.CMB.1.raw
  modified_base (491)..(491): a, c, t, g, unknown or other
  misc_feature (491)..(491): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaggtgtccagtgtgaggtgcagttggtggagtccgggggaggcttagttcagccgtgggggtccctgagactctcctgtgcagcctctggagtcactctctccgcctactggtactcgtgggtcccgccaagcctccgaggggaaggggctgggaggtgggtcgcgtacgtatttaataaagatggactccacagcgtacgcggactccgtagaaggcgatcacctatcctacagacgacaaccgaccaaagaacactaggtcgtctctagacaaagtcgggaactagttcgtagacgacggacccggagggaaccgacggggttntaccgttaagtttagttaaggtaaaactaaaaggggttcggggaaacttaagtagtaagttagtgggtgtacgggtacgtcggtaggggaccaaggggcccagggtccgtaccgccttcg

SEQ ID NO: 222614 - DNA, 529 bp, Homo sapiens
  misc_feature: GYAE6OF02I0QJZ.40.33.C11.1.454.CMB.1.raw
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagccgtgggggtccctgagactctcctgtgcagcctctggagtcactctctccgcctactgggtactctgggtccgccaagctccgaggggaggggctgggagtgggtcgcacgtattataaagntggatccanagcgtacgcggactccgtgaagggcatcacatcncaganacacgccaagaacacagtgtctctgacaaagtggacagtctagagagccgaggacacgggtntactattntagtaacaaaggtgggaactagtgaatagtggtagtggacgtgtgggacagggaccaggtcgtcgctacg

SEQ ID NO: 222615 - DNA, 685 bp, Homo sapiens
  misc_feature: GYAE6OF02H3VE7.40.33.C11.1.454.CMB.1.raw
  modified_base (296)..(296): a, c, t, g, unknown or other
  misc_feature (296)..(296): n is a, c, g, or t
  modified_base (338)..(338): a, c, t, g, unknown or other
  misc_feature (338)..(338): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (634)..(634): a, c, t, g, unknown or other
  misc_feature (634)..(634): n is a, c, g, or t
tcagtctagcgactcacgaccggtgctcgatttagagtgagctcgttggggtttggggccccagccctgggattcccagctgtttctgcttgctggatcaggactgcacacgagagaactcaccatggagcttgggctgagcgtggtttcgtgtaggctactttaaagtagtcagtcgtgagtgctgttgtggagtccgggagcttagttcagcctgggggtcctgagacctctcctgtgccgagtccttcgtaggatactactctctccgccttagtgggttactctgggtaccnccaaagtcctacgaacggggacggtacttgggagtcgggtcncacgttatttaacaaaagtctagggataccgacgacgacgttacgcgtacgtcgtaggaaacgggcgtattcgacgtatcgttactaggtacacaacggacccaaagaaccacgaggtntccttacnggaactaaaagttggaactacgttacttagaacgtaacgcccgggtaaaggaaaccgtacggggtttattaccgtttaagtttaaactttcggtaaacccgtaaaaaggttccggggtaaaccttttaaggaggaaacgtttgaagggttggtacggtacggtttacgnggggggaacccaaggggtacccgtaacggggtcgttcccggcctttaacgg

SEQ ID NO: 222616 - DNA, 562 bp, Homo sapiens
  misc_feature: GYAE6OF02F7CEA.40.33.C11.1.454.CMB.1.raw
  modified_base (458)..(458): a, c, t, g, unknown or other
  misc_feature (458)..(458): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctgggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgaccaaagaacacagtgtctctgacaaagtggacagtctgagagccgaggacacggggttntacttattagttagtaaacaaaaggttggggaacttaagtagaatagtgggtagtcgggacgttcgtaggggaccaaggggacccacgggtccgtcgccttacg

SEQ ID NO: 222617 - DNA, 575 bp, Homo sapiens
  misc_feature: GYAE6OF02IXEHU.40.33.C11.1.454.CMB.1.raw
  modified_base (339)..(339): a, c, t, g, unknown or other
  misc_feature (339)..(339): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
tcagtctagcgactcacgaccggtgctcgatttagagtgagctcgttgggtttgggggccccagccctgggattccccagctgtttctgcttgctgatcaggactgcacacagagaactcaccatggagcttgggctgagctgggtttccttgttgctattttaaaggtgtccagtgtgaggtgcagttggtggagtccgggggaggcttagttcagccgtgggggtccctgagactctcctgtgcagcctctggagtcactctctccgcctacgtggtactcgtcggtccgccaagctccgaggggaggggctgggaggtgggtcgcacgtatttaanaaagatggatccacagcgtacgcggactccgtaggaggccattacacactcctacagagacaacgaccaaagaccacngtgctacngacaagtgacagtcngagcgccgaggaccgagggtntacgtattagttgtaaacgaaaggttgggaactaagtacggaattagtgggtagtgggtaaccgttcggtacggggaccaaggggtacccgtacgggtccgtaccgcccttacg

SEQ ID NO: 222618 - DNA, 546 bp, Homo sapiens
  misc_feature: GYAE6OF02GW9J7.40.33.C11.1.454.CMB.1.raw
  modified_base (453)..(453): a, c, t, g, unknown or other
  misc_feature (453)..(453): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctgggggtccctgagactctcctgtgcagcctctggagtcactctctccgcctactgggtactctgggtccgccaagctccagggaagggctggagtgggtcgcacgtatttataaagatggatccacagcgtacgcggactccgtgaaggccgattcaccatctcagagacaacgccaaagaacacagtgtctcgtgacaaatggacagtctgagagccgaggacgacgggtntactattattagtaacaaaggtgggactaagtgaatagtaggtgtaggacgtacgtggggaccgaagggacccgacgggtcgtcggccttacg

SEQ ID NO: 222619 - DNA, 658 bp, Homo sapiens
  misc_feature: GYAE6OF02HX37T.40.33.C11.1.454.CMB.1.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagccgtgggggtcctgagactctcctgtcgcagcctctggagtcactctctccgcctacgtgggtactcgtcgggtccgccaagctccgaggggaagggctgggagtgggtcgcacgttatttaanaaagntggatccacagcgtacgcgactccgtagaacgggccgattcaccatcctccagacaaccaacgacccaaagaaccacgagtgtcttctgacaaaagttggaacaggtctaggaacgacgacccggaaggaccgtacggggtcgttaccttaagttaacgttttagtaaacgaaaaagggttcgggggtaaaccttaagttaggaaactttaggtaaggggtttcggtaagggtaccggttacggttacggggggaaccctaaacgggggaacccctaaccgggggtttcccggttccgtacccgtttacgg

SEQ ID NO: 222620 - DNA, 568 bp, Homo sapiens
  misc_feature: GYAE6OF02I2KSF.40.33.C11.1.454.CMB.1.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagccgtgggggtccctgagactctcctgtgcacgcctctggagtcactctctccgcctactgggtactcgtcggtccncaagctccgaggggaggggctggagtgggtcgcacgttattagtaaagatggatccanagcgtacgcgactcgtagaggccatcacntctacagacgacacgaccaaagaacacgagtctcnctagacaaagtggacagttcngacgacgcgaaggacacggggtatacgttaagtttagttacgtaaagaaaggttgggaactaagtagaataggtgggtgtacgggacgtggtacggggacgtaacgggcctacgggtctaccgtccttacg

SEQ ID NO: 222621 - DNA, 552 bp, Homo sapiens
  misc_feature: GYAE6OF02JFJ18.40.33.C11.1.454.CMB.1.raw
  modified_base (465)..(465): a, c, t, g, unknown or other
  misc_feature (465)..(465): n is a, c, g, or t
  modified_base (521)..(521): a, c, t, g, unknown or other
  misc_feature (521)..(521): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctgggggtccctgagactctcctgtgcagcctctggagtcactctctccgcctactgggtactctgggtccgccaagctccaggggaagggctgggagtggggtcgcacggtatttataaagatggatccacagcgtacgcggactccgtgaacgggccgattcaccatcctaccagagaccaacgccaaagaacacagtgtctctgacaaagtggaacagtctgacgagccgaggacgacgggtntctattagttagtaacaaaaggtgggaactaagtgaatagtggtgtggtacgtcgngggaccaagggccgacggtcgtcgtcttacg

SEQ ID NO: 222622 - DNA, 1020 bp, Homo sapiens
  misc_feature: GYAE6OF02H6E9I.40.33.C11.1.454.CMB.1.raw
  modified_base (187)..(187): a, c, t, g, unknown or other
  misc_feature (187)..(187): n is a, c, g, or t
tcagtctagcgactcacgaccggtgctcgattttagagtgagctcgttaggggtttagggggggcccaggccctcgggattcccagctagtttccgtggctttcgcttggatcaggactgcacaacagagaacgtcaccatggagctttgggctgagcttgggttttcctgttgctattttaaaggngtcagtgtgagtgcagttggtggaggtccggggagtcgttagggttcgaggtccgttcgggggtacctcggtaggaccgttcctccgtacggtcgtcctacgtcccgttcgtacgggacggttcctacctttccggttacctttccccgtaccctttaccggttacgggggtttaccttccggttacggggtttccccggaccctaaaggtcccgttacccggaacgggggggtaacgggggtcccgtttacgggggaagggttccggggttacccggacggtaaccgggttttaaaggtttttaaacgtaaaacgggaggttttacggggaacttacccggtaaacgttaaggttaccggttaaacccgggtacgggttaaccgtttacccggggtaagggttaaaaccgggggtacccgttaaacgtttaccccgtaacgtaaaccgtttccgttacccggaaacggtaacggtaaccccgtaaaccgggaccgaaaaacgggtaaacccttactaaccgggtttacgttaccttaccggaaggtaaacccaaaaagttccggaacctaaagttaccgtacgggaacgttacggacccggtaaacgggtaacggtaaccggggttttactaaccgttaacgttttaagttaaccgggaaacggtaaaagggttccgggggaaacttaaggtacgggaaccgtttttaaggtcgggggttttaacgtacgggtttaaccgggttaccgggtacggggggtaaaccccttaaaaccgggggttcccgttaccggggggtttaaccgtcccccgggtaaccgtttttacccggg

SEQ ID NO: 222623 - DNA, 605 bp, Homo sapiens
  misc_feature: GYAE6OF02HHWDQ.40.33.C11.1.454.CMB.1.raw
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtcctgagactctcctgtgcagcctctggagtcactctctccgcctacgtgggtactctgggtccnccaagctccgagggagggctggagtgggtcgcacgtattanaaagatggatccanagcgtacgcggactccggtgaacgggccattcaaccgatctccagacgacaaccgcaaagaaccacgagtcgtctcgtagacaaagtaggacagtctgagacggccgaggacgagggtgtacttatttaagttagtaaacgtaaaaggtaggggtaacttaagtagtaaagtacggttagggttaggtacggtaccggtacggtagggggacccgtaaacggggaccgtaccgggttccggtaccgtccgttaccg

SEQ ID NO: 222624 - DNA, 541 bp, Homo sapiens
  misc_feature: GYAE6OF02FWBSQ.40.33.C11.1.454.CMB.1.raw
  modified_base (452)..(452): a, c, t, g, unknown or other
  misc_feature (452)..(452): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctgggggtccctgagactctcctgtgcagcctctggagtcactctctccgcctactgggtactctgggtccgccaagctccagggaagggctggagtgggtcgcacgtattataaagatggatccacagcgtacgcggactccgtgaacgggcgattcaccatctccagagacaacgccaagaacacagtgtctctgacaaagtggacagtctgagagccgaggacacgggtntactattattgtaacaaaggtgggaactaagtgaatagtggtagtagggacgtcgtaggggaccaagggaccgacggtcgtcgcctacg

SEQ ID NO: 222625 - DNA, 544 bp, Homo sapiens
  misc_feature: GYAE6OF02FXQ3E.40.33.C11.1.454.CMB.1.raw
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctgggagtgggtcgcacgtatttataaagatggatccacagcgtacgcggactccgtagaaggccattcacatctccagagacaacgaccaagaacacagtgtctctnacaaagtggacagtctgagngccgaggacgacgggtgtcttattattagtaacaaaggtggggaacttaagtgaatagtggtgtggacgttcgtggggaccagggaccacgggtcgtcgcttacg

SEQ ID NO: 222626 - DNA, 584 bp, Homo sapiens
  misc_feature: GYAE6OF02HRHAF.40.33.C11.1.454.CMB.1.raw
  modified_base (416)..(416): a, c, t, g, unknown or other
  misc_feature (416)..(416): n is a, c, g, or t
  modified_base (582)..(582): a, c, t, g, unknown or other
  misc_feature (582)..(582): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtcagttattgtacaaaagtggggactaaatgaatataggtgtggacgtctggggccaagggaccaggtcgtcgctctatgcctcacaacggccatcgtcttccccctggccncctgctccgagacgacaccctccgagacgcacacggccgacccgtcggggacctggcccgtgggtaccaaacgggacctaacgttcccgacgttaccgacttacggaaccttggaacggccgggtacccgttgggaccgtaacggggccgaccgtaagttacggancg

SEQ ID NO: 222627 - DNA, 593 bp, Homo sapiens
  misc_feature: GYAE6OF02I011O.40.33.C11.1.454.CMB.1.raw
  modified_base (590)..(590): a, c, t, g, unknown or other
  misc_feature (590)..(590): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaagggctggagtgggtcgcacgtatttataaagatggatccacagcgtacgcggactccgtgaagggccgattcaccatctccagagacaacgccaaagaacacagtgtctctgcaaatggacagtctgagagccgaggacacgggtgtctattatgtacaaaagtgggaactaatgaatatggtgtggacgtcgtggggccaaggggaccacgggtcgtcgccttcttacgtcgcctccaaccaacgggcccacgtccggtccttcccccgtcgggccgcccgtcgcctcccacggacgccaccgtccgacgacgcacgacgccggcccgtagggccgtcgccgtcggtcgaacgggtacctaccgttccgacgtccgactacggtacgttcggaacggcgggtcctgggacgtaacgggaccgacacgtagntcg

SEQ ID NO: 222628 - DNA, 792 bp, Homo sapiens
  misc_feature: GYAE6OF02IQT60.40.33.C11.1.454.CMB.1.raw
  modified_base (625)..(625): a, c, t, g, unknown or other
  misc_feature (625)..(625): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcgtgggttttccttgttgcttagtttaaaggtgtccagtgtgaggtgctagttggtgggacggtccgggggaggtcgtttagttcgaggtccggtcggggggtccctaggagtacttccgtcctggtgcgacgtcctcgtggtacgtcactctctccgctacgtcggtacctcgtcgggtcccgaccgaacgtccgtaccggagggggaacggggtcgtaggggacggttcggggtccgacgtaacggttaagtttaaagaaaggtagtacggtaactaccgacgtacggtacgtaccgggacggtaaccgtccggtaagggaaacgggtcccgtaagttacccgaacccgtacgtaccgtaccgaacggacgaaacccaaacggtacccgaaaacgaacgacgtaggtccgttcctacgtacgaacgtaaaggttccggaaactacgtcgtaggaacgggcacccggaaggtaccggtagggttnttaacgtttagtttaacgttacgtaaaaccgggtaaaagggttcgggtaaactttaagtagtaaagtttacggtcggggttagtaccggggttaacgtcggggttaacggggaccctaaacgggggtacccgttacgggttacccgtttaccggtacccgtttaacg

SEQ ID NO: 222629 - DNA, 595 bp, Homo sapiens
  misc_feature: GYAE6OF02FUUZJ.40.33.C11.1.454.CMB.1.raw
  modified_base (504)..(504): a, c, t, g, unknown or other
  misc_feature (504)..(504): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtccctgagactctcctgtgcagcctcgtggagtcactctcctccgcctacgtcgggtactcgtcgggtccgccaacgcctccgaggggaaggggcgtgggaggtgggtccgcgtacgttatttaagtaaagagtggactccacagcgtacgcggactccggtaggaacgggcgacttccaccactcctccagacgacaaccggaccaaagaacacgagtcgtacctcgtagacaaatgggaacagttcagacgacggaccgaaggacgcggggttntacgttattagttagaaacaaaggttcgggaacttaagagaatagtggtgtaggacgttggagggaccaagggtcccagggtctcgctacg

SEQ ID NO: 222630 - DNA, 705 bp, Homo sapiens
  misc_feature: GYAE6OF02G58XU.40.33.C11.1.454.CMB.1.raw
  modified_base (577)..(577): a, c, t, g, unknown or other
  misc_feature (577)..(577): n is a, c, g, or t
tcagtctagcgactcacgaccggtgctcgatttagagtgagctcgttggggtttgggggcccccagccccgtgggattcccagctgtttctgcttgctgatcacggactgcacacacgacgaactcaccatggagcttgggctgagcgtgggttttccttgttgcttaattttaaaaggtgtccagtgtgaggtgcagttggtggaggtccgggggagcttagttcagccgtgggggtccctgagacctctcctgtaccagccctctggagtctactccttcctcccgcctacgtcgggttacctcgtcgggtcccgaccaagcctacccgaggggaaggggcgtgggaggtcgggtcgcgtaacgttaatttaagtaaaagagtaggactacccgaacgtacggaccggtaccggccgggtaccgtccgggtaggaaaccggggtcccgtaacttacccgaccgtacttccctaccgaggacgaaccgaaaccgcccaaaacggaacaacgtacgtgtacctctagaacctaaagtcggaactagtcaggagtacgccggaaggccgtaggggttntacttaagttacgttagaaacgtaaagggtcggtaaactaagtacgtagttaggtgggtggtacgggtacggtggtacgggggaaccaacggggtcccgtagggttccgaccgttaccgttctaacgg

SEQ ID NO: 222631 - DNA, 580 bp, Homo sapiens
  misc_feature: GYAE6OF02FZQLT.40.33.C11.1.454.CMB.1.raw
  modified_base (376)..(376): a, c, t, g, unknown or other
  misc_feature (376)..(376): n is a, c, g, or t
  modified_base (448)..(448): a, c, t, g, unknown or other
  misc_feature (448)..(448): n is a, c, g, or t
  modified_base (579)..(579): a, c, t, g, unknown or other
  misc_feature (579)..(579): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaaggtgggactaatgaatatggtgtggacgtcgtggggcaagggaccacgggtcgcncctctatgcctccaccgaagggcccaagtccggtccttcccccgtggcccgtccctcgcctcccgagggacncctaccgtcccgaagcgccacgacggcccggcccgtgggccttcgcccggtggtaccaaacgggaccttaccgtccgacgtcgacgtaggtactgggaacggccgggctgggacgaacgggccgcagtagnc

SEQ ID NO: 222632 - DNA, 612 bp, Homo sapiens
  misc_feature: GYAE6OF02IDC3X.40.33.C11.1.454.CMB.1.raw
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctgggggtcctgagactctcctgtgcagcctctggagtcactcctctccgcctacgtgggtactctcggggtccgccaagctccgaggggaaggggctgggaggtgggtcgcacgttatttaagtaaagatggatccacaggcgtacgcggactccgtgaagggccattcaccatctccagacgacaacgaccaaaacgaacatacgtntactcgtagaactaagacgaactgtnaggagacgacggaggaacggtacgggtctattaattagttaacgtaaaacgtaaagggtcggtaaattaagtacgtaagtttacggtgggttaggtacgggtcgttacgggtacgggaaccggaacggtaaccggtaccgggtcgtcccgcgtttacg

SEQ ID NO: 222633 - DNA, 584 bp, Homo sapiens
  misc_feature: GYAE6OF02H4EU3.40.33.C11.1.454.CMB.1.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (461)..(461): a, c, t, g, unknown or other
  misc_feature (461)..(461): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagccgtgggggtccctgagactctcctgtgcagcctctggagtcactctctccgcctacgtgggtactcgtgggtccnccaagctccgaggggagggctgggagtgggtcgcacggttatttataaagatggatccangcgtacgcgctcgngaaggcatcacatctacagacgacaacgccaaagaacacgagtgtctctgacaaagtggactagtctgagacgaccggagggacgtacgggtntacgttaattagttagtaaacaaaggtaggggtaactaagtggtaatagtgggttggtacgggtacgtcggtacggggggacctaacgggggaccctaacgggttccggtccgtccctttacg

SEQ ID NO: 222634 - DNA, 584 bp, Homo sapiens
  misc_feature: GYAE6OF02JJE62.40.33.C11.1.454.CMB.1.raw
  modified_base (580)..(580): a, c, t, g, unknown or other
  misc_feature (580)..(580): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaaccacagtgtctctgcaaatggaacagtctgagacgccgaggacacgggtgtctattagttgtaacaaaagtggggaactaaatgaatatggtagtggacgtcgtaggggaccaagggaccaacggtcgtcgctcttaatcgccctcgaccgaggcccagtcgtccttccccacggccgtccctcgctaccgaggacgctacctaccgacgacgcacgacgtcggcccgtgggcgtcgcgtcggttaccgaaggtaccttacctccgagtccgacttacggacttggacggtccgggcgtggaccgtaggccggtacagtaggntacg

SEQ ID NO: 222635 - DNA, 617 bp, Homo sapiens
  misc_feature: GYAE6OF02HHNY1.40.33.C11.1.454.CMB.1.raw
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (481)..(481): a, c, t, g, unknown or other
  misc_feature (481)..(481): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtcctgagactctcctgtgcagcctcgtggacgtcactcctctcccgcctacgtgggtactcgtcgggtccnccaagctccgaagggggaacggggctgggaggtgggtcgcgacgttatttaanaaagntggatccanagcgtacgcgactccgtagaacggcatcacatccncagagacaacgaccaaagacacgagtgtctcgtagacaaagtcggaactgtctaggagcggaccggaggacgtacgggtntactagttacgttagtaaacgaaaggttcgggaattaagtacgaagttaggttgggtaggtacgggtaaccgttcgggtaacgggggaccgaaacggggacccgtaaccggggttccgttaccggaccctttacgg

SEQ ID NO: 222636 - DNA, 548 bp, Homo sapiens
  misc_feature: GYAE6OF02IXUJ6.40.33.C11.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (547)..(548): a, c, t, g, unknown or other
  misc_feature (547)..(548): n is a, c, g, or t
tcagtctagcgactcacgaccggtgctcgatttagagtgagctcgttgggtttgggaggcttagttcagcctgggggggtccctgagactctcctgtgcagcctctggagtcactctctccgcctactgggtactctgggtccgccaagctccgagggaaggggctggagtgggtcgcacgtatttataaagatggatccanagcgtacgcggactccgtggaagggccgattcaccatctccagagacaacgccaagaacacagtgtctctgacaagtggacagtctgagagaccgaggacgaacggggtntctattattagtaacaaaaggtgggactaatgaatagtggtgtggacgtgtgggacaagggccacggtgtcgcctntagtcncctccacgagcccntccgtcctcccctggccnccngctcgagacnctaccncgancncngcgcgcgcggctcgccgtgacgagtacctaactccgtagcgtatacggcgttacggcggaccggggtgtcgggaacgacgggcctcgaagtcgnn

SEQ ID NO: 222637 - DNA, 635 bp, Homo sapiens
  misc_feature: GYAE6OF02HMAAW.40.33.C11.1.454.CMB.1.raw
  modified_base (355)..(355): a, c, t, g, unknown or other
  misc_feature (355)..(355): n is a, c, g, or t
  modified_base (436)..(436): a, c, t, g, unknown or other
  misc_feature (436)..(436): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagctgggttttccttgttgctattttaaaaggtgtccagtgtgaggtgcagttgggtgggaggtccgggggaggcgttagttcaggccgtggggggtccctggagacctctcctgtgcagcctctggagtcactctctccgcctacgtgggtactcgtgggtccgccaagcctccgaggggaacgggcgtgggaggtgggtcgacgacgttatttanaaagatggactcagagcgtacgcggactcggtaggacggcgattcacatctcagagacaacgccaaagacacagtgtctcngacaaagtcggacagtctagaggacgaccggaggaccgtacggggttcgtacttaagtttattacgaaaccggtaaaaggtcgggggaaaccttaagtacggtaaattaggtaggggttaggtacgggtaacggttccgggtaacgggggacccggtaacggggaccccgtaacggggtcccgttaccggccctttacg

SEQ ID NO: 222638 - DNA, 793 bp, Homo sapiens
  misc_feature: GYAE6OF02FRQNS.40.33.C11.1.454.CMB.1.raw
  modified_base (311)..(311): a, c, t, g, unknown or other
  misc_feature (311)..(311): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgtctattttaaaaggtgtccagtgtgaggtgctaggttggtggaggtccgggggaggtcgttagttcgaggccgtcgggggtccctgagaccttctcctgtcgctacgcctcgtggagtccactctcctccgcctacgtcggtactcgtcggtccncgacgccgtccggaaggggaaggggtcgtagggtacggtgggtccgacgtaacggttaactttaaagtaaaggtgtagtactaccgtaacgacgtcgtaccggcggtaaccgtcggtaacggacgggtaccgtacttaccgaacctattaccgaccgaacgaacgaaccaaaccggacctaaaacggaaacctaaccggtaaggtacgttaccgttctacggacctaaaaggtcggtaacgacggtttcgtagtacggaacgacccgggaagggtaccggtaccggggttattaccgttaaagttttacggttaagggtaaaccggtaaaaggttacggggtaaaccgttaaaggtacggttaaagtttaaggttacgggttacgggttacggggttaacccgggttaacgggttaccggggtaacccggttaacggggaaccccgggttacggtcccgggttacccgtacccgtttaccgg

SEQ ID NO: 222639 - DNA, 761 bp, Homo sapiens
  misc_feature: GYAE6OF02GWUF1.40.33.C11.1.454.CMB.1.raw
  modified_base (372)..(372): a, c, t, g, unknown or other
  misc_feature (372)..(372): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagtcagccgtgggggtccctgagactctcctgtgcacgcctcgtggagtccactcgtcctcccgtcctacgtgggtactcgtcgggtccgccaacgccgtaccggaaggggtaacgggggctagggacggttgggtcgacgtacgttagttaagtaaagngtacggactaccgaacgtacggaccgtaccggaccggggtaccttacccgggtaagggaacggggtcccgtactttccgaaccctacgttcccgtaccgaaggtaacgaacccgaaaccgaccctaaaacggaaaccacgtaaggtcgttacctacgtacggacaaacggtcggtaacctagttacgtggaacggtaaccggtccgggaacggtaaccggtaccgggttgtttaacgttaatttagttaacggtaaacgtaaaagggttcgggaacttaagtacggttaattagggttaagggtcgggtacggtaccggttacgggacggggtaacccgggtaagggaccccggtaacgggtttcccggttacccggccgtttaaccgg

SEQ ID NO: 222640 - DNA, 815 bp, Homo sapiens
  misc_feature: GYAE6OF02HVBLN.40.33.C11.1.454.CMB.1.raw
tcagtctagcgactcacgaccggtgctcgatttagagtgagctcgttggggtttggggggccccgagccctgggattcccgacgctgtttctgtcttgctgatcaggactgcacacagagaactcaccatggagcttgggctgagcgttgggttttccttgttgtcttattttaaaaggtgttaccagtgttgagggtgctaggttggtggaggtccggggggaggtcgttagtcgaggccggtcggggggtccctggacgtactctccgtggtcgacgacgcccttgtcgggtagttccaccgttccgtccgtcccggtacctacgttcgggtacttccggttcggggtcccgaccgaacggtcccgtaccggacggggtaaacggggccgttagggacgggttcggggtaccggtaccgtaacggtttaacgttttaaagtaaaaggtaggttacggtaacgttaccgaacgtacggtaaccggttaaccgggccggtaaccggttccggtagggaaaccggggtccgaacgttccaaccgactaccgtaccaaggacggtaacaaccgacccgaaaaggtaaacccgtacgaaggttcgttacgtacgtacgaaacggtaaagtacggaataccggtacgtaggaaggaccgacgggaacgtaccgggaacggttcgtaacttaattagttaaacgaaaggtaaacggtaaacggtacttaagaagttagttacggtaggtaaggttcgtaacgggtggtaacccggtacgggaacggtacccgggacggttccgtaccgggtaccttacgg

SEQ ID NO: 222641 - DNA, 636 bp, Homo sapiens
  misc_feature: GYAE6OF02I23RP.40.33.C11.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (387)..(387): a, c, t, g, unknown or other
  misc_feature (387)..(387): n is a, c, g, or t
  modified_base (634)..(634): a, c, t, g, unknown or other
  misc_feature (634)..(634): n is a, c, g, or t
tcagtctagcgactcacgaccggtgctcgatttagagtgagctcgttgggtttgggaggcttagttcagccctggggggtccctgagactctcctgtgcagcctctggagtcactctctccgcctactgggtactcgtgggtccgccaagctccagggaaggggctggagtgggtcgcacgtatttanaaagatggatccanagcgtacgcggactccgtgaggccgattcaccntcncaganaccacgccaagaaccanagtgtctntgcaaatggacngtctgagngccgagacgagggtgtactattattagtaacgaaaggtgggactaagtgaatgtggtgtaggacgtgtgggaccaagggaccacggtcgcgtctcttancgtccctacgacccgaacgggtccctacgtacccggttcccttcccccggtcggcccgtccccgtgccctaccgacggtaccacccgtaccgtccgaacggtaccgacccgtacgaccgccgggcccgtacggggtcctcggtccgttacgggaaccgtaaaccggtaccgttaaccgttccgtacggtaccgtcgtacggtacgtggaccgggtacggccgtaggacgacgggccgtagactaggncg

SEQ ID NO: 222642 - DNA, 668 bp, Homo sapiens
  misc_feature: GYAE6OF02G9YVZ.40.33.C11.1.454.CMB.1.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
  modified_base (667)..(667): a, c, t, g, unknown or other
  misc_feature (667)..(667): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaaggggctgggagtgggtcgcacgtatttataaagatggatccanagcgtacgcggactccgtgaacgggccgattcaccatcctccagagacaacgccaaagaacacagtgtctctgacaaatggacagtctgagacgccgaaggacgacgggtgtcttattattgtaacaaaaggtggggaactaagtagaatagtggtgtggacgtcgnggggaccgaacgggaccgacggtcgtcgccttctatcgcactccaccgaacgggcccacgtccggttcccgttcccccgtggcccgtcccgtcgcctacccgacgggacgccgtacccgtaccggacgacgaccgacgacggcccgggtacccggttcgggggacctcgggtccccgttacgggtaaccgaaacgggtaacccttaacccgtttcccgtacggttaccggtccgtttaaacggaccggtttagggacggtccggggtcgtcgggaccgaacgggtccgacgaagttagng

SEQ ID NO: 222643 - DNA, 832 bp, Homo sapiens
  misc_feature: GYAE6OF02IQES3.40.33.C11.1.454.CMB.1.raw
tcagtctagcgactcacgaccggtgctcgatttagagtgagctcgttgggtttggggggccccagccctgggattcccagctgtttctgcttgctgatcaggactgcacacagagaactcaccatggagcttgggctgagctgggttttccttgttgtcttaatttttaaaaggtgttcctagttgtggaggttgcgtaggttgggtgggaggtccggggggaggtcgttagttcgagccgtgggggtccctgagactctcctggtcgcagtcctgtggagtcaccttcctctcccgtacctacgtcgggttactcgtcgggtcccaccgtaacgcctaccggagggggaacggggcgtggggaggttcggggtccgtacgtaacggtttaagtttaataaaaggcgttaggtaactcgaacctaggaccgtaggccggaccgttccggtagggaacgggaccctagttaccaccttacgtaccgtaccgtaaggacgtaaccgaaccgtaaccgaaacggtaaaccaccgtaaggttcgtaccttaccgtaggtaacctaaaggtacggaacggtacgtacggtaggtaacggacggaccgggaacggtaaccggtaacggggttcgtacgtttaacttacggtttaagttaaaaccggttaaagggtaaggggtaaacctttaagggtaagttaaaacgggttacgttaagggggttaccggttagggggtaacccggtttacgggggtaaccgggggttaacccgggaaaccgggggtaccccggtaaaccggggtttccggtaacccgggttcccgtttaaccccggg

SEQ ID NO: 222644 - DNA, 593 bp, Homo sapiens
  misc_feature: GYAE6OF02FP6EU.40.33.C11.1.454.CMB.1.raw
  modified_base (245)..(245): a, c, t, g, unknown or other
  misc_feature (245)..(245): n is a, c, g, or t
  modified_base (481)..(481): a, c, t, g, unknown or other
  misc_feature (481)..(481): n is a, c, g, or t
  modified_base (552)..(552): a, c, t, g, unknown or other
  misc_feature (552)..(552): n is a, c, g, or t
  modified_base (592)..(593): a, c, t, g, unknown or other
  misc_feature (592)..(593): n is a, c, g, or t
tcagtctagcgactcacgaccggtgctcgatttagagtgagctcgttgggtttgggaggcttagttcagcctggggggtccctgagactctcctgtgcagcctctggagtcactctctccgcctactgggtactctgggtccgccaagctccagggaggggctgggagtgggtcgcacgttatttataaagatggatccacagcgtacgcggactccgtggaagggccattcaccatctccaganacaacgccaaagaacacagtgtctctgcaaatggacagtctgagagccggaggacgacgggtgtctattattgtaacaaaaggtggggaactaagtgaatagtggtgtggagtcgtggggaccaacggggaccacgggtcgtcgccttcttatcgccctaccaaccgaacggggccccaacgttccggttaccctttccccccgtagggcccgtcccgtcgccttcccgagggacnccaccgtccgtagacgcacgacgccggcccgtgggcctcgcccgtggtacgaaaggccttacgtcctgtcncgtagctaggacggcgggcgtggacgacgggcgacagtann

SEQ ID NO: 222645 - DNA, 744 bp, Homo sapiens
  misc_feature: GYAE6OF02I9PSE.40.33.C11.1.454.CMB.1.raw
  modified_base (547)..(547): a, c, t, g, unknown or other
  misc_feature (547)..(547): n is a, c, g, or t
  modified_base (661)..(661): a, c, t, g, unknown or other
  misc_feature (661)..(661): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgcttaattttaaaggtgtccagtgtggaggtgcgtaggttggtggaggtccgggggaggtcgttaggttcgaggtccggtgggggtccctggacgacttctccgtgtcgcagtcctgtggagtcactctccgtccgcgttacgtcggtacctcggtcgggtaccgaccgaaggtccgtaccggaaggggggaacgggtccgtagggtacggtcgggtaccgtcgtaaacggtttaattttaaagtaaaggtagttacgggactacccgtaacgacggtaccgtaacgggtaccggtaccggtccggtaacgggaacgggtcccgtaattcccgaacctacgttacccgtaccgaagaacggtaaccgaaaccggacccgaaaacgtaaaccncggtaaacgttcgtactactaggaactaaagcgtaacgtacgttcaggtacgcgaccgggagacggacggttctactagtttacgtaagaaacgtaaggtagggtaactaggtnaaaggttgacgggttacggtggaccggttacgggtaccgggaacggaaccggggtaccgacgggttactccggtaccttacgg

SEQ ID NO: 222646 - DNA, 675 bp, Homo sapiens
  misc_feature: GYAE6OF02GJH1V.40.33.C11.1.454.CMB.1.raw
  modified_base (482)..(482): a, c, t, g, unknown or other
  misc_feature (482)..(482): n is a, c, g, or t
  modified_base (588)..(588): a, c, t, g, unknown or other
  misc_feature (588)..(588): n is a, c, g, or t
  modified_base (599)..(599): a, c, t, g, unknown or other
  misc_feature (599)..(599): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgctagttggtggaggtccgggggaggtcttagttcagccgtgggggtccctgagactcctcctgtcgcacgcctcgtggatcgacctctcctcccgcctacgtgggtacctcgtgggtcccgacaacgcctccgaggggaacggggcgtgggaggtgggtccgcgtacgttaatttaagtaaacgtagtaggactaccacgacggtaccgtaccggcggaccttccggtaaggaacgggccgtattccgaacctactccgtacccgagtaacggaaccaaccgaaccaaacgaaaccngtaacgtcgttcacgttacgactaaaggtcggaactacggttcaggaaggaccgcgggaaccggaacgtggggttactgtttaattagttacgaaactaaacgggnggtaacttaanagtaagttagtgggttacgtgggtaccgttggacggggacgaacggggtaccctcgggtcgttcccggctttaacg

SEQ ID NO: 222647 - DNA, 628 bp, Homo sapiens
  misc_feature: GYAE6OF02GWEII.40.33.C11.1.454.CMB.1.raw
  modified_base (523)..(523): a, c, t, g, unknown or other
  misc_feature (523)..(523): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtccctgagactctcctgtcgcacgcctcgtggagtcactctcctccgcctacgtcggtactcgtcgggtccgccaagcctccggaggggaacgggcgtgggaggtcgggtcgctacgttaatttaataaagagtaggactaccgacacggacgtacgcggtacgtccggtaggaacggccgtacttaccaacctactccgtaccgagaacgacgaaccgaccaaagaactacagtctctacgtagaaccgaaagttggaactaggtctaggagacgccggagaccgtacgggttntacttagttattaggtaaacgtaaaggtggaacttagtagtaattaggtggtagtacggtacgtcggacggggaccaacggggtcctacgggtctccgccttacg

SEQ ID NO: 222648 - DNA, 669 bp, Homo sapiens
  misc_feature: GYAE6OF02F6OUS.40.33.C11.1.454.CMB.1.raw
  modified_base (249)..(249): a, c, t, g, unknown or other
  misc_feature (249)..(249): n is a, c, g, or t
tcagtctagcgactcacgaccggtgctcgatttagagtgagctcgttggggtttggaggccttagttcagcctggggggtccctgagacgtctcctgtggccagcctctggacgtcgacttcctctccgcctactgggtactctcgggtccgccaagctccgagggaagggctggagtgggtcgcacgtatttataaagactggactccgacagcgtacgcggactccgagaagggccattcaccatcnccgagagacaacgcaagacacagtgctctgcaatggacagtctaggagacgacgagacacgggtgtactagttacttgtaactaaaaggtggggtactaacgtgtaagtagtagggtgtggacgttcggtacggggccgtaagggacctaacgggtcgtccaccgttcttatccggacctcccgaaccgaacgggccctagtaccggtcccttacccccgtcggtccgtacccgtgtacccttccgaacggtacgtaccttaacccgtcccggaagaccgtaccgacgtacggccggccccgtttagggcccgtcgacccggtttgggaccctaagggccttacgtaccgaggtctacgttacggaacctggacgggtccggcgttacggaccgtaacggccgtacgtaagtcgtacacg

SEQ ID NO: 222649 - DNA, 778 bp, Homo sapiens
  misc_feature: GYAE6OF02HCT1D.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttaattttaaaaggtgtccagtgtgaggtgcagttggtggaggtccgggggaggtcttagttcgaggccgtgggggtcctgagactctcctgtgcagtcctcgtggacgtcctacgttcctccgtcccgtcccgttacgtcgggttaccttccggtcgggtcccgaccgaacggtccgtaccggaacggggggaacggggtcgtggggacgggttcggggtccgacgtaacggtttaagtttaaagtaaaagtagttacggacttaccgaacgtcggtacggtaccggacggtaccgtaccggtagggaacgggccgtaacgttaccaacccgtacttcccgtaccgaaggaaccgaaccgaaaccgaacccaaaaggaaacccctaagtacggttacttacctacgtacgaaacctaaaggtcggaactacggttcgtaagggacggtaccggaccgggaacggaccggtacggggttctacgttaagtttaacgttaagtaaaccgaaagggttgggtaaactaaggtacgaagtttacgggtgggtacggtacgggtacgttacgggaacggggaccgtaacggggaccgttaccgggtccgttaccgtccttaacg

SEQ ID NO: 222650 - DNA, 734 bp, Homo sapiens
  misc_feature: GYAE6OF02HX8HJ.40.33.C11.1.454.CMB.1.raw
  modified_base (192)..(192): a, c, t, g, unknown or other
  misc_feature (192)..(192): n is a, c, g, or t
  modified_base (594)..(594): a, c, t, g, unknown or other
  misc_feature (594)..(594): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgctatttaaaggtgtccagtgtgaggtgcagttggnggaggtccggggaggcttagttcagccgtgggggtcctgacgactctcctgtgcagcctctggagtcactcctcgtccgcctacgtgggtacctcgtcgggcccgtccgaacgccgtaccggaagggggaacggggcgttacggggaggtcggggtccgacgtaacggtttaatttaaagtaaaggtagttcggaacttaccaacgtaggacccggttaacggccgggtaacgttccgggaacgggaaccggggtacctaacgttaccaaccctaatccctaccgaaggaccgaaaccgaaccgaccgaaaacggaacccaacgtacgttacgtacctacgtacggaactaaacggtcggaacgtagtctaggacgaacggccggaaggacgtacggggttnttacttaagtttagtaacgtaaacggtaaaggtaggggtaacttagacgttaagttaggtaggtcggttacggtaccgggtacggtacggggtaaccgaacggggtacccgtacgggtaccggttccgttaccttaccgg

SEQ ID NO: 222651 - DNA, 735 bp, Homo sapiens
  misc_feature: GYAE6OF02I1CDU.40.33.C11.1.454.CMB.1.raw
  modified_base (393)..(393): a, c, t, g, unknown or other
  misc_feature (393)..(393): n is a, c, g, or t
  modified_base (683)..(683): a, c, t, g, unknown or other
  misc_feature (683)..(683): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgcttaatttttaaaaggtgtccagtgtgaggtgcgtaggttggtggtaggtccgggggagtcgtttagttcagccggtgggggtccctgagactctccgtgtcgcacgcctcgtggacgtcacctctcctccgcctacgttcggtactcgtcgggtccaccgaagtcctcggaaggggacgggtcgtgggaggtcgggtcgacgtacgtttaatttaagtaaagtgtaggactccganacggtaccggacggcggtaccgtccggtaaggaaccgggcctacttaccgaaccctacgttacctaccgaggtaacgaaccgtaacggaacccaaaaggaaccacgtcggttactctaccggtagaacctaaagtccggactagtaccgtaagggacgacgggacccgtaaggtaaccggtccggggtttattaaaccgttttagtttaacgtaacgtaaaacggtaaagggttcggtaaacttaaggtacgtaagttacggttgggtacggtagggtaccgttacgggnggggaaaccgtacgggtacccgttaggggtccccgttacgtcccgtttaacg

SEQ ID NO: 222652 - DNA, 619 bp, Homo sapiens
  misc_feature: GYAE6OF02IWUTK.40.33.C11.1.454.CMB.1.raw
  modified_base (492)..(492): a, c, t, g, unknown or other
  misc_feature (492)..(492): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtccctgagactctcctgtgcagcctcgtggagtcactctctccgcctacgtgggtactcgtggtccgccaagctccgaggggaaggggctgggagtgggtcgcacgtattaagtaaagataggataccacgagcgtacgcggactccgtagaacgggccgtagttccactactcctaccgagacgacaaccgaccaaagaacacgagtgtctctgacaaagtcggaactagtctaggagacggaccgaggacctacggggttntacgttagttagttacgttaaacgaaaagggttcgggaactaagttagaacgttagttgggttagtacgggtaacgttcggtggggtacgaacgggaaccgtaccgggtccgtccgtacccgttacg

SEQ ID NO: 222653 - DNA, 895 bp, Homo sapiens
  misc_feature: GYAE6OF02IEL8D.40.33.C11.1.454.CMB.1.raw
  modified_base (679)..(679): a, c, t, g, unknown or other
  misc_feature (679)..(679): n is a, c, g, or t
  modified_base (883)..(883): a, c, t, g, unknown or other
  misc_feature (883)..(883): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagtcgttgggtttttccttgttgcttaagtttttaaaaggtgtccagttgtgaggtgcgtagttggtggacggtcccgggggaggtctttagttcgacgtccggttcgggggttccctaggacgtaccttcctccgttggtcgcgacgtcccttcgtggtacgtccgtaccttccgttccgtcccgtaccgtttacggttccggggttaccttccggttcggggtccccgaccgtaacggtcccgttacccgggaaacggggggtaacgggggtcgttaggggtaacgggtttcgggggttaccgtaccggttaaacggttttaagttttaaacgtaaaaggtacgtacgggtaactacccgaacggtacggtacccggtaaccggccggttaccgttcccggagggtaacgggtccgtaactttaccccgaacctaacgtcccgtaaccgaaggtaaccgaaccgaacccgtaaccgaaaacgaaacctaacggtaggtttccgtactacgtaggaactaaaggtcggaaaccttgtacngggaacgtcggaccgggaaagccggttacgggttacttacgttaaagttttcgaaaccgggttaaaacgaaaggggttttcgggaaactttaagggtacgttaaaacggtttggggtaaggtttacgggtacggtaacccggtttcggggaaccgggggtaccgtaaccggggtacccgttaccggggtttccgtaccccgttnttttaacccggg

SEQ ID NO: 222654 - DNA, 764 bp, Homo sapiens
  misc_feature: GYAE6OF02GV22X.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggagcttagttcagccgtgggggtccctgagacctctcctgtcgcacgcctcgtggacgtcacttcctctccgtcctacgtggtactcgtcggtccgcagctcgagggagggctggaggtggtcgcgtacgttatttaagaaagtgtacggtactaccgacgacggcggtacggaccggtaccgtccggtacggtaacgggccgtacttccaacctacttccgtaccgacggaaaccgaaccgaaccgaacccgaaaacgaacctaacgtaggttctacctacgacgaactaaagtcggacctaggttacgtacggacgtaccggaccggaaacgggtacggtaaccggggtttatttaccgtttaaagttttaggtttaaaccgggttaaaacgtaaaaagggggttacgggaaacttttaaagtaggttaaaacgtttagggttcgggtttaaggggtaccggggtacgtttacccgggggagggggtaaccccggtaaacgggggttccccggtaaacccggggtttcccggtacccggttaccccttttaaccggg

SEQ ID NO: 222655 - DNA, 642 bp, Homo sapiens
  misc_feature: GYAE6OF02JYW6G.40.33.C11.1.454.CMB.1.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
tcagtctagcgactcacgaccggtgctcgatttagagtgagctcgttggggtttgggggccccagccctgggattcccagctgtttctgcttgctgatcaggactgcacacagagaactacaccatggagcttgggctgagctgggttttccttgttgctattttaaaaggtgtccagtgtgaggtgcagttggtggagtccggggagcttagttcagccgtgggggtcctgagactctcctgtgcagcctacgtggtagtcactctctccgactacgtggtactcgtacggtccncaagctcgagggaggctggagtggcacacgtattagaagntgactcanagcgtacgcgactcggtagaacggccgtataccgacactaccgtaccgagacgaacaaccgaccaaagacaacgagtcgtctacgtagaacctaaagtcggaaactagttcgtagtacgacggaccggaaggacgtacgggtgttacttaagttagttaaacggtaaacgaaaacgggttaggggtaaacttaaaggtgtaaacgttaggtacgggtacgtacgggtaaccggttccggtaacggggaaccgtaacggggtacccctaacgggttccgtacccggttacccttaccgg

SEQ ID NO: 222656 - DNA, 730 bp, Homo sapiens
  misc_feature: GYAE6OF02HGML0.40.33.C11.1.454.CMB.1.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
tcagtctagcgactcacgaccggtgctcgatttagagtgagctcgttgggtttgggggcccccagccctgggattcccagctgtttctgcttgctgatcaggactgcacacagagaactcaccatggagcttgggctgagctgggttttccttgttgctattttaaaaggtgtccagtgtgaggtgcagttggtggaggtccgggggaggcttagttcagccgtgggggtccctgagacgtctccgtgtgcagcctcgtggagtccactctcctccgcctacgtgggttactccgtgggtcccnccgaagcctccgaggggaagggcgtgggagtgggtcgacgtacgttatttaanaaagtagtggactccgacaggccgtacggcggtactccggtggaacggcgattccaacactcctaccagacgacaacgacccaaagtaaccacgagttcgtaccttactacgactaaagtacggaaccgtagtactaggacgaacggtaccggaagggtacccggtaaccgggttagttaaccgttaagttttaacgttaaaggttaaacggtaaaacgggttacgggggtaaacttacggtaagggttaaacgttagggttaggggttacgggttacggggtaaccggttcggggttaaccggggggaccccgtaaaaggggggtaccccgtaaccgggggtttcccgttacccgggttcccgtttaaccgg

SEQ ID NO: 222657 - DNA, 971 bp, Homo sapiens
  misc_feature: GYAE6OF02JX1JA.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgcttaattttaaaaggtgtccagtgtgaggtgcagttggtggaggtccggggagtcttagttcaggccgtgggggtcctgacgactcctcgtgtcgacacgtcctgtgtacgtctactcctccgtccgtacctacggttcggtaccgttccggtcgggtaccgaccgaacgtccgtacgggaacgggggacgggtcgtagggtacggttcgggtaccgtaaccgttaacgtttaaagtttaaagtaaagtacggtacggtaacctaccgaacggtacggtaccggtaaccggtaccgggtaaccgttaccgggtaacggggaacccgggtaccgtaacgttacccgaaccgtaccgttacccgtaaccgaaacggtaaaccgaaacccggaaacccgaaaccgtaaaaacggaaccccgttacggtaaccggtttccgtttaaccctaacggttaaacggaaaacctaaacgggttccggaaaccgtttacggttaccggaacgggaaacggtaccccggggtaaccggggtaaacgggttaacccgggttagggtttaacccgttttaaacgtttaaacggtttttaacggttaaaaaccggggaaaaaaccgggtttaaaagggggggttaacccgtttaaaaccttaaaggggtttagttaaaaacgggtttcgggtttaccgggggtttaacgggtaaccgggggtttaacccggttaccggggggtaaacccgggggtaaaaccccggtaaacggggttaccccccggtaggggtttttaccccccgttaccgttaccccgtttttaagg

SEQ ID NO: 222658 - DNA, 841 bp, Homo sapiens
  misc_feature: GYAE6OF02F2KMA.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgcttaagttttaaaaggtgtccagtgtgaggtgctagttgggtggaggtccgggggaggtcttaggttcacgccgtcgggggtccctggagtactctcctgtcgcacgtcctcgtggacgtcactctctccgcctacgtggtactcgtcggtccgcgacgtccgtccgaagggggaacgggtcgtagggtacgggtcgggtaccgacgtaacgtttaagtttaaagtaaaagtagtacggactcccgaacgacggtaccggtaccgggaccggtaccgttcccggtagggtaaaccgggccgtacgttacccaacctacttacccgtaccgaagaaccggaacccaacccggtaaccaaaacgaaacccgacgtacggtttactccttaacgtacgaacgtaaaacgtcgggtaaacctcggttcgttaacgggacgaaccgggcccgggtaaacggtacccggtaccgggggttaactttaccgtttaaagttttaacggttaacggttaaaaaccggtaaaagggtttccgggggaaaactttaggaacgtttaaaacgtttgggtttaaccggggtaagggttaccgggtaaacccggtttcgggtaaccggggggtaaccgtaaacccggggggtaccccgttaccggggtttcccggttacccggttccccgttttaaccg

SEQ ID NO: 222659 - DNA, 776 bp, Homo sapiens
  misc_feature: GYAE6OF02JV60P.40.33.C11.1.454.CMB.1.raw
  modified_base (765)..(765): a, c, t, g, unknown or other
  misc_feature (765)..(765): n is a, c, g, or t
tcagtctagcgactcacgaccggtgctcgatttagagtgagctcgttgggtttgggggcccccagccctgggattcccagctgtttctgcttgctgatcaggactgcacacagagaacctcaccatggagcttgggctgagcttgggttttccttgttgcttaagttttaaaaggtgtccagtgtggaggtgctaggttgggtgggtaggtccgggggaggtcgtttagttcgacggtccggttggggggtccctggaggtaccttctccgtgtcgccacggtcctcgtgggtactccgtacttctccctccgtaccttaccggttcgggtaccttcggtcgggtcccaccgaacgtccgtaccggaagggggacgggtcgtagggaggtcgggtcgtacgtacgttaatttaagaagtagtcggactaccagtacgtacggtacggccgtaaccgtccggtacgggaacgggtccttacgtacctaaccgtactaccgtaccgtaacgaacgtaaccgaacccgacaaacggacctaagtacggttcgttccgtcgtacgtaactaacggtcggtactacggttacacgggacggaccggtacgggaacgggtacgtaccggttacgttactttaaggttaccgttaaggtaaaccggtaaagggtacgggttaactaagtaccggttaatcgggttagggtacgttcgggtaaccggtgggtacggggaaccgtaccgggttaacgtccgggttcggttaccncccgtttaagg

SEQ ID NO: 222660 - DNA, 786 bp, Homo sapiens
  misc_feature: GYAE6OF02IQFRB.40.33.C11.1.454.CMB.1.raw
tcagtctagcgactcacgaccggtgctcgatttagagtgagctcgttgggtttgggggcccccagccctgggattcccagctgtttctgcttgctgatcaggactgcacacagagaactcaccatggagcttgggctgagctgggttttccttgttgctattttaaaaggtgtccagtgtgaggtgctagttggtggaggtccgggggagcttagttcagccgtgggggtcctgagactctctgtgcacgcctgtggagtccactcctcctccgcctagtcgggtacttcgtcgggtcccgccaaagtcctccgaagggggaacgggggtcgtaggggtacggtcgggggtccacgttaacggttaagttttaaataaaaacgggtatagggactaccgaccgaaggtccggtaacggccgggtaccgtaccgggtaggaacgggacccgtattaccgacctaactcctaccgaagacgtaaccgaaccgaaccaaaacggaaaccacgaacgttacgtcctacttacggaacgtaaatacgggtaactacggtcgtaggaacggacggacccgggtaaagggaacccggttaacgggttacggttaactttaacgtttaacttaaacgggttaaaaccgtaaaaagggtagggggtaaaaccttaagtaaggttaagtaggttagggttacggttaacggggtacggttaccggggttacggggaacccgggtaaaccgggtacccggtaaccgggttaccggttcccggtaccttttaacccgg

SEQ ID NO: 222661 - DNA, 778 bp, Homo sapiens
  misc_feature: GYAE6OF02INPL8.40.33.C11.1.454.CMB.1.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (236)..(237): a, c, t, g, unknown or other
  misc_feature (236)..(237): n is a, c, g, or t
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
tcagtctagcgactcacgaccggtgctcgattttagagtgagctcgttgggtttgggagcttagttcagcctggggggtccctgagactctcctgtgcagcctctggagtcactctctccgcctactgggtactcgtgggtccgaccaagctccgagggaaggggctggagtgggtcgcgtacgttatttanaaagatggactccanagcgtacgcgactcgtgaacggcatcacnncncagagacacgcaagaacncagtgtctcgtgacaaatcggacagtctaggagacgaccggaaggaccgtacgggttnttacgttaagtttattacggtaaacgaaaaggttcgggaaacttaagtaggtaaattaggtggttggtacggacgttcggacggggaaaccgaaacggggtcctaaccgggttcgtaccggtaccctttagtttaacgccgtaccctacccgaaaccgggtaacgggtccctaacggttcccggttacccgtttaccccccggtacggtccccgtacccgttcgaacccgttaccggaaacggtaccgtaacccgtaaccccgttaccgggaacgaccgtaaccgaacggtaccggccgggtaccccggttagggtcccgtacggtacccgttaacgggtaacccgaaacgggttaacccttaaaccgttccgtaacggtacccgaacgttacggtaaccgttacgggaacggtcccgggtacgtacgggtaacgaacgggtaccgaacgtaacgtgaccgtg

SEQ ID NO: 222662 - DNA, 791 bp, Homo sapiens
  misc_feature: GYAE6OF02FLI0D.40.33.C11.1.454.CMB.1.raw
tcagtctagcgactcacgaccggtgctcgatttagagtgagctcgttgggtttgggggcccccagccctgggattcccagctgtttctgcttgctgatcaggactgcacacagagaactcaccatggagcttgggctgagtcttgggttttccttgttgcttaattttaaaaggtgtccagtgtggaggtgcaggttggtgggaggtccgggggaggtcttagttcagtccgtgggggtccctgagtaccttctcctgtcgcacgtcctacgtggacgtcacttctccgtccgccttacgtcggtactccgtcggtccggtaccacgtacgccgtacgggaggggtacgtggtacggtagggtccggacgtacgttaacgtttaagtaaagtaagtacgtacgtaccgtaccgacggtaccgtaccggtaccggaccggtacccggtaacgggtacgggaccgtacgtacctaaccgtaacgtccgttaccgaacgtaacggaaccgaaacccgtaccaaaacgtaaaacgaccttagggttaccgttacgtaacgtcggaacctaaaggttacgggaacgacgtttcgaccgggtaaagcccggaacgggtaacccggtagtaccgggttacgtttccgttaagtttaacctagggtttaaaacgggaaaacgttaggggtcttaaacgtagtaaggttaggtccgggttagggtaaccggtccgtttaaggtacccggggaccggtaaaccgtaccggggtacccggcgggtttaccgtcccttaccgg

SEQ ID NO: 222663 - DNA, 910 bp, Homo sapiens
  misc_feature: GYAE6OF02H9GTA.40.33.C11.1.454.CMB.1.raw
tcagtctagcgactcacgaccggtgctcgatttagagtgagctcgttgggtttgggggccccagccctgggattcccagcttgtttctgcttgctgatcaggactgcacacagagaacctcaccagtggagcgttgggctggaggtcgtttgggttttccttgttgtcttaagtttttaaaggtgttccagtggtggaggtgtcgtaggttgggtgggtacgggtccggggggtaggtcgtttaggttcgacggtcccgggttccggggggttaccgtacggtaacggtaccgttccgttccgtaggtcgtacgtaccggttccgttcgtacgggtaacgttcccgttaccttccttccgttacccggttcccgttaacggttccgggtaccgttccggttacgggtaccccgtacccgaagtcccggttacgggaacgggggtaacgggtcggttacggggttacgggtcgggttaccggtaccgttaaggttttaacgttttaaacgtaaaacgggtacgttacgggtaacctacccgttaacggttaacgggaacccgggttaaccggtacccggggtaaccgttacgggttaacggggaaccgggttaccgtaaccggtttacccaaccgtacgttacccgtaaccgaacggtaaccgaaacccgaaacgaaccgtaaaacgacgtaacgttacggtacgttaccagttaccgacgtaaagttcggaactagttcgtaggtacgaacggacggtagaccggttaggtactacgtttaagttacgtttaagaacgttaaagggtacggtaattaacggagtaagtttacggtggttaaccgggtggtaccggtacggtacggggaaccggtaaccggacggtttcccgggtacacccggttctaacg

SEQ ID NO: 222664 - DNA, 128 bp, Homo sapiens
  misc_feature: GYAE6OF02INAPT.40.33.C11.1.454.CMB.1.raw
  modified_base (111)..(128): a, c, t, g, unknown or other
  misc_feature (111)..(128): n is a, c, g, or t
tcagtctagcgactcacgaccggtgctcgatttagagtgagctcgttggggtttgggggccccagccctgggattcccagctgtttctgcttgctgatcaggactgcacannnnnnnnnnnnnnnnnn

SEQ ID NO: 222665 - DNA, 783 bp, Homo sapiens
  misc_feature: GYAE6OF02FFSLM.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagtcttgggtttttccttgttgcttaattttaaaaggtgtccaggtgtgaggtgcgtaggttgggtgggacgggtccgggggaggtcgtttaggttcacggcccggttcggggggtcccctaggacgtaccttccgtccgtgtcgcgacggtcccttcgtggtacgtccgtaccttccttcccgtccgtcccttacgtcgggttaccttccggtcggggtccccaccgaacgtccgtaccggaagggggacggggcgtgggtacggttcgggtcgacgtaacgtttaattaagtaaaagagtacggtactaccgacgacggtcggtaacggccggtaccgtccggttacgggaacgggtcccgtacgttacccgaaccgtacttaccgtaccgaacgaacgaaccgaaccgaaccaaacgaacaacgtaggttcgtaccttcgtacgaacaaacggttggtaactacggttcgtaggacgacggaccggaagggtacccggagggtttacgttacgtttaagtttaacgttaacgaaaacgtaaaagggtcgggtaaattaagtagtaagttggttcgggtagtacggggtacgttacgggcgggaaccgtaacgggacccgtgggttcccgtcgtacccgttacg

SEQ ID NO: 222666 - DNA, 977 bp, Homo sapiens
  misc_feature: GYAE6OF02HWZ77.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcttgggctgagcttgggttttccttgttgtcttaattttaaaaggtgtccagtgtgaggtgcgagttggtggaggtccgggggaggtctttagttcgacggtccggttcgggggttccctggagaccgttcttccgttggtcgcgagtcccttcgtgggtacgttcaccgttccttccgttccccggtacccgttaccggttacggggtttacccttccccgggttacggggttcccccggtaccccgtaaacggtccccgttaacccggggaagggggggtaaacggggtccgtcgggggtaagggttcgggggtccgtacggtaaccgtttaagttttaaaacgtaaaagtagttaggtaaccttaccaacggtaacggtccgtaaccggtccggtaaccgtccgggtaacgggtaaaccgggtaccgtaacgttacccaaccgtctacccgttaccgacgtaacgaacccaacgggacctaaaaccggaaccgaacgtaactgggttaccctacgtacggtaactaaaaggtccggtaaacgagttaccgtacggaacgggtacccgaccgggtaaccgggtaaccgggtttaacggggtaccgttttaacgttttaaacggtttaaacggttttaacggtaaaaaccggtaaaacgggggtttaaccggggttaaaacgtttaaaaggtagggttaaaaaccgttttgggttaaccggggtttacgtttaaccggggggtaccgggtttaccgggggttaaacccggggaacccggttaaacccggggggttaccccgtttaacccgggggtaccccgtttcggttacccccgtttttaacccgg

SEQ ID NO: 222667 - DNA, 816 bp, Homo sapiens
  misc_feature: GYAE6OF02JB4SD.40.33.C11.1.454.CMB.1.raw
  modified_base (183)..(183): a, c, t, g, unknown or other
  misc_feature (183)..(183): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgagctgggttttccttgttgctatttaaaaggtgtcagtgtgaggtncagttggtggaggtccgggggaggtctttagttcaggccgtggggggtccctgagactctccctgtcgcacgcctctggtagtccactcctctccgcctacgtcgggtacctcggtcgggtccgaccaacgccgtaccgaagggggaacggggtccgtgggacggttggggtaccgaccgtaacggttattttaaacgtaaaaaggtaggttagggtaacctccgaacgtaacggttaccggtaacccgggaccggtaacccgttacccggggtaaggggtaaaccggggtacccgtaaccgtttacccgaacccgtaaacgttaccccgtaacccgaagggtaaacccgaaaccggtaaaaccccggaacccaaaaaacggtaaaccctaaaccggtaacgtttacggtaccctttacgtacgggtaaaccaaagttacgggaacctaaggttcgtaaggacggtacggacccgggaaggtaccggtacgggtactttacttaaaggtttagttaacgttaaacgaaaacgggttgggtaaacttaaggtataagtggttgggtaaggttcgggtacggtcggttacgggaccgaacggggtacccgtcgggtaccgtcctacccgtttacg

SEQ ID NO: 222668 - DNA, 754 bp, Homo sapiens
  misc_feature: GYAE6OF02JY046.40.33.C11.1.454.CMB.1.raw
  modified_base (128)..(128): a, c, t, g, unknown or other
  misc_feature (128)..(128): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (513)..(513): a, c, t, g, unknown or other
  misc_feature (513)..(513): n is a, c, g, or t
  modified_base (548)..(548): a, c, t, g, unknown or other
  misc_feature (548)..(548): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggancttgggctgagcgttgggttttccttgttgtctattttaaaggntcngtgtgaggtgcgagttggnggagtccgggggagcttagtcagtccgtgggggtccngacgctcgtcctggtcnctagcctcgtaggacgttcaccttctccgtccgcgttacgttcgggtacctcgtacgggtcccgacctaaggtccaccggagggggtaaacgggggtcctagggttaggtccggggtacctacgtaacgggtttatttaaacggtaaagtagtggtacctaccacggtacgtacggttcccggaacggtacttccggaggaaccggaccgtataccaactacgtacgtacccgaagacgttaacaaccgacaaacggactaacgnggtactcctcgtacgacgaattagggactaacggngtacgagtacggtaccgggaagtacggaccgggttacgtactttaacggttaacgttaaccggtaaaggtaaccggtaggggttaactaaacgtacggaaagttttagggcgggttttacgggacgggttacggtacccggttagggggaacccggtaacggggtaccccggttacgggttcccgtaaacccggttccgttaacgg

SEQ ID NO: 222669 - DNA, 763 bp, Homo sapiens
  misc_feature: GYAE6OF02GX9OD.40.33.C11.1.454.CMB.1.raw
tcagtctagcgactcacgaccggtgctcgatttagagtgagctcgttgggtttgggggcccccagccctgggattcccagctgtttctgcttgctgatcaggactgcacacagagaactcaccatggagcttgggctgagcttgggttttccttgttgcttaattttaaaaggtgtccagtgtgaggtgcgagttggtgggaggtccgggggaggtcttaggttcgagtccggtcgggggtccctgagactctcctgtgcacgcctcgtggacgtcctactcctcctcccgtcctacgtcggtactcgtcgggtcccgacgacgcctaccggaggggacgggcgtgggaggtcgggtccgacgtacgttaatttaagaaagtgtggactccgaacgacggacgtacggccggtacgtaccggtaggaaccgggtccgtacttaccgaacccgtactaccgtaccgaaggaaccgaaaccgaaccgaacccgaaaagaaacccgtaacgtaacggttcctactcgtaacggtaacaaaaggtcgaaccgtacgttcgaaggacgacgggaccgacgggaacggtcggggttactttacgttaaacgttttaagttaacggtaaaacggtaaaagggtacggggttaaataacgggttagttaaagtttagggttcggggtagggttacgggaccggttcgggttaaccggggaaccgggtaaccgggtaccgtaacccggggttcgtaccggttcccttaacgg

SEQ ID NO: 222670 - DNA, 905 bp, Homo sapiens
  misc_feature: GYAE6OF02GB3HX.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccatggagcgttgggctgagtcgtgggttttccttgtgacttaattttaaaaggtgtccagtgtgaggtgctagttggtggaggtccggggagcgttagttcagccgtggggtcctgagctcgtccgtgtgacagccgtcgtggacgtcacttctccgtccgaccgttacgtcgggttacttcggtcggggtacccgaccgaacgtccgtaccggaagggggtaacgggtctacggggtaacggttccggggtcgaccgttaaaccggtttaagttttaaaggtaaaaggtacgttaacgggtaaccttacccgaaaccgtaggtaccggttaccgggaccggtacccggtttaccggggtagggaaaacccggggacccggttaaagtttacccgaacccgttaacttacccgttacccgaaaggaaccggtaaccgtaaacccggaaccgaaacggaaaacctaccgtaacggtacgttaccgtcgtaacgaacgtaaagtcggtaactacgggttacgccggtaagaaccggaccgggtaacgggaacgtaccggggtttactaaacgtttacgttaaacggttacgttaaaaacccggaaaaagggtttaccggggaaaccttaaagggtttacgaaacggtttaaggtttaggggtttaacggggttaccgggttacccgggttttaagggtaccccgggggttaaaccccgggaaacgggggtaaaccccggttttaccggggttaacccggttccggtttaaccccccgtttaacggg

SEQ ID NO: 222671 - DNA, 836 bp, Homo sapiens
  misc_feature: GYAE6OF02INH0U.40.33.C11.1.454.CMB.1.raw
  modified_base (283)..(283): a, c, t, g, unknown or other
  misc_feature (283)..(283): n is a, c, g, or t
tcagtctagcgactcacgaccggtgctcgatttagagtgagctcgttgggtttgggggccccagccctgggattcccagctgtttctgcttgctgatcaggactgcacacagagaactcaccagtggagcgttgggctggagtcgttgggttttccttggttagtacttaaagttttaaagggtcgtccgtaggttggtggagggtcgtcgtaggttgggtgggacgggtccgggggtagtcgttagttcgaggtccggtcgggggtcctgacgtactctcgngtcgcacgtcctagtggacgtcacctcgtacctccgacgttacggtcggtactcggtcggtaccacgacgtcgtacggaggggacggtcgtaggtacggttcggacgtaccgtaagttatttaagaagtacgtacggtactaccgtacgtacggaccgtacggtaccggtaccgttacgggaacgggtaaaccgggtccgtaaacgtttcccgacttacgttcccgacgaaggaccgaaaccgaaccgtaaccgaaacggtaacaaccgtgtcgttacctagtaacgaacgtaacgtcggaacttacggtacgtacggaacggaacgggaccggtaacggtaccgggtaccgggtttactaacggttttaagttaacggtttaacggtaaaaccgggtaaagggttaacgggtaactttaaagtaggttaaacggttagggtttacggggttaacccggttaggtaacccggggttccgtaaaccggggtacccgggttaaaaccgggtccgttaaacccgggggttccctttaccggttaacccggtttccg

SEQ ID NO: 222672 - DNA, 681 bp, Homo sapiens
  misc_feature: GYAE6OF02FNBUW.40.33.C11.1.454.CMB.1.raw
  modified_base (215)..(215): a, c, t, g, unknown or other
  misc_feature (215)..(215): n is a, c, g, or t
  modified_base (529)..(529): a, c, t, g, unknown or other
  misc_feature (529)..(529): n is a, c, g, or t
  modified_base (567)..(567): a, c, t, g, unknown or other
  misc_feature (567)..(567): n is a, c, g, or t
  modified_base (580)..(580): a, c, t, g, unknown or other
  misc_feature (580)..(580): n is a, c, g, or t
tcagtctagcgactcacgaccggtgctcgatttagagtgagctcgttggggtttgggggccccagccctgggattcccagctgtttctgcttgctgatcaggactgcacacagagaactcaccatggagcttgggctgagtcgtggttttccttgttgtctaattttaaaaggtgtccagtgtgaggtgcagttggtggaggttccgggggaggntttagttcaggccgtgggggtcccttggacgacttctccgtgtcgcagtccgtccgtggaggtcctaccgtccttccgtccggtaccctacgtcggggttaactcggtcgggttaccccgccgaacgtccgtacccggagggggtaacggggcgttagggacggttcggggcgtacgtaacgttatttaagtaaagtagtaggactaccgacgacggcggtacggacggaccttccggtaggtacgggaccgacgttaccacctactccgtaccgaagaacgaaccaacgaccgaaaggaactacgacgtcgtntaccgtgaacaagtacggactagttcgagagcggacgnggaacgacgggtntacgttatagttaagtaaacgaaaggtaggtaacgtaatgtaagacgttggagttacgacggttcgtacgggacgacgggactacgggtcgcgtacgtcgg

SEQ ID NO: 222673 - DNA, 776 bp, Homo sapiens
  misc_feature: GYAE6OF02JQCZN.40.33.C11.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
tcagtctagcgactcacgaccggtgctcgatttagagtgagctcgttgggtttgggggccccagccctgggattccagctgtttctgcttgctgatcaggactgcacacagagaactcaccatggagcttgggctgagctgggtttctgttgctatttaaaggtntccagtgtgagtgntagttggtggaggtccggggagcgttagttcaggccgtgggggtccctgacgactcgtcctgtcgcgagtcctcgtggacgtctacttccgtcctccgcctacgtaggtactcgtcgggtccgacctagtccgtaccggagggggtaacggcgtggggtacggttgggtaccgtaccgttacggtacgttttaaacgtaaaggtaacgtgggtaactacccgaacgtaacggttccggtaacgggcccgttaacgtcccgggttaagggaaaccggggtcccgtaacgtttccgaaacccggtacttacccgtccgtaaacggaacgtaacccgaaaaccggccaaaaagggtacccaacgtggttaccgtctacgtaaggacccgtaaaagtccgggaacttacggtagtgaaaccggtagaccggggtagtaaccgtacggggttaatttacgttaagtttacggttaagaaaccggtaaaagggttccgggtaattaaggacttaaggtacgttgggtagttaacgggggtaccttggggtaaccggacggtaacggggtcccgtaacggtccgttaccggcccttttaacggg

SEQ ID NO: 222674 - DNA, 852 bp, Homo sapiens
  misc_feature: GYAE6OF02HNBOV.40.33.C11.1.454.CMB.1.raw
  modified_base (590)..(590): a, c, t, g, unknown or other
  misc_feature (590)..(590): n is a, c, g, or t
tcagtctagcgactcacgaccggtgctcgattttagagtgagctcgttgggtttgggggccccagccctgggattcccagctgtttctgcttgctgatcaggactgcacaacgagagaactccaccagtggacgtcgttagggctggagcgtttcgggtttttcccttggtttcgtaccgtttaaagtttttaaaaggtcgttacctaggttggttaacggaggttcgtcgtaaggttgggtagggtaacgggtccgggggacgtcgttaacgttccgacggtaccggtcgggggtcctaggacgtccgttctccgttaggtcgaccgtacgtaccgtcggtacgggtacttaccgtaccttaccgttaccgtccccgtaaccgtttacggtacgggtttaccgtccggttacgggtacccaccgtaacgcccggttaacgggagggggtacggtcgtagggacggtccggtactaccggtaaacgtttaagtttaacgaaaaggtcgacggtacctaccgaggtaccgtacggtacccggacggtaaccgttacggtacgggaaccgtcgtaacttacccgaacgttcnccgtacgaacgaccgtaaccgaaccgaacctaaacgaacgtacgtagttacgttcgtacgtacgtaactaacgagtaacgtacggtgtacggaacgacggtagggaaccgtacggtacggttacgttaccttagttaacgtaaaccgtaaaggttacgggaacgttaagtgtaacggtacgttaaggtcgttcggtagggttaccgtaaccgggaaggtacccggacggttaccggtaccggttacgttaccgtacgttccg

SEQ ID NO: 222675 - DNA, 838 bp, Homo sapiens
  misc_feature: GYAE6OF02IGOSJ.40.33.C11.1.454.CMB.1.raw
  modified_base (722)..(722): a, c, t, g, unknown or other
  misc_feature (722)..(722): n is a, c, g, or t
  modified_base (733)..(733): a, c, t, g, unknown or other
  misc_feature (733)..(733): n is a, c, g, or t
tcagtctagcgactcacgaccggtgctcgatttagagtgagctcgttgggtttgggggccccagccctgggattcccagctgtttctgcttgctgatcaggactgcacacagagaactcaccagtggagcgttgggctgagtcgttgggtttttccttgttgtacttaagttttaaaggtcgtcagtgtgaggtgcgtaggttggtggacgggtccggggaggtacgtttagtcgacggtccggttcggggggttccctggacggtacttccttccgtggtcgctacgtcctcggtaggtagtaccgtaccttcctcctcccgaccttacggtcgggtaaccttcggtcggggtccgaaccgaacggtcccgtaccggaaggggggtaaacgggtcggtagggtacgggtcggggtactcgtaaccgtttaatttaaagaaacgtacggttggaaccttaccgaacgcgtaccggtaccggacggtcccgtacggtacggaacgggacccgttacgtaccgaacctactcccggacgtaaacgggacgaaacccgaaccggaaccctaaaaacgacccgtaacgaaggtttcgttaccgacgtagaaacctaacggtaggtaacccgttagtaccgtacgggaacgttaaccgggacggaaccgggaccggttaaggggtttcaacgtttagttaacgttaggttaaaaacgaaaggggttntaaaaccggtnttaaggaacgttggttcgggtaagggtaccggtaccgggtttaccggaccggggtaaacccggaccgggttaacccgacggggtttccctacggtccttttacgg

SEQ ID NO: 222676 - DNA, 902 bp, Homo sapiens
  misc_feature: GYAE6OF02FWV7Q.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagacgaactcaccatggagtcttgggctgagcgttggttttccttggttcgtacttaattttaaaacggtcgtccgtagtgtcggaggtgcgtagttgggtggaggtccggggagtcttacgttcgacgtcccggtgggggtccctaggtacgtaccttccgttcctggtacgtccgacgtcccttcggtacgggttacgtacctaccttacttcccgtacccgtaccccgttacgtcggggttaacccttcgggtacccggggtccctaaccgaacggtaccctcgggtaaacgggggtaaccgggggtcgttcgggggtaaccggttcggggtaccgtaaccgttaacgggttttaaacgttttaaacgaaaacggttagtaccgggttactacccgaacgtacggtcccggttaacggacccggttaccgttcccgggtaacggtaacgggtccgtaactaaccccggtcctaaacgttacccgaacccgaagggtaaaccgtacccgaaaacggtacccgtaaacgtaaaacccgtaaccggtagttccgttacgtaccgttacggaaacgtaaaccgtaggaacctacgttaggacgtaaacggcgtaaccgggacggtaaacggtacccggttagtaccctttaggttaactttaacggaaaacgttaagggtacgtaacgtaagttacgtaacggtgttagggtacggttacggtacggtaccgggttcggggaaacccgttacgggtacccggtccgggtttaccgtccccggtatttacccgg

SEQ ID NO: 222677 - DNA, 635 bp, Homo sapiens
  misc_feature: GYAE6OF02H3LUN.40.33.C11.1.454.CMB.1.raw
  modified_base (139)..(139): a, c, t, g, unknown or other
  misc_feature (139)..(139): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (446)..(446): a, c, t, g, unknown or other
  misc_feature (446)..(446): n is a, c, g, or t
tcagtctagcgactcacgaccggtgctcgatttagagtgagctcgttgggtttgggggccccagccctgggattcccagctgtttctgcttgctgatcaggactgcacacagagaactcaccatggagcttgggctgancttgggtttttccttgttgcttaatttttaaaaggtgtccagtgtgaggtgctgttggtggagtccggggagtcttagttcagccgtgggggtcctgacgactctctgtncagcctgnggacgtcactcctcctccgacttacgtaggtactcgtcgggtccgacgtaacgccgtacgaaggggaacggggtctggggagtggggcncgtacgttaatttaagaaagngtggactaccganacgcgtacgcgtacgtccgaggacggtcatcacatccgacagaacgacacgacaagacacagtctnactagacgtaaatcggaatcgtaggcgggaacgaccgagggtaaccgcgggttatacgttaatttagtaacgtaaacgtaaaagggtcggtaactaagttaatagttaacggttggtagggttacgacggttaccggtacgggtaaccgacggtaccggttaccggtccgtaccctcgttaacttacgg

SEQ ID NO: 222678 - DNA, 847 bp, Homo sapiens
  misc_feature: GYAE6OF02JZSP3.40.33.C11.1.454.CMB.1.raw
  modified_base (141)..(141): a, c, t, g, unknown or other
  misc_feature (141)..(141): n is a, c, g, or t
  modified_base (665)..(665): a, c, t, g, unknown or other
  misc_feature (665)..(665): n is a, c, g, or t
tcagtctagcgactcacgaccggtgctcgatttagagtgagctcgttgggtttggggcccccagccctgggattccccagctgtttctgcttgctgatcaggactgcacacagagaactcaccagtggagcttgggctagngcttggttttccttgttgacttaagttttaaaacggtgtaccgtagttgtggtaggtgacgtaggtttggtagggtacggttccgggggaggttcctttaaggttccgaggtcccggtcgggggtcctggacgtcctccgtccgttgtacgaccgacggtcctcgtaggtcgtacctctccgtccgtcccgtaccgtttacggtcggttaccgtcgttcgggtccctaccgtaacgtcccggtaaccggagggggacgggtgttagggaccggttcgggtcgaccgttaaggtttaagtttaaaggaaaggtacgttacggtactacccggtaacgtaaccggtaccggttacccgggaccggttaacccggttccggaacggggtaacccgggtcccttaaacgttccaaccgttacttcccgtaaccgaacgacgtaacccgaaaccgaacccgaaagaaccgtaaccgtgttcggtttaaccctgtaactacgtaaacgacgtaacgtcggaattaacggnggtaccgaccggaaggttactcgggtactttaacttagttacgggttaaacacgggtaaaggttaccgggtaactaagtagttaattaacgggttggtagggttacgtaacccgttcgggggaaccgggttaccggaacccggtcggttaaacccggtttcgggaccctttcctaacccggg

SEQ ID NO: 222679 - DNA, 937 bp, Homo sapiens
  misc_feature: GYAE6OF02GM9JU.40.33.C11.1.454.CMB.1.raw
tcagtctagcgactcacgaccggtgctcgatttagagtgagctcgttgggtttgggggccccagccctgggattcccagctgtttctgcttgctgatcaggactgcacacagagaactcaccagtggagcttgggctgagcgttggggtttttccttggtttgtactttaagtttttaaaagggtcgtcccgtaggttgtggaggttgcgtaggtttgggtgggacgggttccggggggtaggtcgtttaaggttccgacggtcccggttcggggggtacccttgacggtacctcttccgtgtcgcgacgtcctacgtacggtacgtcctacctccgttcccgtacccgtcccgttaccggttacgggtccttccgtcggggtacccgtaccgaacggtcccgtacccgggtaagggggtaacggggtcggttagggtacgggttaccggggtccggtacgttaacggtttaagtttaaacgttaaaaggttagtacggtaccttaccgaacggtaccgggtaccggtaccggtccgggtaccgttaccggttaggggtaaccgggtaccgtacgtaccctaaccgtaccgttcccgttacgaaccggtaacgaaccgtaacccgacctaaaacgaccgaacgtacggtctcgtacgtagacgtaacgacggttaactacggtcgtacggacgtaacccggggacggaaggttacccggtacggggtttcgtttaactttaacggtttaacggtttaaacgtaaaacggttaaagggtttaccgggtaaaacgttaaacgtttgggtaacgttacggggttgggtttaaaccggggtacgggtttcccgggtaaccggggtaaccggggtacccggggaaacccggggtttcccggtaaacccgggtttaccccgggtttcgaccccggttttaccg

SEQ ID NO: 222680 - DNA, 982 bp, Homo sapiens
  misc_feature: GYAE6OF02IKHUJ.40.33.C11.1.454.CMB.1.raw
  modified_base (956)..(956): a, c, t, g, unknown or other
  misc_feature (956)..(956): n is a, c, g, or t
  modified_base (970)..(970): a, c, t, g, unknown or other
  misc_feature (970)..(970): n is a, c, g, or t
tcagtctagcgactcacgaccggtgctcgatttagagtgagctcgttggggtttgggggcccccagccctgggattcccagctgttctgcttgctgatcaggactgcacacagagaactcaccatggagcttgggctgagcttgggttttccttgttgcttaattttaaaggtgtcctagtgtggaggtgcgtaggttggtgggtacgggtccgggggaggtcgtttaagttccgacggtcccggttcggggggttaccctagggtacgtaccgttccgtacccgttggtacgaccgtacggtccccgttacgttgggtacggttacctaaccggttccctacccgttccccggtaccccggtttaccgggttaccgggttaacccgttccgggtttccggggtacccccggtaacccgtaaaccggtccccgttaaccgggtaacgggggggtaaacgggggtccggttacgggggtacggttccgggggttcccggtaaccgttaaccggtttaaagtttaaacgtaaaacggtacgtaacggtaactcccggaacgtaccggtacccggtaccgggtaccggtaccggttacccggtaagggaaccgggtacccgttaacgttcccaacgtacctcctacccgaacggtacgaacccgaaaccggacccgaaaacgaaccgacgttacggttaccgtttacgacgtacggaaactaaggttacccggaagtttacgttccggtaaacggacggtacgggaccgtaaacggtaccgggttagggttaccgtttaattaaacgttttaccgtaacgttaaaaacgggtaggggttaaaccggtaacgttaaagtaggttaaagttacgggttcgggttacggttaccgggtaaacgggttccgggttaacgggggaaaccccggttaagggtaccccgggtaacccggggttttntaaccccggggttntttaccccgggg

SEQ ID NO: 222681 - DNA, 886 bp, Homo sapiens
  misc_feature: GYAE6OF02HOF4A.40.33.C11.1.454.CMB.1.raw
tcagtctagcgactcacgaccggtgctcgatttagagtgagctcgttgggtttggggccccagccctgggattcccagctgtttctgcttgctgatcaggactgcacacagagaactcaccatggagcttgggctgagcgtgggttttccttgttgctaatttaaaggtgtccagtgtgaggtgcgagttggtggaggtccgggggaggtcgttagttcacggtccggtcgggggtccctaggacgtaccttccttcctggtacggcacgtcctcgtggacgtcctacgttccgtccgtcccgtaccgttaccgttcgggttaccttcggtacgggtcccgaccgtaacggccctaccggagggggaaacggggtcctaggggtaggttcggggtccgacgtaaaccggttaattttaaagaaaaggtacgtaggaccttaccgaacgtacggtaccggtaccggaccggtaccgtaccgggtacgggaaacgggtaccgttacgttaccgaaccctaacgttccctaaccggaaaggaaccgtaaacccgaaccggaacccgaaaacgaaaccggaactacggtaccgttacttacgtacgaacgtaaacggtcggaaacttacggtacgttaacgaacggaaccggtacccgggaaagggtacccggtaacggggttacgttactttaaacggtttagtttaaacgggtaaaccgttaaaagggtacggggtaaacttaaacggttaggtaaaggtttaacgggttacgggttacggtttaccggggaaccgggtttaccgggtaccgggggtaacccgggtaaacccggggtacccgggttaacccgggtttcccggttaccccggtacccttttaacccggg

SEQ ID NO: 222682 - DNA, 817 bp, Homo sapiens
  misc_feature: GYAE6OF02JPP07.40.33.C11.1.454.CMB.1.raw
  modified_base (138)..(138): a, c, t, g, unknown or other
  misc_feature (138)..(138): n is a, c, g, or t
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
tcagtctagcgactcacgaccggtgctcgatttagagtgagctcgttgggtttgggggccccagcccgtgggattcccagctgtttctgcttgctgatcaggactgcacacagagaactcaccatggagcttggctgngcttgggttttccttgttgcttaattttaaaggngttccagtgtggaggtgcaggttggngggtacggtccgggggagtcgtttagtcgaggccggtcgggggtcccngagccttcgtcgtgtggcacggtccctcgtggtacgtcctaccttcgtccgtacccgtcgtaccgttcgggtaccgttcgtccgggtcccgtccgacgccgtaccgggaggggaacgggtcgttggggacgtcgggtacgtacgtaccgttaagttaagtaagtaggtcgtacctacgaccgacgtaccggtaccgaccggtccgtaccggttacggacggtaccctagtttacccaccgtactaccgtaccgtaacgaacgaaccgtaaccgaaccgaaacgaaccgtaacgacgggttacttccgtgtaaccggaacgtaacgttacggacgtaagtttaccggtaacggacggtaaccggaccgggaacgggttaccgggtaacgggttacgtttaaccgtttaagtttaacggttaacgtaaacgggtaaaaggttacggggaaacttaacggtaggtaacgttgggttaacggttacgggttaccggttagggtaccggttaaccgggaacggtaaccggggtaacccgtttaacgggtaccggttcccggttaccgtttaccggg

SEQ ID NO: 222683 - DNA, 1099 bp, Homo sapiens
  misc_feature: GYAE6OF01CSRB2.30.53.E09.1.454.CMB.1.raw
  modified_base (205)..(205): a, c, t, g, unknown or other
  misc_feature (205)..(205): n is a, c, g, or t
tcagcacgctacgtcacgaccggtgctcgatttagagagagtgtgttgggtttgggaccttagctggcggtctgggttgtttccctcttcacgacggacgttagcacccgccgtgtgtctcccgtgaataactattcctccggtattcgctagtttgcagtcgggttggtaaggtcgggatcgacccccttgaccgaaacagtcncctccgtaccccggagatagtacgttccgacggacggcgtaccttaaaccgtaaaagtacggtaccggttttaccgggggaacgaacccgaggtaccgttaccgtttcccgtttccccggggttttagtaacgtttccgggttcccccttaccccaaccccccgaccgtacccaaaccgtaaccgttcctaaccgttaccccgttaacctttttaaaactttttaaccgtaaacctttaacgttttaccgggtttcccgggtttccccgggttacccttacccgttaaggttttaaccggttaacccgttaaaccccccttaaaccctttaaccccgtacccgtacccgtaccctaaggttccggtacgtaccggttaccgttacccgggttaacccgggggttttacggttaccttaaccgttacccgtaccgtaaccttaaacccgttaccggacccgtttaaggttaacccgttaccggtttccccggttttcccgtcccggttccctttaccccgttaccgtttacccggtttaaccttcggtacctaacggtaacttaagttaaaccgttaacggtccctaacgttaacccgtaaccttaaacgttaaacgtaaaccggtaaacgggtacctaacccgtacctaaacccaaacccggtaaataaaccgggtacccgtaccctcccgtattaccgttaccgtttacgtaaacccgggttaccgtttaccggtttacttttacccggttttaccttttacccccggtaccccgtttccccgggttttcccgggggtttttacccccgggttttcccttttcccccgttttaaccccggtttcccccggttaagggttttaacccgggttttcgtttccggtttaacccccg

SEQ ID NO: 222684 - DNA, 611 bp, Homo sapiens
  misc_feature: GYAE6OF02HYHPK.30.53.E09.1.454.CMB.1.raw
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
tcagcacgctacgtcacgaccggtgctcgatttagagagagtgtgttgggtttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgcctctacccccggagatgaattcacgaggcgctacctaaatagctttcgggagaaccagctatctccggtttgattggcctttcacccccagccacaagtcatccgcttaattttcaacattaagtcggttcggtcctcagttagtcgttacccaacttctaacctgaccatggctagatctaccgggttcgtctacgtaccctgacaacttacgcctagttaacgcttcgtttccctcggctccctattcgttaactgctacanaatntaagtcnctgacattatacaaagtcnanccacaactaaagcgtactccaatcncttgacgtactacggtttcaggtttctttacgaccttccctacggtcccgggttcttttccgtcctttccctacgtcggttacttggttaccg

SEQ ID NO: 222685 - DNA, 191 bp, Homo sapiens
  misc_feature: GYAE6OF01DBLYX.35.70.G04.1.454.CMB.1.raw
  modified_base (169)..(191): a, c, t, g, unknown or other
  misc_feature (169)..(191): n is a, c, g, or t
tcagtacagatcgtcacgaccggtgctcgatttagtgtagtgtgaagggaaagggtctgagagaggagcccagccctgggattttcaggtgttttcatttggtgaacaggactgaacagagagaagtcaccatggagtttgggctgagcgggctggcaaggcgcatagnnnnnnnnnnnnnnnnnnnnnnn

SEQ ID NO: 222686 - DNA, 184 bp, Homo sapiens
  misc_feature: GYAE6OF01AZE0I.35.70.G04.1.454.CMB.1.raw
  modified_base (170)..(184): a, c, t, g, unknown or other
  misc_feature (170)..(184): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgggctggcaaggcgcatagnnnnnnnnnnnnnnn

SEQ ID NO: 222687 - DNA, 620 bp, Homo sapiens
  misc_feature: GYAE6OF01EIA4X.35.70.G04.1.454.CMB.1.raw
  modified_base (195)..(195): a, c, t, g, unknown or other
  misc_feature (195)..(195): n is a, c, g, or t
tcagtacagatcgtcacgaccggtgctcgattttagtgtagtgtgaagggaaaggggtcgtgagagaggagcccagtccctgggattttcaggttgttttcagtttggtgaacgaggactgaactagagagaagtcaccagtaggagtttgggctgagcgtgtcttttcttgtgctatttaaagtgtcagtgtgnggtgcagctgtcggagtcgtgggggaggcttggtacagccgtggggggtccctgagagtctcctgtgcagcctctggagtcacctttgagtagctatggcatgagcgtgggtccgccgaggcctccggaggggcggggcgtgggaggttgggtcttcgtttcttagtttagtgcttaggtggtggtctcatatactacgcagactcgtgtaggaacgggtccgttacaccgtctaccgagacgtaacaattacccaaagtaaccaccccgttagttactcttagactaaatacgaacacgcctagagacgacccgaacgacgacggaccgttatacttacgtgtagaacgtaaaagttgggaacggtaaggtacggggtaagttgggtttaacttcgtaacgttcgttcggtcgggggtacccgg

SEQ ID NO: 222688 - DNA, 533 bp, Homo sapiens
  misc_feature: GYAE6OF01A3X1K.35.70.G04.1.454.CMB.1.raw
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
tcagtacagatcgtcacgaccggtgctcgatttagtgtagtgtgaagggaaagggctgagagaggagcccagccctgggattttcaggtgttttcatttggtgaacaggactgaacagagagaagtcaccatggagtttgggctgagcggtcgtgtttctaggtcggctattttaaaaggtgtccagtgtgaggtgcagctgtcggagtctgggggaggcttggtacagcctggggggtccctggagagtctcctgtgcagcctctggagtcaccttgagtagctatggcatgagctgggtccgccaggctccgaggggcggggctgggagtgggtctcttctattgtgctagtgtggtctcacntactacgcagactctgtnaagggccgttcaccgtctccagagacaattcccaagaaccacctgtatctgcaatgacagcctagacgagccgacgactacggaccgtatattactgtgacgaaattggacgtacgtggggaagtcggtacttcgatcgtgtgggtccgg

SEQ ID NO: 222689 - DNA, 534 bp, Homo sapiens
  misc_feature: GYAE6OF01C5R1K.35.70.G04.1.454.CMB.1.raw
  modified_base (476)..(476): a, c, t, g, unknown or other
  misc_feature (476)..(476): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagcctggggggtccctgagagtctcctgtgcagcctctggagtcaccttgagtagctatggcatgagctgggtccgccaggctccagggacggggctgggagtgggtctcttctattagtgctagtggtgtctcacatactacgcagactctgtgaagggccggttcaccgtctccagagacattccaaagacaccctgtatctgcaaatcgaacagcctgagagccgacgacacggcctaatacttacngtgacgtaaaattggacgaaacgtggggaaatgggtacttcgatcgtgtggggtcccg

SEQ ID NO: 222690 - DNA, 607 bp, Homo sapiens
  misc_feature: GYAE6OF01ADKBB.35.70.G04.1.454.CMB.1.raw
  modified_base (421)..(421): a, c, t, g, unknown or other
  misc_feature (421)..(421): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttggtacagccgtggggggtccctgagagtctcctgtgcagcctctggagtcaccttgagtagctatggcatgagcgtcggggtccgccgaggcctccgaggggaccggggctgggaggtgggtctcgttctagttagtgtcgtaggtggtggtctcacatactacgcagactctggtagaacgggtccgttcacccgtcnccgagacgactaacttccaaagaacccacccgtgtaactcgtagacaaagtcgaaccagcctaggaacgacgacccgaacgaccgaccggtaccgtaattacgttacgtggtacgaacgtaaaagttcgggaacgtaacggtaggggtaagttcggtaacttcgaagttccgtggtcggggtcccg

SEQ ID NO: 222691 - DNA, 601 bp, Homo sapiens
  misc_feature: GYAE6OF01C04BR.35.70.G04.1.454.CMB.1.raw
  modified_base (247)..(247): a, c, t, g, unknown or other
  misc_feature (247)..(247): n is a, c, g, or t
  modified_base (345)..(345): a, c, t, g, unknown or other
  misc_feature (345)..(345): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtgtgtttctaggtggctaattttaaaaggtgtcagtgtgaggtgcagctgtcggagtctgggggaggcttggtacagccgtggggggtccctgagngtctcctgtgcagcctctggagtcaccttgagtagctatggcatgagctgggtccgccaggctccgagggcgggctggagtgggtctcttcgtattgngctagtggtggtctcacattacacgcagactcgtgtgaacggtccggttcaccgtctccgagacgacaattaccaaagaaccaccctagtaactcgtagactaaatcgaaacaggaccctaggaacgacggacccgacgaaccgaaccgggtcctaagttaacttaacctggttagaacggtaaaaacgttgggaacgtaaacggtgggggtaaagttcggttaaccgttacgtattccgtcggtgggggtcccgg

SEQ ID NO: 222692 - DNA, 568 bp, Homo sapiens
  misc_feature: GYAE6OF01C9YQK.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggcgttttctaggtggctattttaaaaggtgtccagtgtgaggtgcagctgtcggagtctgggggaggcttgggtacagccgtggggggtccctgagagtctcctgtgcagcctctggagtcaccttgagtagctatggcatgagctgggtccgccaggctccgaggggacggggctgggagtgggtctcgttctattagtgctaggtggtggtactcacatactacgcagactctgtgaagggccgttcaccgtctccagagacaattccaaagacaccctgtactctgacaaatgaacagcctagagacggcccgaacgacctacgggccgtaatacgttactgtagacgtaaaagttgggacgaaacgttgggggaattagggttacttacggattacgtcgtgggggtcccg

SEQ ID NO: 222693 - DNA, 577 bp, Homo sapiens
  misc_feature: GYAE6OF01B8VDD.35.70.G04.1.454.CMB.1.raw
  modified_base (352)..(352): a, c, t, g, unknown or other
  misc_feature (352)..(352): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggcttttcttgtggctattttaaaaggtgtccagtgtgaggtgcagctgtcggagtcgtgggggaggcttggtacagccgtggggggtccctggagagtctcctgtgcagcctcgtggagtcaccttgagtagctatggcatgagcgtggggtccgccaggctccgagggacggggctgggagtgggtctcttctattagngctagtggtggtctcacatactacgcagactctgtgaagggcccgttcaccgtctccagtagactaataccaaagaacaccctagtatctgacaaatgaaacagcctagacgagacccgacgacacggcctaatattacgtgtcgaacgtaaaagttgggaacgtaacggtaggggtaaagttcgggttaacttacggtaattccgttcgggtcgggggtcccgg

SEQ ID NO: 222694 - DNA, 678 bp, Homo sapiens
  misc_feature: GYAE6OF01AT5VH.35.70.G04.1.454.CMB.1.raw
  modified_base (532)..(532): a, c, t, g, unknown or other
  misc_feature (532)..(532): n is a, c, g, or t
tcagtacagatcgtcacgaccggtgctcgatttagtgtagtgtgaagggaaaggggtctgagagaggagcccagccctgggattttcaggttgttttcatttggtgaacaggactgaacagagagaagtcaccatggagtttgggctgagctggtctttttcttgtggcttaattttaaaaggtgtccagtgtgaggtgcagctgtcggagtcgtgggggaggcttggtacaggccgtggggggtccctggagagtctcctgtgcagcctcgtggacgtcaccttgagtagctagtggcatgagcgtcggggtccgccgaggccgtccggagggggaccggggcgtgggaggttcgggtcttcgtttcgttagtttaggtcgtcgttaggttgggtcggtctcactactactacgcacgtactcgtggtacggaacgggtcccgttacacccgttcctaccgaaggacgaacctaaacttacccgaaacgtaaccctacccttagtactccgtacgactaaagtcgaaaccncgacctaggacgacgacccgaacgaccgaccgggtaccgttaattacgttacgtagtacggtaacgtaaaacgttcgggaacggtaacggttagggggtaaacttcgggttaaccttcggaacgttccgtcgggtcggggtcccgg

SEQ ID NO: 222695 - DNA, 568 bp, Homo sapiens
  misc_feature: GYAE6OF01C7ENY.35.70.G04.1.454.CMB.1.raw
  modified_base (341)..(341): a, c, t, g, unknown or other
  misc_feature (341)..(341): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggcttttcttgtggctatttaaaaggtgtccagtgtgaggtgcagctggtggagtccgggggaggcttagttcagccgtggggggtccctgagactctcctgtgcagcctctggattcaccttcagtacgtcactggatgcacgtgggtccatcaagttccgaggggaagggctgggtgtggtttcagttntacgagtgatgggactgacacaatcgtacgcggactccggtagaacgggccgattccacccctcagacgacaacgaccaagaacacaactatactactagacaaatgaaactagtcagagacgccgaaggacacggctgtctattactgtcgacacggaggtggacctaataatcgtaagtttgggtttttacgatttaccgtgtacgggggacctaaaggggtaac

SEQ ID NO: 222696 - DNA, 567 bp, Homo sapiens
  misc_feature: GYAE6OF01D265E.35.70.G04.1.454.CMB.1.raw
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcgtgtgtttctagtggctattttaaaaggtgtccagtgtgaggtgcagctgtcggagtcgtgggggaggcttgggtacaggccgtggggggtccctgagagtctcctgtgcagcctctggagtcaccttgagtagctatggcatgagcgtgggtccgccgaggcctccgaggggacgggcgtggagtgggtctcttctattgtgtctagtggtggtctcacatactacgcagactctgtgaagggtccgttcaccgtctccagacgactaatcaaagaaccaccctgtactctgacaaatgaacacgcctagagacgccgacgacacgtaccgtataacttagtagtagtaccgtaaaagttggacggtaacgtaggggtaagttcggttacttcggattcgtcggtcggggtacccgg

SEQ ID NO: 222697 - DNA, 554 bp, Homo sapiens
  misc_feature: GYAE6OF01CRSK5.35.70.G04.1.454.CMB.1.raw
  modified_base (267)..(267): a, c, t, g, unknown or other
  misc_feature (267)..(267): n is a, c, g, or t
  modified_base (453)..(453): a, c, t, g, unknown or other
  misc_feature (453)..(453): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggcgttttcttaggtggctattttaaaaggtgtccagtgtgaggtgcagctgtcggagtcgtgggggaggcttggtacagcctggggggtccctgagagtctcctgtgcagcctntggagtcacttgagtagctatggcatgagctgggtccgcaggctccgagggacgggctggagtgggtctcgttctattagtgcttagtggtggtctcacattacacgcagactctggtgaacgggtccggttcaccgtctccagagacaagttccaaagaaccaccctgtactcgtagaccaaatnaacagcctgacgagccgacgacaccggctaatacttactgtgacgtaaaagttggacgaacgtggggaagttggtacttacgattacgtcgtggggtccgg

SEQ ID NO: 222698 - DNA, 592 bp, Homo sapiens
  misc_feature: GYAE6OF01DQS3E.35.70.G04.1.454.CMB.1.raw
  modified_base (473)..(473): a, c, t, g, unknown or other
  misc_feature (473)..(473): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggtctttttcttgtggcttaattttaaaaggtgtccagtgtgaggtgcagctgtcggagtcgtgggggaggcttggtacaggccgtggggggtccctggagagtctcctgtgcagcctcgtggagtcaccttgagtagctatggcatgagcgtggggtcccgccgaggcctccggaggggcggggctgggagtgggtctcttctattagtgcttaggtggtggtctcgactatactacgcagtactcgtgtggaacgggtccgttcaccgtctccagacactaacttaccaagaaccacctagtactctagacaaatgaaacncgcctagacgacgccgacgacgacggtcctaatacttactgtacgacgtaaaagttggaacgtaacggtagggggtaaagttcgggttaacttacgattccgtcggtcgggggtcccgg

SEQ ID NO: 222699 - DNA, 679 bp, Homo sapiens
  misc_feature: GYAE6OF01CZ7QC.35.70.G04.1.454.CMB.1.raw
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggcttattttaaaaggtgtccagtgtgaggtgcagctgtcggagtcgtgggggagcttggtacaggccgtggggggtccctggagagtctcctgtgcagcctctggagtcaccttgagtagctatggcatgacgcgtcgggtccgccaggcctccggagggacggggctgggaggtcgggtctcttctagttagtgtcttaggtggtgtctcacgtatacctaacgctacgacttcgtggtacggaacgggtcccggttaccacccggtctacccgaaggaacgaactaacttacccaaaagtaaccctacccgttagtacttacctacgtaacctaaaagtacgaaaccacgtaccgtaggaagaccggacccggaacgaaccgtaaccgggtccgttaagttaacgtttaccgtaggtacgaacgtaaaacgttgggaaccggttaaacgggtacgggggtaaagttcgggttaacctttacggacgtttaccgtccgggtcgggggtacccgg

SEQ ID NO: 222700 - DNA, 576 bp, Homo sapiens
  misc_feature: GYAE6OF01DEVJA.35.70.G04.1.454.CMB.1.raw
  modified_base (251)..(251): a, c, t, g, unknown or other
  misc_feature (251)..(251): n is a, c, g, or t
  modified_base (353)..(353): a, c, t, g, unknown or other
  misc_feature (353)..(353): n is a, c, g, or t
  modified_base (417)..(417): a, c, t, g, unknown or other
  misc_feature (417)..(417): n is a, c, g, or t
  modified_base (565)..(565): a, c, t, g, unknown or other
  misc_feature (565)..(565): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtgtcgttttcttagtggctaattttaaaaggtgtccagtgtgaggtgcagctgtcggagtcgtgggggagcttggtacagccgtggggggtccctggagngtctcctgtgcagcctctggagtcaccttgagtagctatggcatgcacgtgggtcccgacaggcctccgaggcgtaagggctggtagtggttggcaggttgngtaggtatgataggaagtaatagattactagtgcaagaccaccgtaggaacggcgtatcacctntacctacagaagacaattaccaagaacttactttcgttacctagactaaatacgaactagacctagacgacgacgacggacgacggacgaatattaattacgtgtagacgtacggaagcgaagtcgggaacgtcccgtaacccccggngtacggaccgg

SEQ ID NO: 222701 - DNA, 582 bp, Homo sapiens
  misc_feature: GYAE6OF01EMEBK.35.70.G04.1.454.CMB.1.raw
tcagtacagatcgtcacgaccggtgctcgatttagtgtagtgtgaagggaaaggggctgagagaggagcccagccctgggattttcaggtgtttcatttggtgaacaggactgaacagagagaagtcaccatggagtttgggctgagctggctttttcttgtggctattttaaaaggtgtccagtgtgaggtgcagctgtcggagtcgtgggggaggcttggtacaggccgtgggggtccctggagagtctcctgtgcagcctctggagtcaccttgagtagctatggcagtgagcgtcgggtcccgcgaggccgtccgaggggacggggctgggaggttgggtctcgttctagttacgtgcgttagtggttgtctcacatactacgcagactcgtgtagaacgggtccgttcaccgtctaccagacgacaattaccaaagtaaccaccctagtactctagacaaatagaacagcctagacgacgaccgacgacgacggacctatattacgtgagtacgtaaaagttggacgtaaggtaggggtaagtacgggttacttacggatcgttcgtcggggtaccg

SEQ ID NO: 222702 - DNA, 583 bp, Homo sapiens
  misc_feature: GYAE6OF01B4NB1.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagccgtggggggtccctgagagtctcctgtgcagcctctggagtcaccttgagtagctatggcatgagctgggtccgccgaggctccgaggggacggggcgtgggagtgggtctcttctattagtgctaggtggtggtctcacatactacgcagactctgtgaacgggtcccgttcgaccgttcctccgaaggacgaactaacttcccaaagaacccacccttgtaactctagacaaatgaacacgctagagacgccgaacgaccgacggacctatacttactgtagtaacgtaaattgggaccgtaacggtgggggaaagttgggttactttggacttccgtggtgggggtacccg

SEQ ID NO: 222703 - DNA, 620 bp, Homo sapiens
  misc_feature: GYAE6OF01CEFI3.35.70.G04.1.454.CMB.1.raw
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (333)..(333): a, c, t, g, unknown or other
  misc_feature (333)..(333): n is a, c, g, or t
  modified_base (399)..(399): a, c, t, g, unknown or other
  misc_feature (399)..(399): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcggtgtcgtttctaggtggctaatttaaaaggngtcagtgtgaggtgcagctgtcggagtcgtggggagngttggtacagccgtgggggtccctgagngtctcctgtgcagcctcgtggctcaccttgagtagctagtggcagtgagtcgtgggccgccaggccnccggaagggccggngnggnggtggtcttcgttatagttgtcgtctggtggtgttactcacctattacgtaacggccaagtacctntggtacggaacggggtcccgttacgacccgttcgtccgaaggacgaactaacttaaccgaaacgtaaccaccctagtaactctacganaatcgaanacgctagagacgcgaacgacgacgggacctattacttacgtgaacgtaacggtaaacgtcggaacgtaacgggtagggtaaacggtcggttacgttacgtagttcgtacgggttcgggtcccggg

SEQ ID NO: 222704 - DNA, 743 bp, Homo sapiens
  misc_feature: GYAE6OF01ACCVO.35.70.G04.1.454.CMB.1.raw
  modified_base (624)..(624): a, c, t, g, unknown or other
  misc_feature (624)..(624): n is a, c, g, or t
tcagtacagatcgtcacgaccggtgctcgatttagtgtagtgtgaagggaaaggggtctgagagaggagcccagccctgggatttttcaggtttgttttctagtttggtagaacgaggactagaacagagagaagtcaccagtggtaggtttggctgagcgtggttctttttcgttggtggtctttaaagttttaaaaggtcgtacctagtgtggaggtgcagctggtcggagtcggtgggggaggtcgttaggtacgacggtccgggtcggggggttccctggaggtacgttcctccgtggtcgcgacgtccttcgtggtacgtcctaccgtttggacggtagtcttagtggactagtggaggtcgttcggggtccccgccggacggtcctaccgggagggggaccggggtcgtaggggtacgggttcggggttccttccgtttacgttaagtttacggtcggtacgttaggttcgggttcggttcctacgactaacgtaccgtacgcgacgtacttcgtggtacgggacgggttccgttaccaccgtccgtacgaaggacgtaactaacgttacccgaaagtaacccacccgttagtactcgtagaactaaagtacgaaacncgcctaggacgacgaccgacgacgaccggtctaatacttcgtagtacgaaacgtaagttggaacggtacgggtaggggtaattcggttacttacggacttcgtgggtcggggtacccgg

SEQ ID NO: 222705 - DNA, 573 bp, Homo sapiens
  misc_feature: GYAE6OF01E0P3Z.35.70.G04.1.454.CMB.1.raw
  modified_base (153)..(153): a, c, t, g, unknown or other
  misc_feature (153)..(153): n is a, c, g, or t
  modified_base (172)..(172): a, c, t, g, unknown or other
  misc_feature (172)..(172): n is a, c, g, or t
  modified_base (176)..(177): a, c, t, g, unknown or other
  misc_feature (176)..(177): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcggngtgttctagtgcattaagncatnngncagntngntngggngntgcngctggggtcctgagngtctctgtgcagcctntggagtcaccttgagtagctatggcatgagctggggtccnccgaggtctccgagggccggggctggagtgggtctcttntattgtgctgtggtgtctcanatcacgcagactngtgaacgggcggttcaccgttcaccgagacactaacttacccgaaataacctaccccgtagttaactaccgttcggaaccttaaaactaacgaacgacgtaccgtacgacgacgaccgacgaccgaccgtacgtactacttacgtagtacgtaacgtaacgtaggtacggtacggtaagggtaacggttacggttacggttacgtacgttccggttcgggtcgggtccgg

SEQ ID NO: 222706 - DNA, 555 bp, Homo sapiens
  misc_feature: GYAE6OF01EHYO5.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttgggtacagccgtggggggtccctgagagtctcctgtgcagcctctggagtcaccttgagtagctatggcatgagctgggtccgccaggctccgaggggacgggctgggagtgggtctattctattagtgctaggtggtgtctacacatactacgcagactcgtgtggaacgggtccggttcaccgtctccagacgacaattccaagaaccaccctgtactctgaccaaatcgaacagcctgacgagccgacgacacggccgtatactacgtgtagacgtaaaagttggacgaacgtaggggaagtcggttacttacgatctgtggggtacccgg

SEQ ID NO: 222707 - DNA, 683 bp, Homo sapiens
  misc_feature: GYAE6OF01AUIIU.35.70.G04.1.454.CMB.1.raw
tcagtacagatcgtcacgaccggtgctcgatttagtgtagtgtgaagggaaaggggtctgagagaggagcccagccctgggattttcaggttgttttcatttggtgaacaggactgaacagagagaagtcaccatggagtttgggctgagcgtgtcgtttctagtggctatttaaaggtgtcagtgtgaggtgcagctgtcggagtcgtgggggaggtcgttcggtacgacgccgtgggggtccctggagtgtctccgtgtgcacgtcctcgtggacgtcctaccgttgagtagtcttagtcggctagtggacgtcgtcggggtcccgccgaggtcctccggaggggccgggcgtgggaggttcggtcttcgttctagttgtcgtgtaggtcggtcgtctcgatacgtactacgcagtacttcgtgtacggaacgggtcccgttcaccgttctaccgaaggtacgtaaacctaactttacccgaaaactaacccgtacccgtagttaacgtcctacggaactaaacgtcgaaaaccgtcgtcccaagggacgtaaccgcccggaacgaaccgtacggtaccgtaattacgtacgttgtaacgaacggtaaacgttcgggaacgttaacgggtagggtaagttacggttaacttccggaagttcccgttaggtcccggggtacg

SEQ ID NO: 222708 - DNA, 683 bp, Homo sapiens
  misc_feature: GYAE6OF01D8WT2.35.70.G04.1.454.CMB.1.raw
tcagtacagatcgtcacgaccggtgctcgatttagtgtagtgtgaagggaaaggggtctgagagaggagcccagccctgggattttcaggttgttttcatttggtgaacaggactgaacagagagaagtcaccatggagtttgggctgagctggtctttttcttgtggcttaattttaaaaggtgtccagtgtgaggtgcagctgtcggagtcgtgggggaggcttggtacaggccgttggggggtccctgagagtcctccgtgtgcacgcctcgtggagtcctaccgttgagtagctagtggcatgagcgtcgggtccgccgaggccgtccggagggggaccggggtcgtggggacggttcgggttccttcgtttacgttagtttaggtcgtacgttaggttgggtcggttctacgaactaactaaccgtaccgacacgtacctcgttagggtacggtaaccggggtcccgtttaccgacccgttcctaccgaagacgaaacttaacgttacccaaaggaaaccctaccccttagtacctcgtacgaaccaaagtacgaacacgccgtagaacgccggtaccgacgaaccgcggtacctattaacttgtagtagaaacggttaaagttcgggaactaacgggtagggtaagtcgttactacgacttcgtcggtgggtacccg

SEQ ID NO: 222709 - DNA, 718 bp, Homo sapiens
  misc_feature: GYAE6OF01EQR5N.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtggtctaattttaaaaggtgtccagtgtgaggtgcagctgtcggagtcgtgggggaggcgttggtacgagccgtggggggtccctgagagtctcctgtgcagcctcgtggagtccacttgagtagctagtggcatgagtcgtgggtccgcgacggccgtccggaggggaccggggcgtgggaggttcgggttccttcgtttcttagttacggtcgtcgttaggtggttcggtcctaccaacgtacttaaccgtacgacgtacgtaccgtcgttaggtacgggaacggggtcccgtttacaacccggttcctaccgaaggaacgaacctaaacgttacccgaaaagtaacccctacccgttagtacttaccgtagaacctaaagtcgaaaccgagtccctaagggacggaccgtacccgaacggaaccgacccgggtaccttaaagtacctttacgaggaaccgtaaacggtaaaacggttcgggaacgtaaacgggttagggggttaacgaggttttaccccgtagacgttcccggttcgggtcgggggtcccg

SEQ ID NO: 222710 - DNA, 607 bp, Homo sapiens
  misc_feature: GYAE6OF01BA59S.35.70.G04.1.454.CMB.1.raw
  modified_base (474)..(474): a, c, t, g, unknown or other
  misc_feature (474)..(474): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggagcttggtacgagccgtcggggtccggtcgagagtcgtcctcgtgcgacgcgtcgtggtacggtcgtaccttgtagtagtctacgtaggtcgagtgagcgtcgggtccggtccgacggtcgtccgtacgggacgggcgtcggtaggtcggttcgtcttcgtagttagtgtcgtagtggtgtcgtctactatacgtacgcgacgtacgtctgtcggaggccggttctaccgtctcagagactaataccgtaaacgaacncctgtactcgtcacaaatgtaacacgtctcgagaccgtcgaaccgacacggacgtatagttctagtcgtaacggaaattagggcgtaacggtaggggtaagttcgttacgttacgagtcctggtcgggtccgg

SEQ ID NO: 222711 - DNA, 897 bp, Homo sapiens
  misc_feature: GYAE6OF01DE0IC.35.70.G04.1.454.CMB.1.raw
tcagtacagatcgtcacgaccggtgctcgatttagtgtagtgtgaagggaaagggtctgagagaggagcccagccctgggtattttcgaggttgttttctatttggtgaacaggactgaacagagagaagtcacagtggtagttggctgagcgtggtcttttctgtggtcttaagtttaaaggtgtccagtgtgaggtgcagtctggtcggagtcggtggggagcgttggacaggtccggtgggggtcctggagtacgtcctcgtgtcgcgacgtccgttcgtaggtaccgtactacccgtttggtaaggtacgtacgtttaagtcggggcctaagtcgggtacggtccggtttaaccgggggtccccgacccgtaacggggtccccgttaccgggaacgggggggtaaccccgggggtgttaacgggggaacggttttccgggggttccttttaccggttacgttttaacgtttaagggttcggtaccggtttaagggtcgggttgggttaccctcgaaacgtttacgtaaacgtaccgtacgaaacggtccttaccggtagttacggggaacgggttccccggttccgtaaccggttcctacccggaaagtaccgtaaacgtaaacgtttacccgaaaacgtaaaccttaacccgtgttaactaccgtaacgtaaccgtaaaagttccggaaaagtccgtaaccggttacgaaccgggacccggtaacccggaacccgaacgggtaccccggtacttaacgttaaaccgtttacgtacggtaacgtaaaaccgggtttaaagttacggggaaccggttaaagggttaacggggtaaggtttcgggttaacctttacgggtaaactttccggtaccgggttaccggggtccccggg

SEQ ID NO: 222712 - DNA, 735 bp, Homo sapiens
  misc_feature: GYAE6OF01ACIUJ.35.70.G04.1.454.CMB.1.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcggtgtgtttctaggtcggctaatttaaaggngtcagtgtgaggtgcagctgtcggagtcgtggggagcgttgacngccgtgggggtcctgagngtctccgtgtgcagcctgtggagtccaccttagaggtagctagtcggactagtcgcgtcgtcgggtcccgccgaggccttccggaaggggtcgggtcgtgggtagtcgggttcctccttaagttacgtttggcgtagttaggtgggtcgttacgacgtagtaactactacgcgtaacgtctacgtgtaacggtacgggtcccgtttcgaacccgtctaccgaacggtactaacgtaacccttacgaaaccgtaaccctcccttaggttaacctcctaacggtactaaacgttacgaacgttaacggtcctaaagggacgtaaccggtaacccggaaccgaccgtaaccggggtaccttaaccggttaaacgtcccggtttagggaaacccgttaggtaaacggtttaccggggaaccgttaacggggtttagggaccgttacggtttaccggttaccgtaagttcccggtacgggtccgggttaaccccggg

SEQ ID NO: 222713 - DNA, 722 bp, Homo sapiens
  misc_feature: GYAE6OF01BJ42R.35.70.G04.1.454.CMB.1.raw
  modified_base (285)..(285): a, c, t, g, unknown or other
  misc_feature (285)..(285): n is a, c, g, or t
tcagtacagatcgtcacgaccggtgctcgatttagtgtagtgtgaagggaaaggggtctgagagaggagcccagccctgggattttcaggttgttttcatttggtgaacaggactgaacagagagaagtcaccagtggaggtttgggctgagcgtggtctttttcttgtggcttaattttaaaaggtgtccagtgtgaggtgcagctggtcggagtcgtgggggagcgttggtacgagccggtcggggggtccctaggagtacgtcctccgtgtcgcacgccctntggactccaccgttgagtagctagtggcagtgagtcgtcgggtcccgcgacggcctccggaggggacgggcgtgggacggttgggtcttcgtttacgtagttgtggtacttggtggttacggtcctacgtactactaacgttacgactacggtacttcgttacggtacggtaaccggggttcccggtttaccgaacccggtttccctacggaacgtaacgtaacctaaaccgttaccgaaagtaaacccctcttagtactcgtacgactaaagtacaactacggctagaacgacggtaccccggaaacgtaccgaccgggtattaacttacgtacttcgggaaacgtaacggttaaaagttcccggggaagtaaacgggttaggggtaacggttacgttacggttcgtaggttccgttcggggtcggggtacccggg

SEQ ID NO: 222714 - DNA, 753 bp, Homo sapiens
  misc_feature: GYAE6OF01C1YBA.35.70.G04.1.454.CMB.1.raw
  modified_base (397)..(397): a, c, t, g, unknown or other
  misc_feature (397)..(397): n is a, c, g, or t
  modified_base (707)..(707): a, c, t, g, unknown or other
  misc_feature (707)..(707): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccagtggtagtttgggctgagcgttggtctttttcgttgtggtcttaagttttaaaagggtgtacctaggtgtgaggtgcagcgtggtcggagtcggtgggggaggtcgttaggtacgcggtccgggtcgggggttccctaggagacgttcctccgtgtcgcacgccgtcgtggactccgtacgttggagtagtactagtggactagtgacggtcggtccgggtccgaccgtacggccgtaccgggaggggaccggggtcgtacgggnggttccggttcgttacctttagtagtttacggtgttacggtggttcgggtcgttaccctacgaacgtactaccgtacggtaccgaacgttacgttcgtaacgggtaaccgggtacgggttaccccggttccgtaacccgttccgacgtaacggaccgaaacgttaactaaccgaaacctaaccggtacctttaggactaaccgcgtaaagaactagaaccacggtcaggacaaccggaccgtaacggaccgtacgtacgttaacgttcttaacgtgtacggtaaaggtacggtaacggacggttaacggngggtaactaccggttacgttacgtcttcggtaccgggtggtaccgg

SEQ ID NO: 222715 - DNA, 846 bp, Homo sapiens
  misc_feature: GYAE6OF01C3LQU.35.70.G04.1.454.CMB.1.raw
tcagtacagatcgtcacgaccggtgctcgatttagtgtagtgtgaagggaaaggggctgagagaggagcccagcccgtgggattttcaggttgttttcatttggtgaacaggactgaacagagagaagtcacatggagtttggctgagctggtctttttcttggtggtacttaagttttaaaaggtgtacctagtggtgtaggtgcagtcgtggtcgggtaggttcggtgggggaggtccgttagggtaaccgtacggtcccgggttcgggggggttcccctagggaacggtacggttccgttccgttggttcggccgacggtcccgttacgtacgggtacgttaccctaacgttaggtaggttaccgtacgtttaagcggtacaggtacggaacggtccggttaccggggtccccgacggtaacggtcccgttaccggggaacgggggccggggtcggttacggggtacggttcggggttccctttacggttttaccgttaagtttacggtcgtaccggttaggtaccgggttaaggttaaacggtaaggaacgtaaccgtaacggccgtaagtaccgtttcgtaacggtagggtaaccgggttcccggttaataccgtacgtacgtcccgtaccgggtaaggtaaccttaaaactaccggaaggtacgtaccgttacggtacgtaaccgtagaactaaagtacgaaaccgcggtacgggtaacggacggtacgaacggaccgtacgggtaaccctagttaacgtcgtgacgacgtacgtacgtcgtacggcggtacggttaccctacgttaacgacgtagtaaccgttaaggtttcggttacgg

SEQ ID NO: 222716 - DNA, 768 bp, Homo sapiens
  misc_feature: GYAE6OF01BEAG0.35.70.G04.1.454.CMB.1.raw
  modified_base (530)..(530): a, c, t, g, unknown or other
  misc_feature (530)..(530): n is a, c, g, or t
tcagtacagatcgtcacgaccggtgctcgatttagtgtagtgtgaagggaaagggctgagagaggagcccagccctgggattttcaggtgttttcatttggtgaacaggactgaacagagagaagtcaccatggagtttgggctgagcgtgtcgttttctaggtggcttaagtttaaaaggtgtcagtgtgaggtgcgagctggtcggagtcggtgggggagtcgttcggtaacgacggtccggttcggggggtcccctggacgtacggttccgtcccgttggtcgaccgtacggtcccttcggtggacgtcctaaccgttgaagttacgacgttagtggactagtcggagtccggtcgggtccgaccggacggtccgtccgggaacggggccggggtcgtggggtacggttcgggttccgtttacgtttccgttaagtttaggtcgtacggttaggttcggttcggtaccttcgaacgtactaaccgtacgacgacgtaccgttgtcggtaggaaccgggtccgttacnccgtctacgagtacgacaacttaccgaaagtccctaccgttagtaactcgtacgaaccgtaaagtacgaaacctcgaccgtaaggacgtaccgacccgtaacgacgtaccggtacttaacgtcttaacggtcgtaaggtaacccgtaaaagttgggaacccggttaaagggtacgggtaaacgggtttacgttaacccggttaccggtaattcccgggttagggtcccggggtacccg

SEQ ID NO: 222717 - DNA, 880 bp, Homo sapiens
  misc_feature: GYAE6OF01B7U6Q.35.70.G04.1.454.CMB.1.raw
tcagtacagatcgtcacgaccggtgctcgatttagtgtagtgtgaagggaaaggggctgagagaggagcccagccctgggattttcgaggttgttttcatttggtgaacaggactgaacagagagaagtcaccatggtagtttgggctgagcgtggtctttttcttaggtggtcttaagttttaaaaggtgtcctagtgtgaggtgcagtcgtgtcggagtcggtggggaggtcgttggtacagtccggtcggggggtccctaggacgtacggttccgtccgttggttacggccgtaacggtcccgttaccggtgggtaccgttaccgacccgttttaggaaggttaacggtacttaaggttggtccgaagttgggaaccggtccgggttacgggtccccggaccggtaacgggtcccggtaccgggtaaacggggggccggggtaccggttgggggaagggttcggggttacctttccgtttacgttaaaccggtttggtgttaccgtaaggttcgggttacggtcctaccgaactaacttacccgtaacggtaccacgtaaccgttcgtacgggtaacgggttaaccggggtacccggttacccgtacccggtacctaccgtaacgacggtaaacctaaacttaacccgaaacgtaaccctaaccgttcgttacctactacgaactaacgtaacgaaccgtacgacctacgggaacgaccggacccggaacgtaacccggacgggtacccttaattaccggttaagtcggttaacggaacggttaaaacgttgggaaaccggttaagggtaaaccgggggtattaacggggttaaccgttacggtaccgtttcggtccgggttccggggttacccggg

SEQ ID NO: 222718 - DNA, 870 bp, Homo sapiens
  misc_feature: GYAE6OF01EAKF3.35.70.G04.1.454.CMB.1.raw
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (189)..(190): a, c, t, g, unknown or other
  misc_feature (189)..(190): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagtacagatcgtcacgaccggtgctcgatttagtgtagtgtgaagggaaaggggtctgagagaggagcccagccctgggatttttcaggttgttttcatttggtgaacaggactgaacagagagaagtcaccatggagtttgggctgaggcggtcgtgttctaggcgctaattaagncntgngngtnngctgngngtgngggagctgtacngcgtcggggtcctgagngtcctcgtgtgctcgtcctcgtggactaccttaccgttgaacgtcgtaacttgcgcctaggacggagttcgggtcccggtccccggaaccgtacgggtccccgtaaacccgggggggacgggggtaccgggtacggggtacgggttcgggtttccggttacccgtttcggtttaacgtttaggtttacggttaccggttacgggttcgggtttccggttaccggttacctaaccgttaaaccgtaaccgttaaccgtaccggtaacgttaaccgttcccgttaaggttaccgggaccggggtttaaccccggttacccgttaaccccggttacccgttaacccggtaacgtaaccggttaaacctaaacccgtaaaccctaaacccggtaaaccgtaaccccgttaaccttaaccgttacccgttaaacgtaccgtaaaccggaaaccgttaacggaacgtaccgtaccggtaacgacccggtaacccgtaacccggaccggtaaccgtaccgttaaccgttagttaaccgttacggtagttaacggtaaacggtaccggttagggttaacggtaaacggggttcggttaaccgtacggtttacctacggtaccggttccggttaccgggtccggtccgg

SEQ ID NO: 222719 - DNA, 755 bp, Homo sapiens
  misc_feature: GYAE6OF01BXOTR.35.70.G04.1.454.CMB.1.raw
tcagtacagatcgtcacgaccggtgctcgatttagtgtagtgtgaagggaaagggctgagagaggagcccagcccgtgggattttcaggttgttttcatttggtgaacaggactgaacagagagaagtcaccatggagtttgggctgagcgtgtcgttttcgttaagtggtcttaagttttaaaaggtgtctagtgtgaggtgcagctgtcggatcgtggggagtcgttgtactgcgtcgggggtccctagagacgtctccgtgtgcagcctcgtggacgtccacgttgagtagctagtggctagtcgagtcgtcgggacccgtaccgaggccgtacccgagggggtaccgggtcgtgggtaggttcggttctccgtttgtacgttaaggtcgttaaccgtggttccggtggtacctaccgtaacgtaacgttaccgaacgactaacggtaccgttgtacggtacgggtaaccgggtaccggttaccgtaacccgttctaccgaaacggactaaaccgtaacgttaacccggaaaacgtaacccctaccgttagtaactaccggttaacaagtaaacctcggaaactacgttacccgaagaacgtacccgggaaccgtaaccgaaccgttaacccgggtactaacgttaccttgtaccggtaagaaacccgtaaggttaccggaaacggttaaacgggttacggtaacggttacgtttaaccgtacggatttaccgtcgggtacggggtaccccg

SEQ ID NO: 222720 - DNA, 643 bp, Homo sapiens
  misc_feature: GYAE6OF01DCSHS.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtggcttattttaaaaggtgtccagtgtgaggtgcagctgtcggagtcgtgggggaggcttggtacagccgtcgggggtccctggagagtctcctgtgcagcctcgtggagtccaccgtttgaagttagcttagtggcatgagctcgggtccgccaggcctccgaggggacgggcgtggagtgggttcctcgttctagtttagtgacgttaggtcggttggttctcacgtatacgtacgcacggtactcgtaggtagaacggggtccgttacacccggtctcccgagtacgactaacttaccgaaacgaccctacccgtagtacctactcgaactaaacgtcgaaacctcgacccgtaggaacgtaccggacccgaacgacccgtaccggcgttaattacgttacgtgtagaacgtaaagttcgggaacgtaaggaggggtaagttcggttacgtacgtagtccgtcggtggggtcccgg

SEQ ID NO: 222721 - DNA, 883 bp, Homo sapiens
  misc_feature: GYAE6OF01CWUXD.35.70.G04.1.454.CMB.1.raw
  modified_base (238)..(238): a, c, t, g, unknown or other
  misc_feature (238)..(238): n is a, c, g, or t
  modified_base (322)..(322): a, c, t, g, unknown or other
  misc_feature (322)..(322): n is a, c, g, or t
tcagtacagatcgtcacgaccggtgctcgatttagtgtagtgtgaagggaaaggggtctgagagaggagcccagccctggattttcaagtgttttctatttggtgaacaggactgaacagagagaagtcaccatggtagtttgggctgagctggtctttttcttgtggtcttaagttttaaaaggtgtccagtgtgaggtgcagctggtcggagttcggtgggggagtcgttggtacncggcccggttcggggggtccctggagtacgttcctccgtgtcgcacgtcctcgtggacgttcctaccgttgagttacgcttagnggactagtggacgcggttcggggccccgaccgagggtcccgaccggacgggggaccggggtcgttggggaggtttcgggtttcccttccgtttacgttaggttttacggtgtacggtttacggttgggttcgttcgtacaactacgttaaccgtaccgacgtacgtaccgtttcggtagggttaccgggaacggggttcccgtttacccgaacccggttccgtaccggaacgtaaacacttaaaccttacccgaaacgtaaaccccctacccgtttggtaactaccctaacggtaaataaaccgtaacggaacctacgggtaacccgttagggaaacccggaccgggaccccggaaaccgaccggtaaacccgggtaccctttaattaaaccggttttacccgagggttaaaccggaaaccggttaaaaaggtttcccggggaaacggtttaaaaacggggtttcgggggggtaaaaacccggtttttacgggttaacccctttaacgggttacccggtttaccccgggttcgggggttcccgggggggttaacccccggg

SEQ ID NO: 222722 - DNA, 816 bp, Homo sapiens
  misc_feature: GYAE6OF01AF7N3.35.70.G04.1.454.CMB.1.raw
  modified_base (350)..(350): a, c, t, g, unknown or other
  misc_feature (350)..(350): n is a, c, g, or t
tcagtacagatcgtcacgaccggtgctcgatttagtgtagtgtgaagggaaaggggtcgtgagagaggagcccagccctgggattttcaggtgttttcatttggtgaacaggactgaacagagagaagtcaccatggagtttgggctgagctggtctttttcttgtggtcttaatttaaaaggtgtcctagtgtgaggtgcagcgtggtcggagtcggtgggggaggtcgttcgggtacgacggtcccggttcgggggggtccctggtacgtacggttccttccgttggtcggaccgacggtcccgttcgtcgggtactaccgtaccgtttaggaggttacgtcttaagnggtactagtcggtacggtccggtcggggtccccgtaccggtacggtcccggtaccgggacggggggaccggggtcgttaggggtacgggttcgggttcctttacgtttaccgttagtttacggtcggttacggttaaggtttcgggttccggttacctacgtaaccgtaacttaaccgtaccgacgtacgttaccgttcgtaggtacgggacccgggtccgttcccgaccgttcccacgacgacgtaaactacgttaccgaaactacccgtacccttagtaactccgtacaaccgtaatacggaactacgtaccgtaggaccggtacggaacccgacgtaccggaccgttactagttacgttcgtacgggtagaaaccggtaaggttacggggaacggtaaccgggttaggggttaaatttccggggtaactttaccgggagttttccggtcgggtcgggtcccgg

SEQ ID NO: 222723 - DNA, 648 bp, Homo sapiens
  misc_feature: GYAE6OF01BT1XV.35.70.G04.1.454.CMB.1.raw
  modified_base (226)..(226): a, c, t, g, unknown or other
  misc_feature (226)..(226): n is a, c, g, or t
  modified_base (307)..(307): a, c, t, g, unknown or other
  misc_feature (307)..(307): n is a, c, g, or t
tcagtacagatcgtcacgaccggtgctcgatttagtgtagtgtgaagggaaaggggtctgagagaggagcccagccctgggattttcaggtgtttcatttggtgaacaggactgaacagagagaagtcaccatggagtttgggctgagcgtgtcgtttctaggtggctaatttaaaaggtgtccagtgtgagtgcagctgtcggagtcgtggggagcgttggtacngccgtgggggtcctgagagtctcctgtgcacgcctcgtggacgtcaccttgagtagctagtggctatgacgtcgtcggccncgtaggcctccggagggcggcgtggagtggtactcttctaagttcgtgtcgtagtggtcggtctacactagtactacgctaagtctcgtagtacggaacgggtccgtttaccgaaccgtcgtaccgaggtaacgacctaaacttccgaaaacgaaccctaccccgttagtacctacgggtacaacgtaaagtcgaacctaggcctaggaaccgaccgtaccgaacggacgtacgggaccttaagtaccgttacgtacgtaaggtacgtaaaagttcgggaacttaacgggacggggttaataccgggttacttacggtgtaccgtgggtccgggtacccgg

SEQ ID NO: 222724 - DNA, 788 bp, Homo sapiens
  misc_feature: GYAE6OF01CVMGT.35.70.G04.1.454.CMB.1.raw
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
tcagtacagatcgtcacgaccggtgctcgatttagtgtagtgtgaagggaaagggtctgagagaggagcccagccctggattttcaggtgttttcatttggtgaacaggactgaacagagagaagtcaccatggagtttggctgagcgtggtctttttcttgtggtcttaagttttaaaaggtgtccagtgtagaggtgcagcgtgtcggagtcgtggggagtcgttggtacgagccgtgggggtccctgagtacgtctccgtgtgcacgcctcgtaggacgtccgtaccgttgagtagcgtagtggacagtgacgcgtcgggtcccgcgacggccgtaccggacggggaccggngttgggacggtcgggtcncgtacgtcgttaggttggaagttgttgtttagtttaanagtatagttacgaggacggtacggtggggtcggggactacgttaccaccgtacgtcctacgaagtaccgaaaccgaaccgtaaccgaaacgaaccgtacgaacgtttacgtttacacggaaacctaaaggttaaccgaaacgtcccgtaccggtacgaaccgggtaaacggaaccgggtaacgggaacccgtaacgggtttgtacggtttaacggtttaacgttacccggtagggttaccgggaacgttaaggggtaacggttacggggtaaccggggtaccccggttaccggggtttacccccccgggtttaaccccccggggtttaagggtcccggggtaaccccgggtttggggtcccgggggtaaaaccccgg

SEQ ID NO: 222725 - DNA, 813 bp, Homo sapiens
  misc_feature: GYAE6OF01CDHKH.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtgcttaatttaaaaggtgtcagtgtgaggtgcagctgtcggagtcgtgggggaggtcgttggtacgaggccggtggggggtccctggagacgttctccgtgtcgccagcctcgtggacgtccaccgttgagtagcttagtggctagtgagtcgtcggggtccgccgacgggcctaccggaggggaccggggcgtgggtacggttcgggttcctttcgttcgttaagtttacggtgtaccgttaggttcgggttcggttcctcgtaactaacgttaccgtaacgcgtaacggtaccttcggttagggtaacgggtaaccggggttcccgggtttaccaccccggttaccctaccgtaaggtaactaaacgtaaacttacccgaaaacgtaacccctacccgttagttaacctccgtacgaacctaaagttaccggaaacaccgggtactaagggaaccggtaccgacccggaaccgaaccggtaccgggttaccgttaaatttacgttaaccggttcgggagtaaaaccggttaaaaggtttcggggaaaccggttaaacggggtttacgggggtaaaacggttttccgggtttaaaccggtttaccggtaaggttttaccggtccgggggttccggggggtaccccggg

SEQ ID NO: 222726 - DNA, 785 bp, Homo sapiens
  misc_feature: GYAE6OF01AHKDA.35.70.G04.1.454.CMB.1.raw
  modified_base (152)..(152): a, c, t, g, unknown or other
  misc_feature (152)..(152): n is a, c, g, or t
  modified_base (234)..(234): a, c, t, g, unknown or other
  misc_feature (234)..(234): n is a, c, g, or t
tcagtacagatcgtcacgaccggtgctcgatttagtgtagtgtgaagggaaagggctgagagaggagcccagccctgggattttcgaggttgtttttcgatttggtgaacaggactgaacagagagaagtcacatggtagtttgggctgagngttggtctttttcttagtggtacttaattttaaaaggtgtccagtgtgaggtgcgagcttaggtccggagtcggtagggggngtcgttaggtacgcggccggttcgggggtccctaggagtacgtccgtccgtggtcgccgcgtccgtcgtaggtacgtaccgtaccgtttggacgttacggtactagtacggtacaagtcggacggtccggtccggggttcccgaccggtaacggccggttacccgggaagggggtcggggtcgtcgggtaggttcgggttctttcgtttacgttagtttaggtcgttacggtaggtttcggtcgttacctacgaactacgtacgtacgcgagtctcgtgacggtacgtccgtcacgttcacgagtaacacgtaactaaccgaacgtaacctccgttagtactaccgagaaccaagtacgaaccgtacgcgtaaacggacgacccggtaccgaaaccgacgttaaacccggtacgtttaacgttaacttaccggttaggttaagaaaccggtttaaaggtccgggtaacggttaaacggggttacgggttaacggttaacccggtttacttaaccggttcggtaccgttccggggtcccggggttacccggg

SEQ ID NO: 222727 - DNA, 654 bp, Homo sapiens
  misc_feature: GYAE6OF01B8VNM.35.70.G04.1.454.CMB.1.raw
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
tcagtacagatcgtcacgaccggtgctcgatttagtgtagtgtgaagggaaaggggtctgagagaggagcccagcccgtgggtattttcgaggttgttttctatttggtgaacaggactgaacagagagaagtcacagtggtagttggctgagcggtgtgttcgagtcgactaagttaaggtgacngtgtgagcagctgtgcgntggngggtgacgtgctcgacggtcgggttccgngcgtactcgtcgtncgcgacgttcgtggacgtcgtacgtagtaggtacgtagtacgtcgngtacgtagtcgcggtcggtcggtccgtcgcgacggacggtacggtacggtacggtcggtacggtcgtcgttacgttacgtagttacgtacgtacgtcggtacggtcgtacgtacgtacgtacgtacgtacgtacgtacgtacgtacgtacggtacggtacggtcgtaccgtacgtacgtacgacgtacgtacgtactaacgtaactacgtactacgtactacgtacgtacgacgacgacgtacgtacgacgacgacgaccgtacgtacgtacgtacgtacgtacgtacgtacgtacgtacgtacggtacggacggtacggtagtacgtacgtacgtacgtacgtcgtcggtcggtcg

SEQ ID NO: 222728 - DNA, 867 bp, Homo sapiens
  misc_feature: GYAE6OF01BR93Z.35.70.G04.1.454.CMB.1.raw
tcagtacagatcgtcacgaccggtgctcgatttagtgtagtgtgaagggaaaggggtctgagagaggagcccagccctgggattttcaggttgttttcatttggtgaacaggactgaacagagagaagtcaccatggtaggtttgggctgagtcgttggtctttttcgttggttggtacttaagtttttaaaaagggtcgttcctaggtggtggtagggtgtcgaggtcgtggtacgggtggttcggtggggggaggtcgttagggtacgacggtccggtcgggggggttcccctgggagtacgttccttccgtggtcgacgtacgtccttcggtggtacgtacctaccgttggtagtagacgtagtggacgtagtggacgtccggttacgggtccccgccggtacggtccgtaccgggacgggggcgggtcggtgggtacgggttcggttcttcgtttacgttagttaggtcggtaccgttaggttcggtcggtactacctaacgtacgttaaccgtacggaacctacggtaccttggttacggtaaccgggtaccgggttcccggttaccgtacccggttaccgtaccgtaacggtaaccgtaaactaacgttaacccaaaaccggtaacaccccgtttaagttacctacgtaacgtaacgtaaacggactaaaccgtaacgaacccgtaacgggtaaccgaccggtaaccccgaccgtaacgggtaaccggttaccgttaaacgttacgttaccggtaggtaacgtaaacggtaaacgggttaccgggtacgtaacggggtaacgggttacgggtacgtttaacggtttacgacgtttccgggtacggggtccgggtacccggg

SEQ ID NO: 222729 - DNA, 900 bp, Homo sapiens
  misc_feature: GYAE6OF01CG5PU.35.70.G04.1.454.CMB.1.raw
tcagtacagatcgtcacgaccggtgctcgatttagtgtagtgtgaagggaaaggggctgagagaggagcccagccctgggtatttttcaggttgttttcattttggtagaacaggactgaacagagagaagtcaccatggtaggtttgggctgagcttggttcttttttcgttgttggtactttaaagtttttaaaaggtcgttaccgtagttgtgtaggtgacagtcgtggtcggtagtcggtgggggaggtctttagggtacgacggtccgggttccggggggttccctaggaacggtacgttcccgttccgttggtacgccgacggtcccgttcggtcggtacgttacccttaaccggtttaggtaaggttacgtaccgtttaggtcggtactaggttacggtacggtcccgggttaaccgggtccccgggaccggtaccgggtcccggtaacccgggggacggggggtaccgggtccgggttagggtacggggtttcggtttacctttccgttttagtttacggtttacggttcggtaacgggtttggttccggttcggttactaaccgtaacttacgtacgtaccgtacgtacgtacgttcggtaacgggtacgggtaccgggttaccgtaccgtcctacgacgtaacgtaactaaacctaacctaaccgaaacctacctccgttagtacgtaccaagaacttaaacgaccgtaacgacgtaagacggtaaccggacccgtacccggaaccggaccgtaaccgttattaacttacggttacgaggttaaacgtaaaggtaaacgggttacgggtaaacggttacggggttacggttaaacggttcgtttaaaccgttggttaccccggttggtcccggggttccgggtaccccgg

SEQ ID NO: 222730 - DNA, 944 bp, Homo sapiens
  misc_feature: GYAE6OF01A1MSP.35.70.G04.1.454.CMB.1.raw
tcagtacagatcgtcacgaccggtgctcgatttagtgtagtgtgaagggaaagggtctgagagaggagcccagccctgggattttcaggttgttttcatttggtgaacaggactgaacagagagaagtcaccatggagtttgggctgagctggtctttttcttgtggtcttaagttttaaaaggtgtccagtgtgaggtgcagctgtcggagtcgtggggagtcgttggtacgaggtccgtcggggggtccctggtacgtacgtcgttccgtgtcgcgacgcctcgtggtacgtccaccgtttggagtagccgttaagtcggactagtagacggtccggttacggggtccccgaccggacggtcccgtacccgggaagggggtccggggtcgttacggggtacggttcggggttccttacgtttccgttagtttaacggtcgtcgttaggtggtcgttacctacgtacgtattaacgtaccgtacgtaacgtaccgtcgtaggtacggtaacgggtccgtttacgaccgtccgttacgagtacgaactaacgttacccgaaagtaacccaccgttatacgtaccgtacgtaacgtaaacgttcgaaccgtacgtaccgttaacggaacggtaacccggtaccccggtaaaccgggtaacccggttaccccgggtacccgtttaaaacggtttttacccggttaaacgggtttacccggtaaacccgggtttaaaaccggggtttaaaaccggttttaacccccgggtaaaaacgggtttaaccggggttttaaccccggggttaacccccgggggtttttaaacccgggggtaaaacccccgggggttaaaccccgggggggttttaaaaaaccggggggggtttcccccgggggtttttaaaaaacggttaacccgggggtttttaaaaaccccccggggggg

SEQ ID NO: 222731 - DNA, 968 bp, Homo sapiens
  misc_feature: GYAE6OF01B2SS5.35.70.G04.1.454.CMB.1.raw
tcagtacagatcgtcacgaccggtgctcgatttagtgtagtgtgaagggaaaaggggctgagagaggagcccagccctgggattttcaggtgttttcatttggtgaacaggactgaacagagagaagtcaccatggagtttgggctgagcgtggtctttttcttggtggtcttaagtttttaaaaaggtgtaccagttgtgtaggtgcagtctggtcggagtcgtgggggagtcgttggtacgaggtccggtcgggggtccctggagacgttccttccgtggtcgccgacgtcctcgtggacgttcctaaccgttggtaacggttacgtacgttaacgtcggtactagttggacggtccggttccggggtaccccgtcccggtaacggggtcccgttaccggggaacgggggggtaccgggggtacgggtaggggtaacgggtttcggggttcctttaccgttttacgttaacggttttaggttacggttaccggtttggttacggggtttcggttaccgttaccgaacctaacgttaaccgtaaccgcgtaaaccgtacgttacggttagggtaccggggtaaccggggttacccgtttacccgtaccccggttacgtaaccggaaggttaaaccgtaaacccttaaaaccgttacccgaaaaacgtacccccttaccgtttaaaggtacctttaccggaaccgtaaactaaacgtacggtaaaccgtcccggtccgtaacgggaaacgtaaccccgggacccgtaaacccgggaacccggttaaccggttacccgtttaaagtttcgttaacgggtttaccggaaaccgggttaaaggttttaaaaccggtcggggtaacccgggtttaaacggggtaacgggggttaaacggttttaccgggtttaaacccggtttccgtaagggttttcccccgggttaacgggggtcccggggtaaccccggg

SEQ ID NO: 222732 - DNA, 688 bp, Homo sapiens
  misc_feature: GYAE6OF01A00R7.35.70.G04.1.454.CMB.1.raw
  modified_base (420)..(420): a, c, t, g, unknown or other
  misc_feature (420)..(420): n is a, c, g, or t
  modified_base (510)..(510): a, c, t, g, unknown or other
  misc_feature (510)..(510): n is a, c, g, or t
  modified_base (604)..(604): a, c, t, g, unknown or other
  misc_feature (604)..(604): n is a, c, g, or t
tcagtacagatcgtcacgaccggtgctcgatttagtgtagtgtgaagggaaaggggtctgagagaggagcccagccctgggattttcaggttgttttcatttggtgaacaggactgaacagagagaagtcaccatggagtttgggctgagcgtgtcttttctagtggtctaattttaaaaggtgtcagtgtgaggtgcagctggtcggagtcgtgggggaggcgttggtacgaggccggtggggggtccctggagaggtcctcctggtcgactacgtccgtcgtgggacttcctaccttggagtagtctagtggctagtggacgtcgtcggggtccgccgaggccgtaccggaggggcgggcgtagggtcggtgggttctcttcgttagtttacgtgtcgtggttggtcgtactcgtaanacgtactaccggataacgtctacgtggtaccgggtaacgggtccggttccaaccgttcccgacgaacgacgaactaacgttaaccgaaanaaaccctcccgttaggtacttctaacgaacctaaagtacgaaacctacggaccgacggagaacccggtaccggaacgaccggtaccggtacctnttaaacgtcttaggacgtaacgtaaagtcggaaacggtaggtacgggtagttggttactacgttagtcctagggtcgggtccgg

SEQ ID NO: 222733 - DNA, 783 bp, Homo sapiens
  misc_feature: GYAE6OF01B1872.35.70.G04.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
tcagtacagatcgtcacgaccggtgctcgatttagtgtagtgtgaagggaaaggggtctgagagaggagcccagccctgggtatttttcaggttgttttcagtttggtgaacaggactgaacagagagaagtcacatggagtttgggctgagtcgttgggttttcctcggttgacttacgttttaagaggttcgtccgagtgtcgaggtnacagtcgtaggnggagtcggtgggggagcggtggtaccagccgtgggacgtcctgacgtacctcgttaccgtgtaggaacggctttagacggtactttcgaacttcgttaactaataaccgtagtcggatacgtcgacgtacggtcggacccgcgacggtcctaccgaaggtacggtaacgggtacgtaggggacgttgggttaccggtagttaaggttcgggttggttacggttagttaggaagttaagggaagttaaagtaactaagttactaagtgaacctaaggtaaccccgtaagggtgggaaacccgggtcctaaccgttaccgaccgtaacctaccgtaacgtaacgaacgtaaacctaaccgttaaccgtaaactttaaccgtacccgttttaacgttaccgtaagaaacttaaacgtaccgaaacgtaccgtaccggtaggaacggacgtaccggaacggaccgacggtaacgtaacgtttaatacgttaacgtggtacggtaaggaaacgaggacggtacggtacgggacccttaacccgggaccctaaggtccgtaaccggg

SEQ ID NO: 222734 - DNA, 1112 bp, Homo sapiens
  misc_feature: GYAE6OF01CD0RJ.35.70.G04.1.454.CMB.1.raw
tcagtacagatcgtcacgaccggtgctcgatttagtgtagtgtgaagggaaagggtctgagagaggagcccagccccgtgggtattttcaggttgtttttctagtttgggtcgaaacaggactagaacagagagaacgtccacagtggtaggttggctgacgtcgttggtttcctttttgttgtcggtacttttaaaagtttttaaaggtcgtacctaggttcgtaggtacggtcgacgtagtcgttacggtacgggtacggttcggggtacgggggtacgtccgtttaggacccgtacgggtccgggggttaccgggggtccctagggtacggtacgtttccgtccggttacggcgtaccgacggttccgttcgtacggtaccgttaccgtacgttaggtacgtacgtagttacgtcggtacgtcggtgtacggtccggttacccgggcccgtaccggaccgggtacccggaaccgggggtaccgggggtaccgggtacggttacggggttacgggtttcccgggtttaccgtttaccgttttaacgtttacggttttacggttaccggtttcggggtttacgggtttccgggtttaccgttaacgtaacccgttaaccgtttaaacccggttaccgtaacccgtaacggttaccggttaaccggtttaccgggtacggggtttaaaccggggttaccccgggtttaacccggttaaccccggttaccccggttaaccggtaaccgtaaaccgggtaacccgttaaacccgtaaacccggtaaacctaaaccccgttaaccccgttacccgttaaccgttaaccgttaccgttaaacgtaaacccgttaaaaccggtaacccggtaaccgtaaccggtaaaccggtaaccggaacccggaacccgggtaaccggtaaacccggaccggttaaccggtttaacccgtttaacggttaccgttaccggtaaacggttaaaccgggttaaacgttaaaccggggttaacggtaaaccgggttaaacggggttaccgggtttaaacggttacggtttaacccggttaacggttacccgggttcccgggttacggggttaccccgggttacccggg

SEQ ID NO: 222735 - DNA, 773 bp, Homo sapiens
  misc_feature: GYAE6OF01AXY1C.35.70.G04.1.454.CMB.1.raw
  modified_base (761)..(761): a, c, t, g, unknown or other
  misc_feature (761)..(761): n is a, c, g, or t
tcagtacagatcgtcacgaccggtgctcgatttagtgtagtgtgaagggaaaggggtctgagagaggagcccagcccgtgggtattttcaggttgttttcatttggtagaacaggactgaacagagagaagtcacatggagtttgggctgagcgtggttctttttcgttgtggtacttaagtttttaaaaggtcgtacctaggttggtaggtaggtgcgtacgtcgttggtaccgggtaggttcgggtagggggacggttcggttcgggtaaccgtacggtcccggggttcgggggggtccccttaggaacggtacggttccgttccgttaggtccgaccgtcgtcccgttgtacgggtaaccgtccgtaaccgtttggaacggttacgccgttaaggtcggactaagttcggacgtccggttcgggccccgacggtacggtcctaccgggaaggggtcgggtcggtgggtacggttcgggtcgtttacctttcggtaatttacggtcgtcgttaggtcggtcgtactacaatacgtacgtacgcgtactcgttgtaggtacggtacggtccgtccgtacgtccgtacagtactaactacgttaacccgaagtacccacgtacgtactaccgtagaactacgtaagacgtacgcgtaacggacgtaccgaccgaaccgaccacggtacctaagtactacgtgtacgtaaacgtaacgtaggaacgtaagggtacggtagtacgttacgtagttacgtacgnggttccggccgg

SEQ ID NO: 222736 - DNA, 791 bp, Homo sapiens
  misc_feature: GYAE6OF01CE2FR.35.70.G04.1.454.CMB.1.raw
  modified_base (742)..(742): a, c, t, g, unknown or other
  misc_feature (742)..(742): n is a, c, g, or t
tcagtacagatcgtcacgaccggtgctcgatttagtgtagtgtgaagggaaaggggtctgagagaggagcccagccctgggtattttcgaggttgttttcatttggtgaacaggactgaacagagagaagtcacatggagttggctgagctggtcttttctgtgtcttaagttttaaaaggtgtccagtgtggaggtgctagtcgtggtcggtaggtcggtgggggagtcgttaggtacgaggtcccgggttcgggggtcccttaggacgtacgttcctccgtgttcgcgacgtccgttcgtagggtaccgttaccgtaccgttacggtaacgttacggtacgttaacggttcggacctaaggttacggtaacggtacccgggtttcccgggggtaaccccggccggttaaccgggcccggttacccggggaacggggggtaacccggggtcggttaggggtacgggttcggggttcctttaccgtttacgtttaacgttacggttcgtacggtttaggtcgggttacgttcgtacgtacgtacttaacgtacgacgtacgtactacggtaggtacggtaccggtccgtaccgtacccgtactaccgaagtacgtaactaacgtaaccaacgtacgtacccagttctacgtagaacctaagtcgaacgacgtcgtaacgagaaccgacggactaacggcccggtacttagttaactacgtaggttacgaaacgtttaacggngtaacggacggtaggtaggtcgttacgtctggtcgtgggccggttaccg

SEQ ID NO: 222737 - DNA, 534 bp, Homo sapiens
  misc_feature: GYAE6OF02GHKPB.35.70.G04.1.454.CMB.1.raw
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcgtgcgtttctagtggctatttaaaaggtgtcagtgtgaggtgcagctgtcggagtctgggggaggcttggtacagcctggggggtccctgagagtctcctgtgcagcctctggagtcaccttgagtagctatggcatgagctgggtccgccaggctccgagggacggggctgggagtgggtctcttcgtattagtgctagtggtggtctcacatactacgcagactctgtgaagggccgttcaccgtctccagagacaattccaagaaccaccctgtatctgcaaatgaacagcctgagacgccgacgacaacggccgtaatacttactgtgacgtaaaattggacgaacgtggggaagtggtacttcggatctacgtgggtccg

SEQ ID NO: 222738 - DNA, 541 bp, Homo sapiens
  misc_feature: GYAE6OF02H8V02.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggcgttttcttagtggctattttaaaaggtgtccagtgtgaggtgcagctgtcggagtctgggggaggcttggtacagcctggggggtccctgagagtctcctgtgcagcctctggagtcaccttgagtagctatggcatgagctgggtcccgccaggctccaggggacggggctgggagtggggtctcttctattagtgctagtggtggtctcacatactacgcagactctgtgaagggccggttcaccgtctccagagacaatccaagaacaccctgtactctagcaaatgaacagcctagagagccgacgacacggccgtaatattactgtgacgaaattggacgaacgtgggaagttggtacttcggatcgtcgtggggtcccgg

SEQ ID NO: 222739 - DNA, 542 bp, Homo sapiens
  misc_feature: GYAE6OF02IRKGS.35.70.G04.1.454.CMB.1.raw
tcagtacagatcgtcacgaccggtgctcgatttagtgtagtgtgaagggaaaggggctgagagaggagcccagccctgggattttcaggtgtttcatttggtgaacaggactgaacagagagaagtcaccatggagtttgggctgagctggcttttcttgtggctattttaaaaggtgtccagtgtgaggtgcagctgtcggagtctgggggaggcttggtacagcctggggggtccctgagagtctcctgtgcagcctctggagtcaccttgagtagctatggcatgagctggggtcccgccaggctccgaggggaccggggctgggagtggggtctcgttctattagtgctaggtggtggtctcacatacctacgcagactctgtgaagggccggttcaccgtctccagagacaattccaagaacaccctgtatctgacaaatgaacagcctagagagcccgagaccacggccgtaatattactgtgcgtaaaattggcgaactgggggaagtcgggtacttcgatctcgtggggtcccg

SEQ ID NO: 222740 - DNA, 542 bp, Homo sapiens
  misc_feature: GYAE6OF02IKKKS.35.70.G04.1.454.CMB.1.raw
tcagtacagatcgtcacgaccggtgctcgatttagtgtagtgtgaagggaaaggggctgagagaggagcccagccctgggattttcaggtgtttcatttggtgaacaggactgaacagagagaagtcaccatggagtttgggctgagcgtgcgttttctaggtggctattttaaaggtgtccagtgtgaggtgcagctgtcggagtctgggggaggcttggtacagcctggggggtccctgagagtctcctgtgcagcctctggagtcaccttgagtagctatggcatgagctgggtccgccagggctccgaggggacggggctgggagtgggtctcttctatagtgctagtggtgtctcacatactacgcagactctgtgaagggccggttcaccgtctccagacgacaatccaagaaccaccctgtactctgacaaatcgaacacgcctagagagccgacgacacgccgtaatattactgtacgacgaaaattggacgtaacgtggggaaagtggtacttcggattcgtcgtgggcccgg

SEQ ID NO: 222741 - DNA, 542 bp, Homo sapiens
  misc_feature: GYAE6OF02F6LK8.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagcctggggggtccctgagagtctcctgtgcagcctctggagtcaccttgagtagctatggcatgagctgggtccgccaggctccgaggggacggggctgggagtgggtctcgttctattagtgctagtggtggtctcacatactacgcagactctgtgaagggccgttcaccgtctccagagacaattccaagaaccaccctgtactctgaccaaatgaacagcctgagagccgacgacaccggcgtactattactgtgacgaaattggacgtaacgtggggaagtggtacttcggtatcgttcgtcgggtccgg

SEQ ID NO: 222742 - DNA, 526 bp, Homo sapiens
  misc_feature: GYAE6OF02G7GQ5.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagcctggggggtccctgagagtctcctgtgcagcctctggagtcaccttgagtatctatggcatgagctgggtccgccaggctccaggggacggggctgggagtgggtctcttctattagtgctagtggtggtctcacatactacgcagactctgtgaagggccgttcaccgtctccagagacaattccaagaacaccctgtactctgcaaatgaacagcctgagagccgacgacacggcctatatactgtgcgaaaattggacgaacgtgggaagtggtacttcgatctcgtgggtccg

SEQ ID NO: 222743 - DNA, 559 bp, Homo sapiens
  misc_feature: GYAE6OF02FX8ZD.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggcttttcttgtggctattttaaaaggtgtccagtgtgaggtgcagctgtcggagtctgggggaggcttggtacagcctggggggtccctgagagtctcctgtgcagcctctggagtcaccttgagtagctatggcatgagctgggtccgccaggctccgaggggacggggctgggagtgggtctcttctattagtgctagtggtggtctcactatactacgcagactctgtgaagggccggttcaccgtctccagacgacaattccaaagaaccaccctgtactctgacaaatgaacagcctagacgagccgacgacgaccgaccgtaatacttactgtagacgtaaagttggacgtaacgtaggggaagttcggtacgttacgagtccgttcggtggggtcccgg

SEQ ID NO: 222744 - DNA, 606 bp, Homo sapiens
  misc_feature: GYAE6OF02G8B7K.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggctttttcttgtggctattttaaaaggtgtccagtgtgaggtgcagctgtcggagtctgggggaggcttggtacagccgtggggggtccctgggagtctcctgtgcagcctctggagtcaccttgagtagctatggcatgagctggggtcccgccgagggcctccgagggaccggggctgggagtgggtctcttctattagtgctaggtggtggtctcactatactacgcagacctctgtgaacgggtccggttcaccggtctccgagacgacaattccaaagaacaccctgtaatctacgacaaatgaaacagtcctaggaacgacgaccgaccgaacgaccgggaccgttataactttaccgtggtacgaacgtaaagtttgggaccgtaacggtggggtaaggttaggttaccgttacggtacgttccgtcggtacggggcccgttacgg

SEQ ID NO: 222745 - DNA, 556 bp, Homo sapiens
  misc_feature: GYAE6OF02I76FB.35.70.G04.1.454.CMB.1.raw
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggcttttcttgtggctattttaaaaggtgtccagtgtgaggtgcagctgtcggagtcgtgggggaggcttggtacagcctggggggtccctggagagtctcctgtgcagcctctggagtcaccttgagtagtcactggatgcacgtgggtccagtcaagttccgaggggaaggggctgggtgtgggtttcacgttattacgagtgatgggactgacacaatctacgcggactccggtggaacgggccgattccaccccctccacgacgacaaccgccaaagaaccacaactatactctgacaaatcgaacagtactagagacgccgaggacacggctgtctattntgngacaggaggtggactaacgaatcgtagttggttttgattcgtcgtcgggactaacggg

SEQ ID NO: 222746 - DNA, 628 bp, Homo sapiens
  misc_feature: GYAE6OF02HWHIM.35.70.G04.1.454.CMB.1.raw
  modified_base (182)..(182): a, c, t, g, unknown or other
  misc_feature (182)..(182): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcggtcgtgtttctaggtcggctaatttaaaaggngtcagtgtgaggtgcagctgtcggagtctgggggaggcttggtacagcctggggggtccctgagagtctcctgtgcagcctntggatcaccttgatagctatggcatgngcgtggcgcgcgcgtcgcggcggcgtggnggtggtcgtcttctagttagtgtcgtagtggtggtcgtcgactactactacgcgtacgtacgtcgtcgtaggtacgggtaccggttacgtaccgtccgtccgacgaagaacgtaacttaacgtaaacgtaaccgtacctacgttactacgtacgtaactaatacgaacgacgtaccgtacgacgacgaccgaacgaccgaccggtacgtaacgttacgttacgtagtacgtaacgtaacgtacggtacggtaacggtaacggtaacggtacggttacggttacgtacgtacgttacggtcgggtccgg

SEQ ID NO: 222747 - DNA, 711 bp, Homo sapiens
  misc_feature: GYAE6OF02IZDYK.35.70.G04.1.454.CMB.1.raw
  modified_base (199)..(199): a, c, t, g, unknown or other
  misc_feature (199)..(199): n is a, c, g, or t
  modified_base (270)..(270): a, c, t, g, unknown or other
  misc_feature (270)..(270): n is a, c, g, or t
  modified_base (630)..(630): a, c, t, g, unknown or other
  misc_feature (630)..(630): n is a, c, g, or t
tcagtacagatcgtcacgaccggtgctcgatttagtgtagtgtgaagggaaagggctgagagaggagcccagccctgggattttccaggtgtttttcatttggttgaactaggactgaacagagagaagtcaccatggagtttgggctgagcggtgtgtttctaggtcggctatttaaaaggtgtcagtgtgaggtgcngctgcggagtctgggggagcttgggtacgagccgtggggggtccctggagtggtcctccgtgtgcagcctntggagtcctaccttgagtactctatggatatggagcgttgggtcccgcccgaggggtcctccggaaggggacccggggtcgtacggggaacggttggggtctcggtttcttaacgtttacgggtgtcgttaggttgggtcggttaccgttccgagtaacgttaccgtaacgaccgtaacggtaccttccgtaggttcggaaacggggtcccggtttacgtaaccggtcccttacccgaagtacgtaacctaattaccgaaactaaaccacccttagtaacctactacggtaacaaagtgaaaccaggtacctaggaacgacgaccgacgaaaccgccggtacctaacgtaacttcgtagngtaaccggtaaagttcggaaggtaaaccgttaggggaagttcgtacggtttaccggaattccgttacggtacgggtccggg

SEQ ID NO: 222748 - DNA, 595 bp, Homo sapiens
  misc_feature: GYAE6OF02I3K2V.35.70.G04.1.454.CMB.1.raw
  modified_base (443)..(443): a, c, t, g, unknown or other
  misc_feature (443)..(443): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggctttttcttgtggctattttaaaagtgtccagtgtgagtgcagctgtcggagtcgtgggggaggcttggtacagccgtggggggtccctgagagtctcctgtgcagcctctggagtcaccttgagtagctatggcatgagcgtgggtcccgccgaggcctccgaggggacggggcgtgggagtgggtctcgttctagttagtgctagtggcggtctcgacatactacgcagactcgtagtggaacggtccggttcaccgtctaccgagacgacaattccgaaagaaccncccttgtactctgactaaatcgaaacacgcctaggacgacgcccgaacgaccgaacggaccgttaagtacttacgtgtagaacgtaaattcgggacgtaacgtaggggtaacgttcggttaacgttcgtaactccgttacggtcgggtccgg

SEQ ID NO: 222749 - DNA, 537 bp, Homo sapiens
  misc_feature: GYAE6OF02HKLLM.35.70.G04.1.454.CMB.1.raw
  modified_base (302)..(302): a, c, t, g, unknown or other
  misc_feature (302)..(302): n is a, c, g, or t
  modified_base (481)..(481): a, c, t, g, unknown or other
  misc_feature (481)..(481): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggcttttcttgtggctattttaaaaggtgtccagtgtgaggtgcagctgtcggagtctgggggaggcttggtacagcctggggggtccctggagagtctcctgtgcagcctctggagtcaccttgagtagctatggcatgagctgggtccnccaggctccagggacgggctgggagtgggtctcttctattagtgctagtggtggtctcacatactacgcagactctgtgaagggccggttcaccgtctccagacgacaattccaaagaacaccctagtactctcgacaaatgaacagcctgagacgcgacgacacggccgtatattacngtagacgtaaaagtggacgaacgtgggaagtggtacttcgagtctcgtgggtccgg

SEQ ID NO: 222750 - DNA, 557 bp, Homo sapiens
  misc_feature: GYAE6OF02GUWKT.35.70.G04.1.454.CMB.1.raw
  modified_base (453)..(453): a, c, t, g, unknown or other
  misc_feature (453)..(453): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggcttttcttgtggctattttaaaaggtgtccagtgtgaggtgcagctgtcggagtctgggggaggcttggtacagcctggggggtccctggagagtctcctgtgcagcctctggagtcaccttgagtagctatggcatgagctgggtccgccaggctccgaggggacggggctgggagtgggcctcttctatttagtgcttaggtggtggtctcacatactacgcagactctgtgaagggtccgttcaccgtctccagagacaattccaagaaccaccctagtactctagacaaatgaacngacctgagagtcgacgacacggctaatattacgtgtgacgtaaagttcggacgtaacgtagggggaacgtagggttacttcggaatcgttccgtggggtcccgg

SEQ ID NO: 222751 - DNA, 592 bp, Homo sapiens
  misc_feature: GYAE6OF02F7CNN.35.70.G04.1.454.CMB.1.raw
  modified_base (155)..(155): a, c, t, g, unknown or other
  misc_feature (155)..(155): n is a, c, g, or t
  modified_base (268)..(268): a, c, t, g, unknown or other
  misc_feature (268)..(268): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcggtgngtttctaggtggctattttaaaaggtgtccagtgtgaggtgcagctgtcggagtctgggggaggcttggtacagcctggggggtccctgagagtctcctgtgcagcctctggngtcaccttgagtagctatggcatgagctgggtccgccaggctccagggacggggctgggagtgggtctcttcgtattagtgctaggtggtggtctcacagtactacgcagactctgtgaagggccggttcaccgtctccagagacaattccaagaaccaccctgttanctgacaaatnaacacgtccngagacgcccggaacgaccgaacggtaccgtattacttaactcgtaggtaccggtaaaaatttgggaaccggtaaacggtgggggtaaaacgttcgggttaacgtttccggtaattccgtcggttcgggggtcccgg

SEQ ID NO: 222752 - DNA, 588 bp, Homo sapiens
  misc_feature: GYAE6OF02JT543.35.70.G04.1.454.CMB.1.raw
tcagtacagatcgtcacgaccggtgctcgatttagtgtagtgtgaagggaaaggggctgagagaggagcccagccctgggattttcgggtgttttcatttggtgaacaggactgaacagagagaagtcaccatggagtttgggctgagctggctttttcttgtggctatttaaaaggtgtccagtgtgaggtgcagctgtcggagtctgggggaggcttgggtacagcctggggggtccctgagagtctcctgtgcagcctctggagtcaccttgagtagctatggcatgagctgggtccgccaggctccgagggacggggctgggagtgggtctcgttctattagtgctaggtggtggtctcacatactacgcagactctgtgaagggccgttcaccgtctccagagacaattccaaagaacaccctgtactctagacaaatcgaacagcctagacgacgcccgaacgacgaccggtaccgtaataacgttacgtgtacgacgtaaaagttcgggaaccgtaacggtaggggaagttcggtaaccgtttacggacgttaccgtccggttacgggggcccgttacggg

SEQ ID NO: 222753 - DNA, 555 bp, Homo sapiens
  misc_feature: GYAE6OF02IXVS9.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagcctggggggtccctgagagtctcctgtgcagcctctggagtcaccttgagtagctatggcatgagctgggtccgccaggctccgaggggacggggctgggagtgggtctcgttctattaggtgctaggtggtggtctcacatactacgcagactcgtgtcgaagggtccggttcaccggtctccgagacgacaattccaagaacaccctgtactctgacaaatgaacagcctagagacgccgacgacgacggcctaatattactgtgacgaaattcggacgtaacgtaggggaagttcggtacttcggatcgtcgtggggtacccgg

SEQ ID NO: 222754 - DNA, 534 bp, Homo sapiens
  misc_feature: GYAE6OF02HEMNL.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttgttacagcctggggggtccctgagagtctcctgtgcagcctctggagtcaccttgagtagctatggcatgagctgggtccgccaggctccgagggacggggctgggagtgggtctcttctattagtgctagtggcggtctcacatactacgcagactctgtgaagggccgttcaccgtctccagacgacaattccaagaaccaccctgtactctgcaaatgaacagcctagacgagccgacgacacggcctatatactgtgacgaaattggacgaacgtgggaagtcggtacgttcgatcgtcgtgggtccgg

SEQ ID NO: 222755 - DNA, 631 bp, Homo sapiens
  misc_feature: GYAE6OF02JJN0G.35.70.G04.1.454.CMB.1.raw
  modified_base (335)..(335): a, c, t, g, unknown or other
  misc_feature (335)..(335): n is a, c, g, or t
  modified_base (555)..(555): a, c, t, g, unknown or other
  misc_feature (555)..(555): n is a, c, g, or t
tcagtacagatcgtcacgaccggtgctcgatttagtgtagtgtgaagggaaaggggctgagagaggagcccagccctggtattttcaggtgttttcatttggtgaacaggactgaacagagagaagtcaccatggagtttgggctgagcgtgtcgtttctaggtggctatttaaaggtgtcagtgtgaggtgcagctgtcggagtgtgggggaggcttggtacaggccgtggggggtccctggagagtctcctgtgcagcctctggagtcaccttgagtagctagtggcatgagcgtcgggtcccgccgaggtcctccgaggggcgggcgtgggngtgggtctcttctagttagtgctaggtggtcggtctcacgtatactacggacaacgtcttcgtggtaggaacggggtcccggtttccacccggttctacccgaaggaaccgtactaaacgttcccaaaaggaaccctacccttgtaactcttacgactaaaactcgaaacctggcctaggacgacggcccgaacgtacgccggtaccgtatacgtttacncgtagaacgttaaagtcgggaactacgggtagggtaacgttcgggttactcggaattccgtagggttcgggaccgg

SEQ ID NO: 222756 - DNA, 569 bp, Homo sapiens
  misc_feature: GYAE6OF02HPXZA.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagcctggggggtccctgagagtctcctgtgcagcctctggagtcaccttgagtagctatggcatgagctgggtcccgccaggctccgaggggacggggctgggagtgggtctcttctattagtgctagtggtggtctcacatactacgcagactctgtgaacgggccgtcaccgtctcagagacaattccaagaaccaccctgtactctgacaaatgaacagcctagacgacgcccgaacgaccgacggtccgtaattacttacgtgtacgaacgtaaaagttcgggaacgtaacggttgggggaagttgggtaccttcggacttcgttcggtggggtcccgg

SEQ ID NO: 222757 - DNA, 599 bp, Homo sapiens
  misc_feature: GYAE6OF02HO1DM.35.70.G04.1.454.CMB.1.raw
  modified_base (153)..(153): a, c, t, g, unknown or other
  misc_feature (153)..(153): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (547)..(547): a, c, t, g, unknown or other
  misc_feature (547)..(547): n is a, c, g, or t
  modified_base (592)..(592): a, c, t, g, unknown or other
  misc_feature (592)..(592): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcggngtcgtttctaggtcggctaattttaaaaggtgtcagtgtgaggtgcagctgtcggagtcgtgggggaggcgttggacagccgtgggggtccctggagcgtcctcctgtgccagcctcgtggacgtcaccttggaacgtagctagtggnatgngtcgtgggtcccncgaggcctcgaggggcggcgtgggattgggcttgttactattagtgactagtgggtgtctcaactatactacggcagtacctgtaggtacggaacggggtccgttccgacccgttcgtaccgaaggataacctaaattaccgaaagtaaccaccgtataatccagtaacaaatacgaacgtcgacctagacgacgaccggaacgtacgaccggtactaactagttacgngtacgaacgtaagtcgagtaacgaggtagtgtctagactcgtcgnggtaccg

SEQ ID NO: 222758 - DNA, 604 bp, Homo sapiens
  misc_feature: GYAE6OF02JETVL.35.70.G04.1.454.CMB.1.raw
  modified_base (466)..(466): a, c, t, g, unknown or other
  misc_feature (466)..(466): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggaggcttggtacagccgtggggggtccctgagagtctcctgtgcagcctcgtggagtcaccttgagtagctatggcatgagctgggtcccgccgaggcctccgaggggacggggctgggaggtcgggtctcgttctagttagtgcgtagtggtggtctcacatactacgcagacctctgtcgaacgggtccgttacaccgtctccgagacgactaattccgaagaaccaccctgtactctgacaaagtgaacngcctagagacgcccgaacgaccgaaccggtccgttaattacttacgtagttacgaaccggtaaaagtttcggaacgtaacggtacgggggtaaagttcgggttaacttaccggagttccgttacggtcggggtacccg

SEQ ID NO: 222759 - DNA, 585 bp, Homo sapiens
  misc_feature: GYAE6OF02ICSTN.35.70.G04.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (481)..(481): a, c, t, g, unknown or other
  misc_feature (481)..(481): n is a, c, g, or t
  modified_base (525)..(525): a, c, t, g, unknown or other
  misc_feature (525)..(525): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcgtggtcgtttcttaggtggctattttaaaaggtgtccagtgtgaggtgcagctgtcggagtcgtgggggagcttggtacagccgtggggggtccctgagngtctcctgtgcagcctntggatcacttgatagctatggcatggagctgggtccgaccnggctccgagggcgggctagggngtgggtctcgtttactagtttagngcttaggtcgggttggtctacacctattacggactcagtcctgtgtggaagggtccgttcaccggtctccaaggacgactaaacttccaaaggaacctaccctgtaatccttagaccaaagcgaacancccgtagaacgccgaccgacgtaacgccgggcttacgtaatacnggtcaaccggtaaattcggcgtaaacgtgggagttcgtacgttcgatcgtggtccgggcg

SEQ ID NO: 222760 - DNA, 599 bp, Homo sapiens
  misc_feature: GYAE6OF02F38R7.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtgcgttttcttaggtggctattttaaaagtgtccagtgtgaggtgcagctgtcggagtctgggggaggcttggtacagccgtggggggtccctggagagtctcctgtgcagcctctggagtcaccttgagtagctatggcatgagctgggtccgccaggctccgagggacgggctgggagtgggtctcgttctagttagtgctagtggcggtctcacatactacgcagactctgtgaagggccgttcaccgtctccagagacaattccaaagaaccaccctgttactctagactaaatcgaaaccagcctagacgacgacccgacgaaccgacgggcccttaagtacttacgtgtacggaacgtaaaagttcgggaacgtaaccggtaggggtaaacggttcggtttaacgttacggtaacgtttccgtaccggttggggtaccccgg

SEQ ID NO: 222761 - DNA, 622 bp, Homo sapiens
  misc_feature: GYAE6OF02H33WL.35.70.G04.1.454.CMB.1.raw
  modified_base (264)..(264): a, c, t, g, unknown or other
  misc_feature (264)..(264): n is a, c, g, or t
  modified_base (345)..(345): a, c, t, g, unknown or other
  misc_feature (345)..(345): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggcttttcttgtggctattttaaaaggtgtccagtgtgaggtgcagctgtcggagtctgggggaggcgttggtacagccgtggggggtccctgagagtctcctgtgcagcctntggagtccaccttgagtagctatggcatgagctgggtcccgcaggctccgaggggacgggctgggaggtgggtctcgtttntattaggtgcgtaggtgggttggtactcacattactaccgcagactcgtggtgaacggggtccgttcaccgtcaccgagagaactaattcccaaagaccctacccgtagtaactctagacctaaagtcaaactcggaccctagagaaccgccgaaccgtacgaccgggtaccgtaatacgttacctggtacgacgtaaaagtttcgggaccgtaaaccggttggggaaagttcggttaaccttaccggaacgtttcgttccggtagggggtccccgg

SEQ ID NO: 222762 - DNA, 578 bp, Homo sapiens
  misc_feature: GYAE6OF02IF80P.35.70.G04.1.454.CMB.1.raw
  modified_base (179)..(179): a, c, t, g, unknown or other
  misc_feature (179)..(179): n is a, c, g, or t
  modified_base (337)..(337): a, c, t, g, unknown or other
  misc_feature (337)..(337): n is a, c, g, or t
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (474)..(475): a, c, t, g, unknown or other
  misc_feature (474)..(475): n is a, c, g, or t
  modified_base (478)..(478): a, c, t, g, unknown or other
  misc_feature (478)..(478): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcggtgtcgtttctagtcggctatttaaaggngtcagtgtgaggtgcagctgtcggagtcgtgggggagctttgggacagccgttggggggtccctaggaggagttctccgtagtgcagcctctggactccacttgatagctagtggcatcgagcttcgggccgaccaggtccgtccgaaggggccgggntcgggagtcgggtctcgtttctaagttgcgtctggttgtggtcttaccanattaccacggacagtactcgtagttacggacgggtccgtttacaccgttcgacngacttanactcgaaancacctgcttangactannacngtcagacgacgacgacgacgtactacgtaatacgtatacgtagaacgtaagtcgacgtaacgggtaggagttcgtaacgttcgacgtcgtcggcgggtac

SEQ ID NO: 222763 - DNA, 626 bp, Homo sapiens
  misc_feature: GYAE6OF02GRQQD.35.70.G04.1.454.CMB.1.raw
  modified_base (497)..(497): a, c, t, g, unknown or other
  misc_feature (497)..(497): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttgggtacagccgtggggggtccctggagagtctcctgtgcagcctcgtggagtccaccttgagtagctatggcatgagcgtgggtcccgccgaggctccgaggggacggggcgtgggaggtgggtccttcttcgtagttagtgctaggtggtggtctcgacatactacgcagtactcgtggtagaacgggtccggttacacccgttctccaaggacgacctaaattcccgaaagtacccacccgttgttaactcttagaacctaaaatcgaaaccnggtacctaggacgacgcccgaacgacgaccggtccgttaatacgttactggacgtaacggtaaagttgggaccgtaaacggtggggtaagttacggttacttcggatttccggtggtcgggggtacccg

SEQ ID NO: 222764 - DNA, 622 bp, Homo sapiens
  misc_feature: GYAE6OF02GI7ZT.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttggtacagccgtggggggtccctggagagtctcctgtgcagcctctggagtcaccttgagtagctatggcatgagcgtcgggtcccgccgaggcctccgaggggacggggctgggagtgggtctcttcgtagttagtgtctaggtggtgtctcactatactacgcagactcgtgtacgaacgggtccgttcaccgtctccagacgactaataccaaagaaccaccctgtaactcctagactaaatcgaacacgacctaggacgaccgaccggaaccgacgaccggtaccgttaattacttacgtaggtacgtaaaccgtaaaaggttcgggaaccggtaaacggttggggtaagttcggttaacgttcgaacgtttccggttaccgggtggggtacccggg

SEQ ID NO: 222765 - DNA, 645 bp, Homo sapiens
  misc_feature: GYAE6OF02JIVG7.35.70.G04.1.454.CMB.1.raw
  modified_base (287)..(287): a, c, t, g, unknown or other
  misc_feature (287)..(287): n is a, c, g, or t
  modified_base (350)..(350): a, c, t, g, unknown or other
  misc_feature (350)..(350): n is a, c, g, or t
  modified_base (555)..(555): a, c, t, g, unknown or other
  misc_feature (555)..(555): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggagcttggtacagccgtggggggtccctgagagtctcctgtgcagcctctggagtcacgttgagtagctagnggcatgagctgggtcccgcaggcctccgagggacgggctgggagtgggtctcgttctagttgngtctaggtggtgtctcactatactacgcagtacctcgtggtaggaacgggtcccggtttcacccgttctccgaacggtacgaactaacgttacccgaaagaaccctaccccgttgttaactccgttaggaacctaaaagtcgaaaccgtagccctaggacgacgacccgaacggtaccaccggggtaccttaagttatttaccgnggttacgaacgtaaaaggttcggaaccgtaacggtaggggtaaacgttcggttacttaccggaagttcccgttacggtccgggggtaccg

SEQ ID NO: 222766 - DNA, 664 bp, Homo sapiens
  misc_feature: GYAE6OF02ISSQB.35.70.G04.1.454.CMB.1.raw
  modified_base (180)..(180): a, c, t, g, unknown or other
  misc_feature (180)..(180): n is a, c, g, or t
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (653)..(653): a, c, t, g, unknown or other
  misc_feature (653)..(653): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtgtcttttctaggtggctattttaaaggngtcagtgtgaggtgcagctgtcggagtcgtgggggagtcttgggtacagccgtggggggtccctagagacgtcttcctgtcgcagcctgtggntccaccttgagtagctagtggacagtgagcgttgggcccgaccnggtcctcggaaggggccgggnttgggagttgggtctcttctagttagtgtacgtagttcggtgtcctactacattaccgacgcgtaagtacctacggtcgtagggtaacgggtcccggtttaccaaccgttccgtacaagggactaactacgttaccgaaagtaccctaccgttgtaacttcgaacgaacctaaagtcgaaacgcgccgttaagacgtaccgacccgacgaacgttaccggaaccttgttaacttcgacgttaggaacgttaaactccgggaacgtaaccggtaggggtaaactttcggtacgtttagaaccttcggttcccgggngggttacccgg

SEQ ID NO: 222767 - DNA, 580 bp, Homo sapiens
  misc_feature: GYAE6OF02G9TP7.35.70.G04.1.454.CMB.1.raw
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtggggggaggcttgggtacaggccgtggggggtccctggagagtctcctgtgcagcctctggagtcaccttgagtagctatggcatgagctgggtccgccaggctccgaggggacgggctggagtgggtctcttctattagtgctagtggtgtctcactatactacgcagacctcgtgtaggaacggtccgtcacccgtctcagacgacaattccaagaacaccctgtactctacgacaaatgaacagcctagacgacgaccggaacgacgaccggacgtaatattacctgtacgtaacggtaaaattcgggacgtaacggttaggggaagttcgggttaacttcggagttaccgtcggtaggggtcccgg

SEQ ID NO: 222768 - DNA, 636 bp, Homo sapiens
  misc_feature: GYAE6OF02JOTHD.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggcttttcttgtggctatttaaaaggtgtccagtgtgaggtgcagctgtcggagtcgtgggggaggcgttggtacgagtccgtcggggggtccctggagtagtcctccgtgtgcaggtcctcgtggacgtctaccgttgtagtacggctaagtggcagtgacgtcgtcgggtcccgccgacggcctccgaaggggcgggcgtgggaggtggtctcgtctagtagtgctaggtggtgtctcactagtactacgcaagctcgtgtacggaacggtccgttacaccgtcacccgaagacgaataacgtccaaagacctcctagtactcgacacaaacgtgaaccagtcctaggacgaacggtcccaaggtaccaaccgggttccaaacttacgttactagtacggaacggtaaacgttgggaacccggttaaggtacggggaattcgggttaccttagtaacggtttccgcgggttccggggcccgg

SEQ ID NO: 222769 - DNA, 682 bp, Homo sapiens
  misc_feature: GYAE6OF02IRPAK.35.70.G04.1.454.CMB.1.raw
  modified_base (522)..(522): a, c, t, g, unknown or other
  misc_feature (522)..(522): n is a, c, g, or t
tcagtacagatcgtcacgaccggtgctcgatttagtgtagtgtgaagggaaaggggtctgagagaggagcccagccctgggatttttcaggtgttttcatttggtgaacaggactgaacagagagaagtcaccatggagtttgggctgagcgtggcttttcttaggtggctaattttaaaaggtgtccagtgtgaggtgcagctgtcggagtcgtgggggaggcttggtacagccgtggggggtccctgagagtctcctgtgcagcctctggagtcaccttgacgtagctatggcatgagcgtgggtacccgccaggctccgaggggacgggctgggagtgggtcctcgttctagttagtgctaggttggtggtctcactattactacgacagacttcgtgtagggaacgggtcccggtttacacccggtttccaccgaggtacgaacctaaacttacccgaaagtaaaccctccccgttggttaaacttccgttaacgaacctaaaagttccggaaaaccncgtccttacggagaccgacccgtaacgaaccgtaccggtcccgttaaattacgttacgtaggtacgtaaccggtaaaatttccgggaaccggtaaacgttagggggtaaacttcgggttaacgttaccgaagtttccggttacggggtacggggtcccgg

SEQ ID NO: 222770 - DNA, 845 bp, Homo sapiens
  misc_feature: GYAE6OF02IA0RU.35.70.G04.1.454.CMB.1.raw
  modified_base (317)..(317): a, c, t, g, unknown or other
  misc_feature (317)..(317): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggagcgttggtacagccgtgggggtccctggagagtctccgtgtcgcagcctcgtggagtccacgttgaagtacgcttaagtggcatgacgcgttcggggcccnccgaggcctaccggacggggaccggggcgtggggaggttcgggttccttcgtttacgttagtttacggtgtccgttaggtcgggttcggtttccacgtaacctacgttaaccgttaacggacctaacggtaccttcggttaggtaccgggtaaccggggggtccccggtttaccgaccccggtttaccctacccgaaaggtaacccgtaaaccgtaaacgttaaccccggaaaacgaaccccttaaccccgttaggtaacccgttacgtaacgaaacctaaaacgtaccgaaaacgtaccgtaccgtaaggaacggaacccgtacccggaacccggaacccggtaaccggtaccggtttaaacttaacgttttacgtacgggttaacggtaaaaccggtttaaaaggttaaccgggggtaacgtaaaacggggggttacggggttaaaacgggttttaccgggtttaaccgggtttaaccggttaacggtttacccggttttaccggggaccggggggtttaccccgg

SEQ ID NO: 222771 - DNA, 615 bp, Homo sapiens
  misc_feature: GYAE6OF02GGAPP.35.70.G04.1.454.CMB.1.raw
  modified_base (356)..(356): a, c, t, g, unknown or other
  misc_feature (356)..(356): n is a, c, g, or t
  modified_base (474)..(474): a, c, t, g, unknown or other
  misc_feature (474)..(474): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtctgggggagcttggtacagccgtggggggtccctggagagtctcctgtgcagcctcgtggagtccaccttgagtagctatggcatgagcgtgggtccgccgaggctccgaggggacggggctggaggtgggtctcttctattagtcgntaggtggtggtctcacattactacgcaacgcttctggtaggacgggtccgttcacccggtctcgagacaactacttccgaaagacccacccttagttactctagacaaatcgaaaccncgtccctaggacgacgacccgaacggaccgaccggtaccgttaataccgttacgtggtagtaaacgtaaagttcgggaaccgtaacgggttggggaaagttcgggttaacgttcggactcggttccgggtggggtacccgg

SEQ ID NO: 222772 - DNA, 644 bp, Homo sapiens
  misc_feature: GYAE6OF02FHXRN.35.70.G04.1.454.CMB.1.raw
  modified_base (305)..(305): a, c, t, g, unknown or other
  misc_feature (305)..(305): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtgtcgtttctagtggctatttaaaggtgtcagtgtgagtgcagctgtcggagtcgtggggagcttggtacagccgtgggggtccctgagacgtctcctgtgcacgcctcgtggtacgtcaccttgacgtagctagtggcatgagtctgggtccnccgagctccgagggacgggctgggaggtgggtctcttctagtttagtgtcttaggtcggttggtactcgactataactacggctaagtactcgtgtcggaacgggtcccgtttccgaccgtcctaccgaagtacgaactaacttaccgaagtaacccaccttagtaactcgttacgacctaaagtagaaccgtacgtacctaggacgacgaacccggtacggaaccgtaccggtccgttaataaccgttacgtgtacggaacgttaaaacgtcggtaaccgtaacggtaggggtaacggttacggttaccgttacgacgttcgtcggtcggggtaccgg

SEQ ID NO: 222773 - DNA, 748 bp, Homo sapiens
  misc_feature: GYAE6OF02IUIH3.35.70.G04.1.454.CMB.1.raw
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggcttttttcttgtggctaattttaaaaggtgtccagtgtgaggtgcagctgtcggagtcgtgggggaggtcttggtacagccgtggggggtccctgagacgtctcctgtcgcacgcctctggatcaccttgagtancgtatggcatggagctggggtccnccgaggtcctccggaggggccggggcgtgggacggttcgggtcttcttccgttagtttacggttgtccgttaggttgggtggtctccgaactagttaccgtacgactacggtacttcggtaggttcgggaacgggtcccggtttacctacccgttccgtacccgaaggtacgtaaacctaaacttacccgaaagaacccctacccgttacgttaactccttagaccttaaagtacgaaacacggtaccctaggaacgaccgacccggtaacggacccgtaaccggtaccggttaattaaccgtttacgtacggttaacggaccggttaaaacggtttccgggaaacggttaaaccgggtaggggggttaaaacgtttacggggttaaccgtttccgtaaacggtttcccgttcccgggttcgggggttaccccggg

SEQ ID NO: 222774 - DNA, 692 bp, Homo sapiens
  misc_feature: GYAE6OF02IJGVW.35.70.G04.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (378)..(378): a, c, t, g, unknown or other
  misc_feature (378)..(378): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggaggtttgggctgagctggctttttcttgtggctaatttaaaaggtgtccagtgtgaggtgcagctggtcggagtcgtgggggaggcttggtacaggccgtggggggtccctggagaggtctcctgtgcagcctcgtggatccaccttgagtagctagtggnatgagcgtcgggtccnccgaggctccggaggggcgggctgggagtgggtctcgttctagttagtgtctaggtgggtggtcnctatacgtacgtacggccaagtcttacgtggtagggtaacgggtcccggttactacccggtctaccgagtaacgacctaattaaccaaacggtaacctaacccgtggttaaacttctacgaacctaaatacggaactaggtacccgtagggacgaaccggtacccggaaccgaccgtaccgggacccgttaaattaccgtaacggttcgtacggtaacctaaaaacgggttcgggaaccgtaagggtaacgggggtaacggttcggttaaccgttaccgggtaatttccgggttaccgggtagggggtccccgg

SEQ ID NO: 222775 - DNA, 635 bp, Homo sapiens
  misc_feature: GYAE6OF02IASNB.35.70.G04.1.454.CMB.1.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (335)..(335): a, c, t, g, unknown or other
  misc_feature (335)..(335): n is a, c, g, or t
  modified_base (389)..(389): a, c, t, g, unknown or other
  misc_feature (389)..(389): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtgtgtttctaggtggctatttaaaaggtgtccagtgtgaggtgcagctgtcggagtcgtgggggaggcgtggtacagccgtggggggtccctggagngtctcctgtgcngcctgtggagtctaccgttgagtagctagtggacagtgagtcgtaggtcccgcaggcctccggaaggggccgggngtggaggttcgggtcttcgttacgtagttagtcgtgttaagtgggttcgtctanaactagttaacacgctaacgaccttgtaggaggtaacggggtcccgtttacgaacccgttctaacccgagaactaacgtaacttaccaaagtaaccgaccttagtacttcgtagaactaaatacgaacgacgtccgtaagacgacgacccgagaacgtccggacgttatagtactgtacgacgtaaagttcgacggtaacggtagggagttacggtaccttaggtactccgtaggtcggtacccgg

SEQ ID NO: 222776 - DNA, 621 bp, Homo sapiens
  misc_feature: GYAE6OF02H8T98.35.70.G04.1.454.CMB.1.raw
  modified_base (174)..(174): a, c, t, g, unknown or other
  misc_feature (174)..(174): n is a, c, g, or t
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
tcagtacagatcgtcacgaccggtgctcgatttagtgtagtgtgaagggaaagggtcgtgagagaggagcccagccctgggatttcaggtgttttctatttggtgaacaggactgaacagagagaagtcgccatggagttggctgagcgtgcgttctagtggctagttaaaggngtcagtgtgaggtgcagctgtcggagtctggggagccgttgaacngcctgggggtccctggagtgctctgtgcagcctgtggngtcaaccttggangtctagtggngngngngtcgtcgtcgcgcgcgtcgacggcggngtgtggtggtcgtcgtctagtgtgtcgtgtgtgtcgtctactactactacgacgacgtacgtcgtgtacggtacggtcggtccgtaccgtcgtaccgtacgtacgacgtaacgtaaccaaccgaaccgtaaccgtacgtacgtcgtacgtacgtaacgtaacgtacgtacgtacgtacgacgacggaccgaaccgaccgtaaccggtacgtaacgttacgttacgtacgtacgtaacgtaacgtagtacggtaacggtaacggtaaggtacggttaccgttacgttacgtacggtccggtcggtccgg

SEQ ID NO: 222777 - DNA, 707 bp, Homo sapiens
  misc_feature: GYAE6OF02GQAMM.35.70.G04.1.454.CMB.1.raw
  modified_base (517)..(517): a, c, t, g, unknown or other
  misc_feature (517)..(517): n is a, c, g, or t
tcagtacagatcgtcacgaccggtgctcgatttagtgtagtgtgaagggaaaggggtctgagagaggagcccagccctgggattttcaggtgttttcatttggtgatcaggactgaacagagagaactcaccatggagtttgggctgagctggtcttttcttgtggctattttaaaaggtgtccagtgtgaggtgcagctgttggagtcgtgggggagtcgttggcacaggccgtcgggggtcctggagtacctctcctgtgcgagcccttgtggtacttcgtaacccttttagcctaaccgttagtggtctagtcgagtccgtcggggtcccggccgggtcctaccggaagggggtaacggggtcggtagggtacggttcgggttacctacggtaaaccgttagtttcggaacgttgggttacgttcggtactacgtaactaaacgtacgtaagttcgggtaacgtacgaacggtaaccgtcccggtagggtaccgggggtccgttacgaaccgtntacccgtacgaacgtaacgtaactaaacgttccgaaagggtaccacggtactagttaactaccgtaaactaaagtcgggaactaggttacgtagtacgacggtccgaaggacctacggtaccttagtacttacgtgacggtaacgtaacggttcaaagttgtacgcgtaggctaaggtggtaggtgtaac

SEQ ID NO: 222778 - DNA, 691 bp, Homo sapiens
  misc_feature: GYAE6OF02FGH0O.35.70.G04.1.454.CMB.1.raw
  modified_base (344)..(344): a, c, t, g, unknown or other
  misc_feature (344)..(344): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggtcttggtacagccgtgggggtccctgagaggtctcgtgtgcgagcctcgtgggactcgacgttgagttagcttagtggacagtgacggtctcggggtcccgcgacggcctccggagggaccggggngtgggtaggtcgggttcttccgtttacgttagttaggtgtaccgttaggtgggttggtctacgtactagtaccgtaacgcaacggtacctcgttggtacggaacgggtcccggttctaacccggtcctccgaacggtaacgaactaactttaccgaaacgtaacccaccgttacgttctaccgtacggtaacaaacgtacgaaacacgtccgtagacgtaccgaccggtaaccgaccggtaccgtacgttaacgttaattaccgtaggtagtaacggtaaagtcggaacgtaacggtaggggtacgttaggtaccgttacggacttcggttacgggtcgggtaccgg

SEQ ID NO: 222779 - DNA, 805 bp, Homo sapiens
  misc_feature: GYAE6OF02GMD36.35.70.G04.1.454.CMB.1.raw
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggtctttttcttgtggcttattttaaaaggtgtccagtgtgaggtgcagctgtcggagtcgtgggggaggcgttggtacaggccggtggggggtccctggagagtctcctgtgcacgcctcgtggacgtcctaccgttgagtagcttagtcggacagtgacgtcgtcgggtccgccgaggccgtccggaggggacggggcgtgggaggttcgggtcttcgttcgtagttaggtcgtcgttaggtcgggttcggttcctacgtaactacttaacgtacgtacgacgtaccttcgtaggtacgggtaaccggggttcccggtttaccgtacccggttcctacccggaaggaacgtaaacctaaaccttaccgaaacggtaaccctacccgttgttaactccgttacgaactaaaacgtcgaaaccgtacgtaccgtacggacggtaacccggaacccgtaacggaacccggaccggggttaaaccctttaaacgtttaaccgttttacgtacggggttaaccggttaaaacgggttaaaacggttttaccggggaaccgggttaaaaccggggttaacggggggttaagtttaccgggtttaacgtttaacccgggtacgttttcccggttaccggggggtccggggttaccccggg

SEQ ID NO: 222780 - DNA, 731 bp, Homo sapiens
  misc_feature: GYAE6OF02HY4FO.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggaggtttgggctgagctggctttttcttgtggctattttaaaaggtgtccagtgtgaggtgcagctgtcggagtcgtgggggaggcttggtacaggccgtggggggtccctggagagtctcctgtgcagcctcgtggacgtctacctttgagtacgactatgggactagtgagtcgtcgggtcccgccgagggtccgtacggacggggacggggtctgggtacgggtcgggttccgttccgtttacgttagtttaacggtcgtacgttaggttgggttacgggtccttacgacgtaacgtacgtacgctaacgtacttcgtaggttcgggaacgggtcccggttaccgacccggtctccgaagacgactaactacgaaacgaaccctaccgttacgtattaccgagtaactaaacgtacgaaacacggtacctaagacggtacgacccggaaccgaccggtaaccggtacgttaaataccttacgtaggtaccgaacggtaaaacggttcgggtaacggtaacggggttaggggtaacggtttcggttaaccggtttacggtaccgttccggttccgggtacggggttaccccggg

SEQ ID NO: 222781 - DNA, 891 bp, Homo sapiens
  misc_feature: GYAE6OF02JBK52.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtggcttattttaaaaggtgtccagtgtgaggtgcagctgtcggagtcgtgggggagtcgttggtacagccgtgggggtccctgagacgtctccgtgtgcagcctcgtggagtcaccttgagtacgctagtcgcatgagtcgttcgggtcccgaccgtacggccgtacccggagggggtaccggggcgttggggtacggttcggggttccttcgtttacgttaagtttacggtgaccgtttagggtcgggttcggttccttacgtaacgtacgtttaaaccgtaccggtaccgtaacggtacctttaccgttagggttacgggaaccgggggttcccggttttacccggacccggtttacccgttaacccggaaaggggtaaccgtaaaccgtaaaacctttaaccccgtaaaaacggtaaaccccccgttacccgttaacggtttaacgttaccttaaccgggaaaccttaaaaacgggtaaccgaaaccgttaaccgtcccgttaagggaaacgggacccggtaaccccggaaaccggtaaccgggtaacccggggttaccgtttaaacgtttacctttaaccgggtcggttaaccgggtaaaccgttaaaaacggggtttccggaacccggggtaaacgggtttagggggaaaccggttttcggggtttaaccttaccggggtaaccgttttaccggtcccgggggttaccggggtacccccggg

SEQ ID NO: 222782 - DNA, 664 bp, Homo sapiens
  misc_feature: GYAE6OF02HHAXY.35.70.G04.1.454.CMB.1.raw
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttggtacagccgtggggggtccctgagagtctccgtgtgcagcctctggatcaccttgagtagctagtggcatgagcgtggtcccgccgacggctccgagggacgggcgtggaggtgggtctacgttcgtagttagtgtctaggtggtacggtctacgactataacctacgcaaggtcttcgtacggtacggaacgggtcccgttaccgtacccgtcctacccgaaggacgtaaacgtaaaccgttaccgaaacgaaaccctacccgttagttaactccgttaacggactaaagtacgaaacacgtaccgtagagacgaccgaaccgaccgaaccggacgtaattaacttacgacgttagtaaccgtaaaagttacggacgtaacgtaacgggggtaattacgggttaaccgttcgtacgttacgttaccgggtacgggtaccgg

SEQ ID NO: 222783 - DNA, 665 bp, Homo sapiens
  misc_feature: GYAE6OF02HLP6B.35.70.G04.1.454.CMB.1.raw
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggtcttttcttaggtggctaatttaaaaggtgtcagtgtgaggtgcagctgtcggagtcgtgggggaggcttggtacgagccgtgggggtccctgagagtctccgtgtgcagcctnggactctacttggagtagctagtggcagtagngtcgtcgggtacccgaccgaggtccgtcccggaagggggaccggggtccgtaggggtacggttcgggtccgttcgtttacgttaagttaggtcgtagttaacggttgggtacggtctactaacaagtactacgctaaggtactcgtgtaggacgggtccggtacaccggtctacgagacactatacaacgaacnccctagtactcngactaaagtcaaacgtagtcgtagtacgaacggtccgaacgtaccgaaccgggtacctaaagtttacgtaacgttcggacgtaacggttaaagtaccggaacggtaacggtaggggtaaagttcggtaacgtcgtactacggttcggtacgggtaccgg

SEQ ID NO: 222784 - DNA, 552 bp, Homo sapiens
  misc_feature: GYAE6OF02GB9JF.35.70.G04.1.454.CMB.1.raw
  modified_base (163)..(163): a, c, t, g, unknown or other
  misc_feature (163)..(163): n is a, c, g, or t
  modified_base (174)..(174): a, c, t, g, unknown or other
  misc_feature (174)..(174): n is a, c, g, or t
  modified_base (176)..(179): a, c, t, g, unknown or other
  misc_feature (176)..(179): n is a, c, g, or t
  modified_base (182)..(183): a, c, t, g, unknown or other
  misc_feature (182)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (191)..(193): a, c, t, g, unknown or other
  misc_feature (191)..(193): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(203): a, c, t, g, unknown or other
  misc_feature (202)..(203): n is a, c, g, or t
  modified_base (213)..(213): a, c, t, g, unknown or other
  misc_feature (213)..(213): n is a, c, g, or t
  modified_base (215)..(216): a, c, t, g, unknown or other
  misc_feature (215)..(216): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (479)..(479): a, c, t, g, unknown or other
  misc_feature (479)..(479): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcggtgtgttctaggngctattaaggncnnnngtnngntntcgnnngggngntgnngctgggtccngnngctctgtgcngcnctgancnctgatagntatgnatgagctggtccncagtcnccggaggcgggctggcgtggtcttctctatgtntacgtggtcgtggtcnctactagtactcgacagtacctgtgtcggacggtcgtccacgtctaccgagacgaactataccaaacgtacccaccgttgtaactcgttacaacctaagtacggaacacgtaccgtagacggaccgtacccggaacaccgtaccgacgttataacgttacgngtacggtaacgtaaacgtcgggtacgaaacgtgggtaagtttcgtagtccgtattccggtggttacccgggcg

SEQ ID NO: 222785 - DNA, 649 bp, Homo sapiens
  misc_feature: GYAE6OF02IXFIN.35.70.G04.1.454.CMB.1.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (354)..(354): a, c, t, g, unknown or other
  misc_feature (354)..(354): n is a, c, g, or t
  modified_base (489)..(489): a, c, t, g, unknown or other
  misc_feature (489)..(489): n is a, c, g, or t
tcagtacagatcgtcacgaccggtgctcgatttagtgtagtgtgaagggaaaggggcgtgagagaggagcccagccctgggatttcaggttgtttcatttggtgaacaggactgaacagagagaagtcaccatggagtttggctgagcgtggtcttttctgtggctagttttaaaggtgtcagtgtgagtgcagctgtcggatcgtggggagctggtacngccgtgggggtcctgagngtctccgtgtagcagcctcgtaggacgtcaccgttggacgttagctagtggcagttgagcgttgggtcccncgnggctccgaagggcgggctggagtgggtctcgttacgtattgngctaggtggtgtactgacgtattaccgacgacgtgtaaccctcgttaggacgtaacgggtccggtttcacccggtctaccgaggacgaacaacgttaccaagaacctaccgtgtactcgtagcaaaatcgaaacngtaccgtacgacgtacgaccgtaacgaccgaaccgggtccgttaaaccgtaaagtttcccgtaggttaccgtaaaccggtaaaagtttcgggaaaccggtaagttaccgggaacggttacggtaccgtttaacggcttacccgttcggcgggttacccgg

SEQ ID NO: 222786 - DNA, 559 bp, Homo sapiens
  misc_feature: GYAE6OF02GMUMX.35.70.G04.1.454.CMB.1.raw
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (492)..(492): a, c, t, g, unknown or other
  misc_feature (492)..(492): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcgttggtacagccgtggggggtccctgagagtctcctgtgcagcctctggagtcaccttgagtagctatggcatgagctgggtccgcaggctccgagggacgggctggagtggtctnttctattgngntagtggtggtctcacatactacgcaagctctgtgaacgggtccggttccgaccgttctaccacgagacaagttccaaagaaccaccctgtatctagacaaatgaacagcctaggagacgccgtacgacgaccgcgtaatattacngtagacgtaaattggaacgaacgtagggaagttcggtacgttcgactcgttacggtcgggtacccgg

SEQ ID NO: 222787 - DNA, 713 bp, Homo sapiens
  misc_feature: GYAE6OF02HQULO.35.70.G04.1.454.CMB.1.raw
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
  modified_base (387)..(387): a, c, t, g, unknown or other
  misc_feature (387)..(387): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtggctattttaaaaggtgtccagtgtgaggtgcagctggtcggagtcgtgggggaggtcgttggtaaccgnggccgtggggggtccctggagtacgtcgtcctgtgcagcctcgtggntcgaccgttgagtagcttagcggactagtgatcgtgggacccncgtacggcgtccgaaggggacgggtctagggtggtcgggtcctggtttacctagttaacggngtaccgttaggtcggttaggtcctacacggtactacgtaacggctaagcttacgtgacggaagggttcccgtataaccggttcaccccgaaggaagacccgtaaacgttaccgaaacgaacccgtaaactcggttaaacgtacgtacgttaaacccaaaagttcgaaaaaacccgcgtaccctttaagggaacggtaacgaccccggaaacggaactaccgggaccgttaaattacgttaacccgaggttaaccggagtaaaatcggtaacgggaactaaggggtagtacgttacgtagaacggttcgtacggtgggttaacccgg

SEQ ID NO: 222788 - DNA, 687 bp, Homo sapiens
  misc_feature: GYAE6OF02JP1N9.35.70.G04.1.454.CMB.1.raw
  modified_base (237)..(237): a, c, t, g, unknown or other
  misc_feature (237)..(237): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtggtcttaattttaaaggtgtccagtgtgaggtgcagctggtcggagtcggtgggggaggtcgttggtaacgnggtccggttggggggtccctaggaggtacgtccgtcctggtcgcgacgtcctcgtgggactcctaccgttggagtagctagtggctagtggacgcggtcgggtcccgaccgacggtccgtaccggacggggaccgggcgtggggacggttcgggttccttcgttacttagttacggtcggtaccgtaggttgggtcggttcctacgactacgtaccgtacgactacgtacttcgtaggtacggaccgggtaccgttcgacccgttcacgaacggtacgtaactaacgtaaccgaacgaaccctaccgttgaactctagaaccaaatcgaacctcgactaggacgacgaccggaacacgcgtacgttaatactgtagtagaacgtaaaggttcggaacgtaggtagggtacgttacgggtacttacggccggttactcggggtcggtccgg

SEQ ID NO: 222789 - DNA, 648 bp, Homo sapiens
  misc_feature: GYAE6OF02JF81E.35.70.G04.1.454.CMB.1.raw
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
  modified_base (573)..(573): a, c, t, g, unknown or other
  misc_feature (573)..(573): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagcgtggcttttcttgtggctattttaaaggtgtcagtgtgaggtgcagctgtcggagtcgtgggggaggcttggtacagccgtcgggggtccctggagagtcctcctgtnctagcctctggagtccaccttggagtagcttagtcggnatggagtcgtgggtcccgccaggcctccggaggggaccgggcgtgggtaggttcgggtccttcttctaagttacgtgccgtaggtcgggtggtcctcgagtactaccgtgaccaacgtacttcgtagtcggaacggggtccgtttccaaccgttcctaccgagaaccgtactaaacgttacccgaaagaaccctacccgtagttactacccgtagacaaattcgaaccgcgtaccagacgacgaccgaaccgacgaccggtacttacttagttaccnggtacggaacgttaaagttcggacgttaacggtgggtaactggttaccgtacgtactcggtcggtcggggtaccg

SEQ ID NO: 222790 - DNA, 649 bp, Homo sapiens
  misc_feature: GYAE6OF02FLZFV.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacaagagagaagtcaccatggtaggttggctgaggctggcttttacgttgtggctatttaaaaggtgtccagtgtgaggtgcagctgtcggagtcgtgggggaggcgttggtacagccgtggggggtccctggagagtctcctgtgcagcctctggagtcaccttgacgtagctatggcatgagctcgggtcccgccaggcctccgagggaccgggcgtgggaggtgggtctcttgttacttagtgtctaggtggtggtctcacatacgtacgcagactctgtgaacgggcgttcagtcgtctccagacactaacttaccaaagtaacctacccttagtacttcgtacgtactaaaacgtacgaaacgtacgacccgttaggaacgaccggtaacccgaaccgtaaccgaaccggtaccgtaattatttacccgtggttaacggtaacgtaaaaggttccgggaaccgtaaacggttaggggtaaacgtttgggtttaaacccgttgaacgttccggttacgggtaccggggg

SEQ ID NO: 222791 - DNA, 838 bp, Homo sapiens
  misc_feature: GYAE6OF02IC9GD.35.70.G04.1.454.CMB.1.raw
  modified_base (180)..(180): a, c, t, g, unknown or other
  misc_feature (180)..(180): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcgtgtcgttttctagtggctaatttaaaggtntccagtgtgaggtgcagctggtcggagtcgtgggggagcgttggacacgccgtggggggtccctggagagtctaccgtgtcgcacgccctgtaggacgtacaccgttgtaagtacggactagtggataagtgaagcgtgggtcccgaccgagtccgtaccgacggggacggcgtggaggttcgggtccttaccgttatagttagtcgtacgtaggttgggtacgttccgtactaactacgttaactaaccgcaacgtacttccgttaggtacggtaacgggtccgtttacgacccgttacgtaccgaagtaacgtaaactaaccgttaaccgaaacgtaaacccgtacccttaaggttaaccctaggttaacgaaacgtaaaacgttacggaaaaccctacgttacccgaaacgggtaaccgaaccggtaacccgggtaacccggttaaacccgggacccggttaaaccggttaatttaaaccccgtttaacggttaccggttaaaccgggtaaaaccggttaaaaaccgggtttaggggaaaccccgggttaaaccggggtttaaggggtaaaccggttttaccggggtttaaaccccgttaggtttaaaccccgggtttaacggtacccggggtttaccggggtaacccccggggg

SEQ ID NO: 222792 - DNA, 700 bp, Homo sapiens
  misc_feature: GYAE6OF02H8RWP.35.70.G04.1.454.CMB.1.raw
  modified_base (193)..(193): a, c, t, g, unknown or other
  misc_feature (193)..(193): n is a, c, g, or t
  modified_base (244)..(244): a, c, t, g, unknown or other
  misc_feature (244)..(244): n is a, c, g, or t
  modified_base (687)..(687): a, c, t, g, unknown or other
  misc_feature (687)..(687): n is a, c, g, or t
tcagtacagatcgtcacgaccggtgctcgatttagtgtagtgtgaagggaaaggggtctgagagaggagcccagccctgggattttcaggtgtttcatttggtgaacaggactgaacagagagaagtcacatggagttgggctgagtctggtcttttcttgtggctatttaaaaggtgtccagtcgtgaggtnctagctgtcggagtctgggggagcgtggtacagcgtcgggggtccctgagngtctccgtgtgcagcctcgtggacgtcctaccttggaagtacgtctagtcggcagttggagtcgtgggtcccgccgtacggtcctaccggaaggggacgggtcgtgggtaacggtcggggtactcgtttactagtttacgtgtcgttaaggtggtacgttcgtcgtaactacgtaacgtacgtctaagtacgtacgtcgtaggtacgggtccggtacgtaccgtcctaccgtacgaagaacctataccgaaacgtaactaaccgtacgtactacgtagactaaacgtagaaaccgtagacccgtaagtacgaacggtcccgaaccggtacgaacccggtacgtaaccttagttaaccgtaggtacggtaacggtaaacgtaaccgggtacgaaccgggtaagggtaacggtacggttacgtaccggttcgtacgttacccggnggtaaccccgggg

SEQ ID NO: 222793 - DNA, 851 bp, Homo sapiens
  misc_feature: GYAE6OF02H0PF9.35.70.G04.1.454.CMB.1.raw
  modified_base (267)..(267): a, c, t, g, unknown or other
  misc_feature (267)..(267): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtcttttcttgtggcttattttaaaaggtgtcctagtgtgaggtgcagctgtcggagtcgtgggggaggcttggtacagccgtgggggtccctgagagtctcctgtgcagcctgnggagtcaccgttgaagtcgctagtggactagtggacgtccgttgggtccccgtccgtaacgggtccgtaccggacgggggaccggggtaccgttgggtaggttaccgggttccttcgtttaccgtagtttacggttcggtaccggttaggttcggttacggttactaccgtaactaacgttaaccgtaccggacctaagtaccttacggtcggtacgggaaacgggggttcccggtttacacccggtttaccgacccgaaggtaaccaacgtaaaccgtttacccgaaaacggtaaccctacccgttaacttagttcccgaagttaacctaaaacgtagaaacccgtacggaacccgttggtaaacccggtacgaaccccgggtaacccggaaccgaacccggggtttaacccgttaaatttaaccgttaccgttacggggttaaacgaaaccggtttaaaaaggggtttacccgggaacgttaaacccgggggtttaggggtaaaaaccggttttcggtttaaacccggtttaccgtaacggtttaccccgggttaccgggggttaccgggggtaacccccgg

SEQ ID NO: 222794 - DNA, 767 bp, Homo sapiens
  misc_feature: GYAE6OF02H2ID8.35.70.G04.1.454.CMB.1.raw
  modified_base (185)..(185): a, c, t, g, unknown or other
  misc_feature (185)..(185): n is a, c, g, or t
  modified_base (226)..(226): a, c, t, g, unknown or other
  misc_feature (226)..(226): n is a, c, g, or t
  modified_base (570)..(570): a, c, t, g, unknown or other
  misc_feature (570)..(570): n is a, c, g, or t
  modified_base (613)..(613): a, c, t, g, unknown or other
  misc_feature (613)..(613): n is a, c, g, or t
tcagtacagatcgtcacgaccggtgctcgatttagtgtagtgtgaagggaaaggggtctgagagaggagcccagccctgggattttcaggtgttttcatttgtgaacaggactgaacagagagaagtcaccatgagttggctgagctggcttttctgtgtctattttaaaaggtgtccagtgtgngtagcagctgtcggagttcgtgggggaggtcttcggtaacncgaccgttggggggttcccctaggtagaggtacctccgtagttgcgagccttgtacggctccgtaccgttagaacgtacgattagtcgcgatacggagccggttcggtacccggccgaaggccttaccgaaggggccgggagtcgggaagttggggttccttacctttggttaactttaggtactacgttaacggttgggtacggtttaccacctaactagtttaaaccgcggactaagaccctttcgtaggtaacggtaacggggtcccgttacctaacccggtacttaccgaggtacgaaacgtaacgttaccgaaaacgtaacctacccgttacgttaacnccgtttaagaacccttaaagtaccgaaactaacgggtccctanacggtaacgacccgaacgacccgaacggtacgttaacgttacgttaaccgtagtaccggtaacgtaaaaggtttcgggaacggttaaacccggtaggggtaaagtttacgggttaacttccggttaacgttaccgttgggaaccggttcccggg

SEQ ID NO: 222795 - DNA, 621 bp, Homo sapiens
  misc_feature: GYAE6OF02F7JXS.35.70.G04.1.454.CMB.1.raw
  modified_base (254)..(254): a, c, t, g, unknown or other
  misc_feature (254)..(254): n is a, c, g, or t
  modified_base (458)..(458): a, c, t, g, unknown or other
  misc_feature (458)..(458): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
tcagtacagatcgtcacgaccggtgctcgatttagtgtagtgtgaagggaaaggggtctgagagaggagcccagccctgggactcccagctgtttctgcttgctgatcaggactgcacacagagaactcaccatggagttcgggctgagctggtttccttgttgcctattttaaaaggtgtccagtgtgaggtgcagctgggtggaggtccgggggagtcttagttcagccgtgggggtccctgagctctctgngcacgcctgtggattccaccttcagtacgtcatggatcgcacgtcgggtcctacgtaacggttccgaaggggaaggggtccgtgggttcggttgggtttcaacggttagtacgagtggagtgggtactgacaacgactctacggcgtaccgtacggtaggaacggcctactccctacccctcgacggacgaaccacgaccaaanaaccaacactataatcanaacaaatanaactacgtcagagacggaccgaaggacgaccggctggtaaccttagttacgtagtacgacgtaaacggtaggtcggaaccttaagaacgttagttaggtttaacggttttacgacgttaccgttagggaaccgggg

SEQ ID NO: 222796 - DNA, 723 bp, Homo sapiens
  misc_feature: GYAE6OF02JM8KL.35.70.G04.1.454.CMB.1.raw
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagcgtggtcttttcttggtgcttaagttttaaaggtgtcagtgtggaggtgcgtagcgtggtacggngtcgtggggaggcttggtaccagccggtggggtcctaggngtagtcgtccgtgtcgcacggcttcgtaggactcctaccgtgtagtacncgtagtggcagtgacgtcgtcgggtcccgcgtacggtccgtcggacggggtccggngtacgggngttcgggtctcgttacgtagttgtcgtagtggtggtcggtactctactagtaccgttcgaaccgagtcctaagtttcggacggttaccgggtcccgtttaacgccccgtttaagacccgttaggaaactacctaaacgttaccgaaacgtccctaaccgtagtactcgaactacgtaaatcggaactaacggtcaacgggtacgaccgaacccggtacgaacgttcccggaacgtttaagtacccgttagttaccgggtaacgtaccggtaaacggttaccgggacgtaacggggtttaacggtaacggtcggtttttaaacgccggttagtacccgggttacggtggggtccccgg

SEQ ID NO: 222797 - DNA, 735 bp, Homo sapiens
  misc_feature: GYAE6OF02G0JL8.35.70.G04.1.454.CMB.1.raw
  modified_base (322)..(322): a, c, t, g, unknown or other
  misc_feature (322)..(322): n is a, c, g, or t
  modified_base (418)..(418): a, c, t, g, unknown or other
  misc_feature (418)..(418): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtctttttcttgtggcttattttaaaaggtgtaccagtgtgaggtgcagctgtcggagtcgtgggggagcgttggtacagccggtggggggtccctggagtagtcctcctgtgcacgcctctggacgttccaccttgagtgcgttagtggcagtgagtcgtcgggtcccnccgaggcctaccggaggggacgggcgtgggacggtcgggtccttcgttcgtaattaggtgtcgtaggtggtgtctcacgatacacgcagtactcgnggtaggacgggtcccgtacgacccgttctaccgaagacgaacctaacgttacccgaaacgtaacccctacccgttagtaccttacgtacgtaacctaaaagtcgaaaccaccgtaacgttaccggaaagtacccggtaacccggaaccgacccgggtaaccgggtaccccgtttaaagtacgttttaaccggtggttaacggtaaaccggtttaaaggtaccgggtaacggtaaaccgggtacgggggtaaacgttaccggggtttaacggttttaccgaagtttaccccgggttacgggtaccgggggtaccccgg

SEQ ID NO: 222798 - DNA, 936 bp, Homo sapiens
  misc_feature: GYAE6OF02FIYFG.35.70.G04.1.454.CMB.1.raw
tcagtacagatcgtcacgaccggtgctcgatttagtgtagtgtgaagggaaaggggctgagagaggagcccagccctgggatttttcaggtgttttcatttggtgaacaggactgaacagagagaagtcaccatggagtttgggctgagcgtgtcgttttcttggtcggctaattttaaaggtgtccagtgtgaggtgcagctggtcggagtcgtgggggagtcgttggtaccaggcccgttgggggggtccctggacgaggttcctccttggtacgcgacgtccgttcgtgggtaacgttccgaccgtttggaaggttagaccgtttaagttcggggacctaaggttcggacgggtccgttcggggggtaccccggcccgtaacgggcccctttacccgggaacggggggaacccggggggtccgttgggggtaacggggtttcgggggtttccttaccgttttacttaaggttttaggttcggtaccgtttaaggggttcgggggtttcggggtttaccccttacgtaacccgtaaacgtttaccccgtaacgggacctaacgggttacctttaccggttaggggtacgggtaacccgggggtacccgggttttcctaaccccggttccgtttacccgaaggtaaccggtaaaccttaaacgtttaaccccgaaaggtaaaccccctacccgttacgttaaccgttccggtttaacgaaccgtaaaagttaccgggaaaaccctacgggtaccccgttagggaaaccgacgggaaccccggtaccgtaaaccggtacccgggtaccgttaacgttaacgtttaccgtacgtacggaaacggttaaacgtttcggaaacccgggttaacggtaggggttaacggttacgggttacctttgggaaccctttccgggttcggtacgggggtccccgg

SEQ ID NO: 222799 - DNA, 675 bp, Homo sapiens
  misc_feature: GYAE6OF02F8P5O.35.70.G04.1.454.CMB.1.raw
  modified_base (522)..(522): a, c, t, g, unknown or other
  misc_feature (522)..(522): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggctttttcttgtggctatttaaaggtgtccagtgtgaggtgcagctgtcggagtcgtgggggaggtcgttgggtacaggccgtgggggggtccctggagagtctccgtgtgcagcctctggacgtcaccttgagtagctagtggcagtgagcgtcgggtccgccgaggcctaccggaggggacggggcgtgggaggttcgggtcttcgttacttagttagtgtcgttaggtgggtcgtctacgactactactacgcagtactcgtggtacggaacgggtccgttacacccggtctaccgaggtacaacctaacttacccgaaacgtaaccctacccttaggtaccttcgtacggaactaaagtcgaaaccncgtaccgtaggaacggacgaccggaacgaccgaccggtacttaatacgttacgtgggtacgtaaccggtaaagttcggggaaccgttaacgggtgggggttaacgttcggttacgttacgggacttcgggttacccggtacgggggtccccgg

SEQ ID NO: 222800 - DNA, 603 bp, Homo sapiens
  misc_feature: GYAE6OF02GMU3F.35.70.G04.1.454.CMB.1.raw
tcagtacagatcgtcacgaccggtgctcgatttagtgtagtgtgaagggaaaggggctgagagaggagcccagccctgggatttttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttggtacagccgtggggggtccctgagagtctcctgtgcagcctctggagtcaccttgagtagctatggcatgagtctggggtcccgccgaggcctccgaggggacggggctgggaggtgggtctcgttctagtagtgctaggtggtgtctcacatactacgcagactctaggtggaacgggtcccgttacgacccgtctccaagacgaactaattaccaaagtaacccaccttgtaactcagacaaagtcaacagtcccagacgacgacccgacgaaccgaccggtaccgttaatacgtttagtgtacgtaacgtaaagtggtaaccgtaacggtagggtaagttggttaaccgttcgagttccggtacggtgggggtcccg

SEQ ID NO: 222801 - DNA, 666 bp, Homo sapiens
  misc_feature: GYAE6OF02GRI93.35.70.G04.1.454.CMB.1.raw
  modified_base (531)..(531): a, c, t, g, unknown or other
  misc_feature (531)..(531): n is a, c, g, or t
tcagtacagatcgtcacgaccggtgctcgatttagtgtagtgtgaagggaaaagggtcgtgagagaggagcccagccctgggattttcaggtgtttcatttggtgaacaggactgaacagagagaagtcaccatggagtttgggctgagctggctttttctgtggctattttaaaaggtgtccagtgtgaggtgctagctgtcggagtcgtgggggagcttggacaggccgtagggggtccctaggagaggtctcctgtgcgagcctcgtggatctaccttgaagtagacgtatggcatgagctgggtcccgccgtaggcctaccggagggacgggctggaaggtgggtactcgttacgtacgttagtcgtcgttagtggtacgtcgtacactagtacctacggacacgtactcgtggtacggtaacgggtccgttacgacccggtaccttaccgaagtaacgaactaaacttaccgaaaacgtaacccaccctaggttaactccgtaagtaaccaaagttacggaaaccncggtacctagaccggtaagcccgaaacgaccgaccggtaccgttaactagttacctaggttacgaacggttaaaatcgggaacgtaaccgtggggtaacttagggtaccttagaacgtcgtacggtcgggtaccg

SEQ ID NO: 222802 - DNA, 631 bp, Homo sapiens
  misc_feature: GYAE6OF02F7OK0.35.70.G04.1.454.CMB.1.raw
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
tcagtacagatcgtcacgaccggtgctcgatttagtgtagtgtgaagggaaaggggtctgagagaggagcccagccctgggattttcgaggtgttttcatttggtgaacaggactgaacagagagaagtcaccatggagttttgggcttgagcggtgtcgtttctaggtcggctattttaaaggtgtccagtgtgaggtgagagcgtgtcgagtcgtaggggcgcgttaggacngccgtagggggtcccnggagcgttctcctggtacgtcncggtctctaaggcttcgacttgagtacgattaggtcgatgtcgaggtcctgggtccctacggngccgtacgaggcgggtnaggnggtcggtctggtattagtgtcgtcgtagtcggtaacgtcncgtatacgtatcacgtnactcgtgtggaacgtccgtaacgtcctgaccgaggactacgtaaacttcgaaacgtaccgtaaaccgttntaagttcccgtaaacgttaacncgaaacgtcgtcaacgggcgtaccgacggaccgtacgacgttacgtaatcggtaagtgtacgtaaggtaggtccggtaaggtacgacgggttactggtaccttacggagttcgacggtccggaacg

SEQ ID NO: 222803 - DNA, 908 bp, Homo sapiens
  misc_feature: GYAE6OF02FZ2WF.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggaggtttgggctgagcgtggtctttttcttagtggctaattttaaaaggtgtccagtgtgaggtgcagctgtcggagtcgtgggggagcgttggtacgagcccggttcgggggtccctggacgtagtcctccgtgtcgcgacgcctcgtcgacgttctaccgttagacgtagtcctagtcgacagtgacgtcggtcggtccccggtaccggaggcccgtccggacggggtaccggggcggttagggtacggtcgggttacttccgttacgttaagtttcggtgtaccgttaggtgggttccggtactaccgaagttacgttaccgtacgaccgtaagtacccgtttacgtggggttaaccggtaacgggggttccccggtttacgtaaccccggttacccgtacccgaagggttaaacgtaaaccccttaaacggttaaccccggtaaaacgtaacccgtaccccgttaacggtttaaccgttacccgtttaaccgaaacttaaaacctaccgggtaaaccgtaccggtaacccggtaagggaacccggtaacccggaaccccgggtaaaccggtaccccgggtaaacccggttatttaaaacccggttaacgttttaacccgggtacggtaaacccgggttaccggtttaaaaagggtcccgggttaaaaccgggaaaggggtttaacccggggggtaaggtttttacccgggttaacgtttacccggggtaacgttttcccgggtaaccggggttccggggtttccccggg

SEQ ID NO: 222804 - DNA, 732 bp, Homo sapiens
  misc_feature: GYAE6OF02HTIOT.35.70.G04.1.454.CMB.1.raw
  modified_base (485)..(485): a, c, t, g, unknown or other
  misc_feature (485)..(485): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggagtttgggctgagctggtcttttcttgtgctattttaaaggtgtccagtgtgaggtgcagctgtcggagtcgtgggggagtcttggtacagccgtcggggggtccctggagagtcctccgtgtcgcgacgtcctcgtggacgtctaccgtttggagtagctagtggcagtgagcgtacgggtcccgccgacggtcctaccggacgggggaccgggcgtcgggacggtttcggggttccttcgtttacgttacgtttagtcgtacgttacggttgggttcggttcctacactattacgtaacgcaagtccttcgtgtacgggtaacgggtcccgtttacacccggtttacnccgaaggtacaacttaacgttacccgaaagtaacccgacgcgttgttaactcgtcgaaacctaaagtacgaaccgaggtacctagggacacggtacgtacggaaacggtcccgaacgggtttccgacggttttaggtttaactacgggttcggtaccggaaagtaaaacgggttcctttaaccggtaaccccgtttttaggaaccgttttacgggtaaccggggtttcggaaacgttaccccggggg

SEQ ID NO: 222805 - DNA, 755 bp, Homo sapiens
  misc_feature: GYAE6OF02GYCHN.35.70.G04.1.454.CMB.1.raw
  modified_base (641)..(641): a, c, t, g, unknown or other
  misc_feature (641)..(641): n is a, c, g, or t
tcagtacagatcgtcacgaccggtgctcgatttagtgtagtgtgaagggaaaggggtctgagagaggagcccagccctgggatttttcaggtgttttcatttggtgaacaggactgaacagagagaagtcaccatggagtttgggctgagcgtgcttttctgtggctatttaaagtgtcagtgtgagtgcagctgtcggagtccgtggggaggtcgttaggtacgagtccgtggggggtccctggacggtagtcctccgtgtcgcacgcctcgtggagttcctaccttgacgttacgcttagtgcatcgagtcgtcgggcccgtccgaggcccgtaccgggtacgggggaccgggtcgtaggggacgggttcgggttcgttccgttttacgttaacgtttacggtgtccggttaggttgggttcggttcctacgtaactacgttacctaccggataacgtaccttcggtaggtacgggtaacgggtcccgtttaccgaacccggtttcctacccggaaagtaacggtaccttaacgttaacccgaaaggaaccctaacggtttcgttaaactcgtagtaacctaacgtaggaaacctcgggtaccaagggaccgtacgcccggaaccgttgaacccgggtntttaacgtctccgttagggtacaacggttaaacggttccggaaggtttaccggggaaggttacggtttaccgtagttaccggtaactttcggtaccggggtcgttaccccgggg

SEQ ID NO: 222806 - DNA, 873 bp, Homo sapiens
  misc_feature: GYAE6OF02G17C2.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttggtacagccgtggggggtccctgagagtctcctgtgcacgcctcgtggagttccaccttgacggtagctagtggacatggagtcgttcggggtcccgaccgacggccgtaccggacggggaaccgggggtccgtggggaggttcggggttccttcgtttcgttagtttacggttcgtccgttaggttgggtcggttcgttaccaactacttaccgtacggtctaacggtaccttcgttcggtagggtaaccggggtcccgggtttacccgacccggttccttacccgaacgtacggtaacctaaaacgtttacccgaaaacggtaaacccctacccgtttacgttaaaccgttaccgttacgaaacctaaaacgttacggaaaaccgtccgtacccggttaacggtaacggaacccggggtaacccggaaacccggtaaacccgggtaaacccgggttaacccgtttaacgttaacccgttttaacggttacgggttaaccggtaaccgggtttaaaaaccggtttacggggtaaacccgggttaaacggggttaacggggggtttaaacggggtttaccgggttttaaccggttaacccggtttaaccgggtttcccggtttaccggggttgggggggttacccccgggg

SEQ ID NO: 222807 - DNA, 822 bp, Homo sapiens
  misc_feature: GYAE6OF02IPXNS.35.70.G04.1.454.CMB.1.raw
  modified_base (274)..(274): a, c, t, g, unknown or other
  misc_feature (274)..(274): n is a, c, g, or t
tcagtacagatcgtcacgaccggtgctcgatttagtgtagtgtgaagggaaagggggtctgagagaggagccccagccctgggattttcaggtgttttcatttggtgaacaggactgaacagagagaagtcaccatggagtttgggctgagcgtggtcttttcttggtgctaattttaaaaggtgtaccagtgtgaggtgcagtctggtcggagtcgtgggggaggcgttggtacaggtccgtggggggttccctgagtacgtcctcctgtgcncgtcctcgtggacgtcaccgttgagtacgcgttagtggctagtgacggtcgttcgggtacccgccacgggtcctccggacggggaaccgggggtcttaggggacggttcgggttcttcctttcgttagttggttagccgttaggtcgggttccggttctaccgacgtaacttaccgtacgaccgagtaccgtctcgggtaacgggtaaccgggttcccggtttcccgtaaccccgtttaccgtaccccggaaggtaaccctaaccgtttaaaacccgtttacccgaaaaacgggtaaacccccttaccccggttaaggtttaaacccgtttcggtaaccgtaaacgttaaacttaccgggaaactacccgtaccgggtaacggaaccgacccggtacccggaacccgtaaccgtaacccgggttctaaaacgtttccgtacgtttacgaacgggttaaaccgttaaagggttacggtaccggagggttaacggggttacgttacggttactttccgaacgttccgggttcgggtcgggttacccgggg

SEQ ID NO: 222808 - DNA, 793 bp, Homo sapiens
  misc_feature: GYAE6OF02HNKGF.35.70.G04.1.454.CMB.1.raw
  modified_base (672)..(672): a, c, t, g, unknown or other
  misc_feature (672)..(672): n is a, c, g, or t
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggagtttgggctgagctggtcttttcttgtggtcttaattttaaaaggtgtcctagttgtgtaggtgcgagctggtcggagtcggtgggggagtcgttggtacgacggtccggtcgggggggtccctggtaaggtacggtcctccgtgtcgcgtacgcctcggtaggtcgtaccgtacgttcgaggtacgtctagtgtacagtgagcggtcggtcgccgaggtcctaccggaggggccgggtacgtgggtaggttcgggtcttcgttagttacgttggtacgttacgttagggttcggttacggttcctacacgtaacgtacgtaaccgtcgtaaacgtcgtacgttcggtaagggacccgggtttcccgttaccgtacccggtcgtaaccgtaaggcctaaaccgtacttaaccgaaacgtaccctaccttagttaaaccgtctacgaactaacgtacgaaacgacgtcgtaaggtaccggaacggtacccggaacgaaccccgttaacgggtaccttaacgttaaccgtttacggnggttaacggttaaaccgggttaaaggtcccgggtaaacgggtaaccggggttacgggttaagggttcccggtttaacggtacggtttacccggtcggttaccggggtccgggttacccggg

SEQ ID NO: 222809 - DNA, 973 bp, Homo sapiens
  misc_feature: GYAE6OF02GQSKC.35.70.G04.1.454.CMB.1.raw
  modified_base (216)..(216): a, c, t, g, unknown or other
  misc_feature (216)..(216): n is a, c, g, or t
tcagtacagatcgtcacgaccggtgctcgatttagtgtagtgtgaagggaaaggggctgagagaggagcccagccctgggattttcaggtgttttcatttggtgaacaggactgaacagagagaagtcaccatggtagtttgggctgagctggtctttttctgtggctaattttaaaaggtgttccagtgtgaggtgcagctgtacgggagttcgngggggagtcgttaggtacacggccggtcgggggtccctaggagtagtccttacgtgtcgacgtacgtcctcgtagggtacgtacctacccgtttaggacgttaacggcgttaacgtacggacgtaagtcggtacggtcccggtttacggggtaccccgaccggttaccggggtaccttaccccggggaagggggacccgggggtaccgtaggggtaacggtttcgggtttacccgttccgttttaaccggtttaggtttacgggtttcgttaacggttcgggtttacgggttcgggtttaccgtaccgttaaactaaccgttaaaccggttaacgaacccgttaaaccgtaaccgtttaccggttagggttaacccgggtaaccgggggtttacccccgttaaccggtcccgtttccggtaaacccgtaaagggttaacccggtaaacctaaaaccgtttaacccaaaaacggttaacccccttaaccgttaagtttaaccccgtgttaaaccgttaactaaaaaccgggtaacgaaacccgtagtaaacccgtacggaaaacgtccggaacccccggtaaagtaacccgggtaaacggttaaccccgttaaatttacccgttaaccggtaacgtttaacgggaaacccttaaaacgggttgggaaaccccggtttaaaggggaacgggttttaacccgtaggttttaccggtaaacggttcccggtttacggtaccccggggttaggtcccccggg

SEQ ID NO: 222810 - DNA, 793 bp, Homo sapiens
  misc_feature: GYAE6OF02JZZLM.35.70.G04.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtacagatcgtcacgaccggtgctcgatttagtgtagtgtgaagggaaagggtcgtgagagaggagcccagccctgggattttcaggtgttttctatttggtgaacaggactgaacagagagaagtcaccatggagtttgggctgagctggcttttcttgtggctattttaaaggtgtccagtgtgaggtgcagntgtcggngtcgtgggggaggcttggtacagcctggggggtccctgngagtctcctggtgccagcctcgtggagtcgtaccttggacgtagtcctatgggctatggacgcgttggggtcccgccgacggtccgtccggacggggtaccgggggccgtacgggaagggttcggggtccctttcgtttccggttaaagtttagggtcgacgtttaacgggttcgggtggttacttccgacctaagttaccgtacggacaggtaacccttcgtggtacgggaaggggttcccggttcgtaacccggtctaccgacggaactacgaacgttaccaaacggaacctacccgaggttacctttacccgagacctaaaacgtagtaacccgtaacggtcccgttaagaaccggttaaccggggccccgaaaccgggaaaccgttacccggttaacccgttaacgttaacgttttaaacccggacggttaccggtaaacgggttaaaccggttacggtaacccggtaagggttaacggggtaacgtttaccgggttaccggttaacccggttaacgtccggttaccggggttaccggtcccggg

SEQ ID NO: 222811 - DNA, 760 bp, Homo sapiens
  misc_feature: GYAE6OF02F086W.35.70.G04.1.454.CMB.1.raw
tcagtacagatcgtcacgaccggtgctcgatttagtgtagtgtgaagggaaaggggtctgagagaggagcccagccctgggatttttcaggtgttttcatttggtgaacaggactgaacagagagaagtcaccatggagttttgggctgagcgtggtctttttcttgtggctattttaaaaggtgtccagtgtgaggtgcagctggtcggagtcgtgggggaggtcgttggtacgaggccggtcggggggttccctggaggtacggtccttccttggttcggacacggcccttcgtgggtactcctaccgttgtagtagtaccgttagtcggctagtgacggtcgtcgggtcccgccgaggtccgtacggacgggcggggcgtgggtaggtcgggtcgtttcttcgttacgttaggtagtcggttaggttcgggttggttctctaacttaacgtaccgtacgaccagtacgtttccgtggtacgggaacggggttccccgttaccggtacccgttcccgtaccggtaacggaacggtaaacctaacgttttaacccgaaacgtaaacccgtacccttaggttacctacgttcgtaaacgtaaacgtaacgaaccgttaccggactaagggtacgaccggacccggtaacgaccgtaacccggtaagttacttaacgttacgtagtacgtaaggtaaacgttaggaccggaggttagggtaacggttagtacgttaggcgttcgtaccgggttggtccggg

SEQ ID NO: 222812 - DNA, 891 bp, Homo sapiens
  misc_feature: GYAE6OF02F9IJK.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactagaacagagagaagtcaccatggagtttgggctgagcgtggtctttttcgttgtggacttaagttttaaaaggtgtacctagttcgtgagtgacgagtctaggtcggacgtcgtagggggacgcgtttaggtaccgacggccggttcggggggtccctaggagtcgtacctccgtggttcgaccgcggtccttcgtaggttacgttacgttacgtttacgaccgtacgtacgtacggactagtacggtacgcggtaccggtcccggtcccgggtcccggtaccggtaccgggaacggggtaccgggtcggtacgggtacgggttcggtaccgttaccgtaacgtttacggttaggttacggttacggttacgtcgtaccgtaacgaacgtaacgtacggtacggtacggtacgtaaccgtaacggttaccggtaccgggtaacgggtaaccgggtaccgttaccgtaccgttacgttaccaacgtaacggtaacgtaacgttaaccgttaaccggaacgtaccgaactacgttaaccgttaccgtacgtaagtaacctaaacgtaaccgtaacgtaccgtacggtaacggaccgaaccgggtaccggtaaccgtaaccggttaaccgttaaccgtttaacgttaccggtttacggttaacggtacgggtttaaaccgttaaccgggtttaaacgggttcgggtttaacggttacgggttaaccgggtttacggggtaaacgggttcgggttaacggttaccgttaagggtaacccgg

SEQ ID NO: 222813 - DNA, 877 bp, Homo sapiens
  misc_feature: GYAE6OF02GZ9GH.35.70.G04.1.454.CMB.1.raw
tcagtacagatcgtcacgaccggtgctcgatttagtgtagtgtgaagggaaaggggtctgagagaggagcccagccctgggattttcaggtgttttcatttggtgaacaggactgaacagagagaagtcaccatggtaggtttgggctgagctggtctttttcttgtggcttaattttaaaggtgtccagtgtgaggtgcagctggtcggaggtcggtgggggaggtcgttggtacgacggccggtacggggggtccctggacggtacggttcctccgtgtcgcgacgtcctcgtggacgtccgtaccgttaggtagtacgtctagtcggactagtggacgtcggtacggggtcccgcccggacggtcccgtaccgggacgggggaccgggggtcggttacggggtacgggttcggggttcccgtttccgtttacgtttaggtttacggttcggtcggtttagggttcgggttcggttcctaccgtaaccgtaacgtaccgtaaccgacgtaaccgtacgtccggttacgggtacgggtaccgggtcccgttaccgtaccccggttaccacgtaacggaaccgtaacctaaccggttaaccgaaacccgtaaccccgttaccgttagttacctacggtaacgtaaacctaaagtaccaaacgtaccggaccgttaagggaacccggaaccgtaaccgggaaacctaaccgggtaacccgggttaccgtttaaaatttccgggttaaacgtcgggttaaaccggtaaaaccgtttaaagggtaccgggaaacccggttaagggggtaaccgggggttaattttaccggggtacctttacggacccggtttccggttaccgggggtccgggttacccgg

SEQ ID NO: 222814 - DNA, 803 bp, Homo sapiens
  misc_feature: GYAE6OF02H14HR.35.70.G04.1.454.CMB.1.raw
  modified_base (656)..(656): a, c, t, g, unknown or other
  misc_feature (656)..(656): n is a, c, g, or t
  modified_base (797)..(797): a, c, t, g, unknown or other
  misc_feature (797)..(797): n is a, c, g, or t
tcagtacagatcgtcacgaccggtgctcgatttagtgtagtgtgaagggaaaggggtctgagagaggagcccagccctgggattttcaggtgttttcatttggtgaacaggactagaacagagagaagtcaccatggtaggtttgggctgagcgtggttcttttttcgttggtggtactttaaagtttttaaaaggtcgtccgtagttgtaggtaggtgacgagtcgtggtcgggaggttcggtggggggtacgtgtttacgggtacgtacgggtccgggttacggggggtaccctaggaaggtacgttccgttccgtggtacgccgtacgtccgtcgtacggtacggtaccttacgttaggtaacgtacggttactaggtggtacgtagtacggtacggtccgggtaccggtcccgtacggtccggtccggggacgggggtacgggggaccggttacgggtacgggttacgggttccggttctttacggttttacgttaaggttggttaccgtacggggttacggtcggttaccgttacaacgtacgtaacgtaccgacgtacgacttacggtacgtaggtacgggtccgttaccgtacgtaccctacgaacgtacgtacaaccttacgaaactaaccgactacgtaattcgtanaacgaatagaaccgactcgacggacaccggaccaaccgtacggacgttaccctaaagtttcgaattggtacgtaactaggtaacggtaacggtaaggtaacgggttagtcgttaacggtccttaggtcgtcggttaccggnggtccg

SEQ ID NO: 222815 - DNA, 830 bp, Homo sapiens
  misc_feature: GYAE6OF02G6OH8.35.70.G04.1.454.CMB.1.raw
  modified_base (294)..(294): a, c, t, g, unknown or other
  misc_feature (294)..(294): n is a, c, g, or t
  modified_base (672)..(672): a, c, t, g, unknown or other
  misc_feature (672)..(672): n is a, c, g, or t
tcagtacagatcgtcacgaccggtgctcgatttagtgtagtgtgaagggaaaggggtcgtgagagaggagcccagccctgggattttcaggtgttttcatttggtgaacaggactgaacagagagaagtcaccatggagtttgggctgagctggtctttttcttgtggtctattttaaaggtcgtccagtgtggaggtgcagtcgtgtcggagtcggtgggggaggtcgttaggtacgacggtccgggttcggggggtccctaggagtacgttctccgtgtcgcacgtcctcgnggacgtccgtaccgttgagtacgtctagtggcatggacgtcggtcgggtcccgccgacggtccgccggacggggccgggtcgtcgggaggttcgggttcgtttcgttcttagtttacgttcggtcgttaggttcgggtcgttacctacgtaactacgttaacgtacgtaaccgtagtacccttacggtacggtacggggtaaccggggttcccgtttaccgtccccgtttaccgtaccgtaaagggacctaaaccgttaaacttacccgaaacggtaacccctacccgtttattaaccgtacgtacgtaaaactaaacggttacaacccggtaaccgtaccggtaaggaaccgccggacccggtaacgggaacccccnggggttaaacccttaaatttcgttaacccgggtacggttagtaaaaccggtaacggtttccgggaaccggtaaaggggtttaccgggggttaaagtttccccggtttaactacgggtaaccggtttccggttaccggggggtcccggggtttacccgg

SEQ ID NO: 222816 - DNA, 847 bp, Homo sapiens
  misc_feature: GYAE6OF02GFUXD.35.70.G04.1.454.CMB.1.raw
  modified_base (183)..(183): a, c, t, g, unknown or other
  misc_feature (183)..(183): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
tcagtacagatcgtcacgaccggtgctcgatttagtgtagtgtgaagggaaaggggtctgagagaggagcccagccctgggattttcaggtgttttcgatttggtgaacaggactgaacagagagaagtcaccatgggagttttgggctggagcggtcgcgtttctaggtgctatttaaaggncagtgagaggtgctagcgtgtcggagttcgaggggagtcgttggtacacggtccgtgggggtcctggagcgtcgtaccgtgngtcagtccatagggtctctactcggtatacggactagtacggntaatggaggtccgttcgggtcccgaccgttaggccgtaccgggaagggccgggtccgagggttaccggtgggttccttacggtaccgtttaattcgtcggaactttacggttgggacgttcgtaccgaacgtaacgttccgtacgtaccctagaccgtttcgtacggtacgggtaaccgggttcccgttaccggtaacccggtcgtacccgaagaaacggtaaacgtaaacgtaaaccggtaacctaaacgtacccgttaaccggtagttacccgttacggaaacctaaagttaccaaagtacccggtttaaacctaggggtacccgggaaaaccggtttacccggaacccgggaaacgggttaacccggtaaccccgggtttaaatttaaacccggttcccgggtttaggacggttaaaaaccgggtaaaccgggttttaaccgggaacccgggttaaggttaacgggggtaacggttaacccggttaaggttaccccggtaaaggtttccggttaccccggggttcggggaacccgg

SEQ ID NO: 222817 - DNA, 768 bp, Homo sapiens
  misc_feature: GYAE6OF02JU475.35.70.G04.1.454.CMB.1.raw
  modified_base (409)..(409): a, c, t, g, unknown or other
  misc_feature (409)..(409): n is a, c, g, or t
  modified_base (710)..(710): a, c, t, g, unknown or other
  misc_feature (710)..(710): n is a, c, g, or t
tcagtacagatcgtcacgaccggtgctcgatttagtgtagtgtgaagggaaaggggtcgtgagagaggagcccagccctgggattttcaggtgttttcatttggtgaacaggactgaacagagagaagtcaccagtggagtttgggctgagctggtctttttcgttgtggcttaagttttaaaaggtcgtccgagtgtggaggtgcagctgtcggagtcgtggggaggcgttggtacaggtccggtcgggggtcccttgagacgtccgttccgtggtcgcgtacgccgttcgtcgggacttaccgtaccttggtaacgtacgtacgttagttacggaactcggttacggaggttccggttacggggtcccgcggtacgtacccggtaccggtacgggggtacccggggnggttaacgggtcgggtttacggggttaacctttccggtttaacgttacggttagggtcgttaaccggtggtttcgggttaacgttacgttaccgaacgttaacgttaccgtaccggtagaaccgtacgttacggttacggtaacgggtaaccgggttcccggtaaccgtacccgttaccgaccgtacggtaccggtaactaacgtttaaccgaaaccggttaccctaaccgtgttacgtacgtcaacgtaatacgactacgctacggagacgaccgagtacgtcgacgttacagtgtacgngtaacgtcgtcgacgtaagtacgttattagttacgaagttcggtactcggactacggg

SEQ ID NO: 222818 - DNA, 148 bp, Homo sapiens
  misc_feature: GYAE6OF01EXGNB.12.22.B11.1.454.CMB.1.raw
  modified_base (147)..(148): a, c, t, g, unknown or other
  misc_feature (147)..(148): n is a, c, g, or t
tcagatacgacgtacacgaccggtgctcgatttagacgacagctcagggaccaaggtgtaagtcaaacgaactgtggctgcaccatctgtcttcatcttcccgccatctgatacgtcgtatctgagcgggctggcaaggcgcatagnn

SEQ ID NO: 222819 - DNA, 148 bp, Homo sapiens
  misc_feature: GYAE6OF01EPVE7.12.22.B11.1.454.CMB.1.raw
  modified_base (148)..(148): a, c, t, g, unknown or other
  misc_feature (148)..(148): n is a, c, g, or t
tcagatacgacgtacacgaccggtgctcgatttagacgacagctcaggggaccaaggtggaagtcaaacgaactgtggctgcaccatctgtcttcatcttcccgccatctgatacgtcgtatctgagcgggctggcaaggcgcatagn

SEQ ID NO: 222820 - DNA, 245 bp, Homo sapiens
  misc_feature: GYAE6OF01BK0SR.12.22.B11.1.454.CMB.1.raw
  modified_base (243)..(245): a, c, t, g, unknown or other
  misc_feature (243)..(245): n is a, c, g, or t
tcagatacgacgtacacgaccggtgctcgatttagacgacagctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttcctacgtcgtatctgagcgggctggcaaggcgcatagnnn

SEQ ID NO: 222821 - DNA, 148 bp, Homo sapiens; identical to SEQ ID NO: 222819
  misc_feature: GYAE6OF01BVTC4.12.22.B11.1.454.CMB.1.raw
  modified_base (148)..(148): a, c, t, g, unknown or other
  misc_feature (148)..(148): n is a, c, g, or t

SEQ ID NO: 222822 - DNA, 420 bp, Homo sapiens
  misc_feature: GYAE6OF01D8IE4.12.22.B11.1.454.CMB.1.raw
  modified_base (414)..(420): a, c, t, g, unknown or other
  misc_feature (414)..(420): n is a, c, g, or t
tcagatacgacgtacacgaccggtgctcgatttagacgacagctcagggaaggccctggagtggataggatacatctctaaaagtgggagcaccttctacaatccgtcactcaagagtcgagtttccatatccgtagacatgaccaagaatcacttctccctgaacctgacctctatgactgtcgcagacacggccgtctattactgtggcagagaaagatatatagcggcggtccatctatacatagacgtctggggcaaagggaccacggtcaccgtctcctcagcctcaccaagggcccatcggtctcccctggcaccctcctccaagagcacctctggggcacagcgccctggctgcctggtcaggactactcctacgtcgtatctgagcgggctggcaaggcgcatagnnnnnnn

SEQ ID NO: 222823 - DNA, 148 bp, Homo sapiens; identical to SEQ ID NO: 222819
  misc_feature: GYAE6OF01D1MI3.12.22.B11.1.454.CMB.1.raw
  modified_base (148)..(148): a, c, t, g, unknown or other
  misc_feature (148)..(148): n is a, c, g, or t

SEQ ID NO: 222824 - DNA, 505 bp, Homo sapiens
  misc_feature: GYAE6OF01C2WJ2.12.22.B11.1.454.CMB.1.raw
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (468)..(505): a, c, t, g, unknown or other
  misc_feature (468)..(505): n is a, c, g, or t
tcagatacgacgtacacgaccggtgctcgatttagacgacagctcagggaagggcccgtggagtggataggatacatctctaaaagtgggagcaccttctacaatccgtcactcaagagtcgagttttccatatcccgtagacatgaccaagaatcacttctccctgaacctgacctctatgacctgtcgcagacacggccgtntattacngtggcagagaaagatatatagcggcgtccatctatacatagactcgtgggcaagggacacggtcaccgtctcctcacgcctccaccaagggcccatccggtccttccccctcggccacccctcctccaacgacgccacctcgtggggccacgacgccggcccgtgggccttcgccgtaggtcaaacggtcctacgttccctaccgtcgttactccgttgaggccgggacgttgggacgaagggccgacgaagttagnnnnnnnnnnnnnnnnnnnnnnnnnnnnnnnnnnnnnn

SEQ ID NO: 222825 - DNA, 246 bp, Homo sapiens
  misc_feature: GYAE6OF01D7ZT8.12.22.B11.1.454.CMB.1.raw
  modified_base (244)..(246): a, c, t, g, unknown or other
  misc_feature (244)..(246): n is a, c, g, or t
tcagatacgacgtacacgaccggtgctcgatttagacgacagctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttcctacgtcgtatctgagcgggctggcaaggcgcatagnnn

SEQ ID NO: 222826 - DNA, 261 bp, Homo sapiens
  misc_feature: GYAE6OF01D8XK7.12.22.B11.1.454.CMB.1.raw
  modified_base (244)..(244): a, c, t, g, unknown or other
  misc_feature (244)..(244): n is a, c, g, or t
  modified_base (249)..(261): a, c, t, g, unknown or other
  misc_feature (249)..(261): n is a, c, g, or t
tcagatacgacgtacacgaccggtgctcgatttagacgacagctcagggtcttcgtggctcacgtccaccaccacgcatgtgacctcaggggtccgggagatcatgagggtgtccttgggttttggggggaagaggaagactggaccggtccccccaggagttcaggtgctgggcacagcggccctgggctgcctggtcaaggactacttcctacgtcgtatctgagcgggctggcaaggccgnatagnnnnnnnnnnnnn

SEQ ID NO: 222827 - DNA, 252 bp, Homo sapiens
  misc_feature: GYAE6OF01DX9XL.12.22.B11.1.454.CMB.1.raw
  modified_base (246)..(252): a, c, t, g, unknown or other
  misc_feature (246)..(252): n is a, c, g, or t
tcagatacgacgtacacgaccggtgctcgatttagacgacagctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttcctacgtcgtatctgaggcgggctggcaaggcgcatagnnnnnnn

SEQ ID NO: 222828 - DNA, 844 bp, Homo sapiens
  misc_feature: GYAE6OF01B23OT.12.22.B11.1.454.CMB.1.raw
  modified_base (572)..(572): a, c, t, g, unknown or other
  misc_feature (572)..(572): n is a, c, g, or t
tcagatacgacgtacacgaccggtgctcgatttagacgacagctcagggggagaaaggagccttagccctggattccaaggcctatccacttggtgagcagcactgagcaccgagaattcaccatggactgggctccggctgggtcttccgttgttgtcttatttaggaggtgtcagtgtgaagtgcgttggttgggtggtaggtcggtgggggacgccgtaggtacgaacggccgtgggggactcccgtggggactaccttcctccgtggtcgccgacgtccgttcgtagtacttccgagtccgttacgtacttacctaacgttattagttacgtacggtaccggttcgggtaccccgaccgtaacggtaccgttccgggtagggggaaacgggtccgtagggtaacggttcgggttcctacgttacttacgtacgtaacgtaggttaacgtacggtaacctaaaacgttaatttaaccgtttaacgtttaaccggacccgtacccgtaacgtaccggtagggttaacgggtaaccggggttacccgttacctaacccgtacgtttacccnccggtaaacgacgaaccaaccccgtactaagtaccgaacgttctaacgtacgtaacttcgaacttaaccgtaacgaacgtaaacgtcgaaggaacggtaccgcccggggtaaagtacgaacgttatttattttaacgtcggtaacgtagggtaagtaaacggtttttagggtaacggtacggtaacggttaaacggaagggtaaaacgggggttaaccgggggggaggtttaaaccgggacgggtttcggggaaacccggtttaaccggggg

SEQ ID NO: 222829 - DNA, 552 bp, Homo sapiens
  misc_feature: GYAE6OF01B9PJX.12.22.B11.1.454.CMB.1.raw
  modified_base (178)..(178): a, c, t, g, unknown or other
  misc_feature (178)..(178): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (515)..(516): a, c, t, g, unknown or other
  misc_feature (515)..(516): n is a, c, g, or t
  modified_base (519)..(552): a, c, t, g, unknown or other
  misc_feature (519)..(552): n is a, c, g, or t
tcagatacgacgtacacgaccggtgctcgattttagacgacagctcagggaaggccctgggagtggataggatacatctctaaaaagtgggagcaccttctacaatccgtcactcaagagtcgagtttccatatccgtagacatgaccaagaatcacttctccctgaacctgaccctntatgactgtcgcagacacggccgtntattacngtggcaagagaaagatatataggcggcggtccatctatacattaggacgtcgtggggacgaaagggaccacggtccaccgtcctcctcacgcctccaaccgaacgggcccctacgtccggttccccttccccccgtcggtcccacccctccctaccaacggacgtccaccgttcggtcgggggacaccgacggccggcccgtcgggcgtcggccgtcggtacgacggtaccttaccgttccgttacgttcgttacttcgtggacggccgggtcgtcgggtacggacgggaccgacgtacgtcggnngcnnnnnnnnnnnnnnnnnnnnnnnnnnnnnnnnnn

SEQ ID NO: 222830 - DNA, 148 bp, Homo sapiens
  misc_feature: GYAE6OF02GSEY1.12.22.B11.1.454.CMB.1.raw
  modified_base (147)..(148): a, c, t, g, unknown or other
  misc_feature (147)..(148): n is a, c, g, or t
tcagatacgacgtacacgaccggtgctcgatttagacgacagctcagggaccaaggtggaagtcaaacgaactgtggctgcaccatctgtcttcatcttcccgccatctgatacgtcgtatctgagcgggctggcaaggcgcatagnn

SEQ ID NO: 222831 - DNA, 162 bp, Homo sapiens
  misc_feature: GYAE6OF02I1A16.12.22.B11.1.454.CMB.1.raw
  modified_base (150)..(162): a, c, t, g, unknown or other
  misc_feature (150)..(162): n is a, c, g, or t
tcagatacgacgtacacgaccggtgctcgatttagacgacagctcaggggaccgaaggtggaagtcaaacgaactgtggctgcaccatctgtcttcatcttcccgccatctgactacgtcgtatctgagcgggctggcaaggcgcatagnnnnnnnnnnnnn

SEQ ID NO: 222832 - DNA, 247 bp, Homo sapiens
  misc_feature: GYAE6OF02HJLL5.12.22.B11.1.454.CMB.1.raw
  modified_base (243)..(247): a, c, t, g, unknown or other
  misc_feature (243)..(247): n is a, c, g, or t
tcagatacgacgtacacgaccggtgctcgatttagacgacagctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttcctacgtcgtatctgagcgggctggcaaggcgcatagnnnnn

SEQ ID NO: 222833 - DNA, 426 bp, Homo sapiens
  misc_feature: GYAE6OF02GLF8H.12.22.B11.1.454.CMB.1.raw
  modified_base (421)..(426): a, c, t, g, unknown or other
  misc_feature (421)..(426): n is a, c, g, or t
tcagatacgacgtacacgaccggtgctcgatttagacgacagctcagggaaggccctggagtggataggatacatctctaaaagtgggagcaccttctacaatccgtcactcaagagtcgagtttccatatccgtagacatgaccaagaatcacttctccctgaacctgacctctatgactgtcgcagacacggccgtctattactgtggcagagaaagatatatagcggcggtccatctatacatagacgtctggggcaaagggaccacggtcaccgtctcctcagcctccaccaagggcccatcggtcttccccctggcaccctcctccaagagcacctctgggggcacagcggccctgggctgcctggtcaaggctacttcctacgtcgtatctgagcgggctggcaaggcgcatagnnnnnn

SEQ ID NO: 222834 - DNA, 148 bp, Homo sapiens; identical to SEQ ID NO: 222819
  misc_feature: GYAE6OF02GXUSK.12.22.B11.1.454.CMB.1.raw
  modified_base (148)..(148): a, c, t, g, unknown or other
  misc_feature (148)..(148): n is a, c, g, or t

SEQ ID NO: 222835 - DNA, 618 bp, Homo sapiens
  misc_feature: GYAE6OF02IAF94.12.22.B11.1.454.CMB.1.raw
  modified_base (527)..(527): a, c, t, g, unknown or other
  misc_feature (527)..(527): n is a, c, g, or t
tcagatacgacgtacacgaccggtgctcgatttagacgacagctcagggaaggccctggagtggataggatacatctctaaaagtgggagcaccttctacaatccgtcactcaagagtcgagtttccatatccgtagacatgaccaagaatcacttctccctgaacctgacctctatgactgtcgcagacacggccgtcttattactgtggcagaagaaagataatagtagcggcggttaccattctaatacaagttagaccgtcgtaggggacgaaagggaccacggtcaccgtctcctcagcctaccacgaacggcccagtcgtcctccccgtgccaccctcctaccacgagccacctcggtcggggacacgacggccggtcccgtcgggcctccgtccgtgggtaccgaaacggtaccttaccgttacccgtaacggtttaccgttaactccggttaggacgggtccggggtactacggggacgaaacgggtcccggaccgtaagttagggactagcgagacgngacgacgctcgacacgacacacacgacgtcgtacgacactagagcgcgacgacgtacgacgacgtacgacgtagtacgacgtacgtatccg

SEQ ID NO: 222836 - DNA, 160 bp, Homo sapiens
  misc_feature: GYAE6OF02GJE9A.12.22.B11.1.454.CMB.1.raw
  modified_base (147)..(160): a, c, t, g, unknown or other
  misc_feature (147)..(160): n is a, c, g, or t
tcagatacgacgtacacgaccggtgctcgatttagacgacagctcaggggaccaaggtggaagtcaaacgaactgtggctgcaccatctgtcttcatcttcccgcatctgatacgtcgtatctgagcgggctggcaaggcgcatagnnnnnnnnnnnnnn

SEQ ID NO: 222837 - DNA, 187 bp, Homo sapiens
  misc_feature: GYAE6OF01BB3N6.37.25.C03.1.454.CMB.1.raw
  modified_base (172)..(187): a, c, t, g, unknown or other
  misc_feature (172)..(187): n is a, c, g, or t
tcagtagtgtagatcacgaccggtgctcgatttagtagtgtagatttgggttgggggaagaggaagactgacggtcccccaggagttcaggtgctgggcacagcggccctgggctgcctggtcaaggactacttccatctacactactgagcgggctggcaaggcgcatagnnnnnnnnnnnnnnnn

SEQ ID NO: 222838 - DNA, 177 bp, Homo sapiens
  misc_feature: GYAE6OF01BWT0O.37.25.C03.1.454.CMB.1.raw
  modified_base (172)..(177): a, c, t, g, unknown or other
  misc_feature (172)..(177): n is a, c, g, or t
tcagtagtgtagatcacgaccggtgctcgatttagtagtgtagatttgggtttggggaagaggaagactgacggtcccccaggagttcaggtgctgggcacagaggccctgggctgcctggtcaaggactacttccatctacactactgagcgggctggcaaggcgcatagnnnnnn

SEQ ID NO: 222839 - DNA, 173 bp, Homo sapiens
  misc_feature: GYAE6OF01A6MQX.37.25.C03.1.454.CMB.1.raw
  modified_base (173)..(173): a, c, t, g, unknown or other
  misc_feature (173)..(173): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagn

SEQ ID NO: 222840 - DNA, 233 bp, Homo sapiens
  misc_feature: GYAE6OF01BSB48.37.25.C03.1.454.CMB.1.raw
  modified_base (231)..(233): a, c, t, g, unknown or other
  misc_feature (231)..(233): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnn

SEQ ID NO: 222841 - DNA, 173 bp, Homo sapiens; identical to SEQ ID NO: 222839
  misc_feature: GYAE6OF01EELT1.37.25.C03.1.454.CMB.1.raw
  modified_base (173)..(173): a, c, t, g, unknown or other
  misc_feature (173)..(173): n is a, c, g, or t

SEQ ID NO: 222842 - DNA, 173 bp, Homo sapiens; identical to SEQ ID NO: 222839
  misc_feature: GYAE6OF01D0W3O.37.25.C03.1.454.CMB.1.raw
  modified_base (173)..(173): a, c, t, g, unknown or other
  misc_feature (173)..(173): n is a, c, g, or t

SEQ ID NO: 222843 - DNA, 174 bp, Homo sapiens
  misc_feature: GYAE6OF01EBOVM.37.25.C03.1.454.CMB.1.raw
  modified_base (173)..(174): a, c, t, g, unknown or other
  misc_feature (173)..(174): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnn

SEQ ID NO: 222844 - DNA, 530 bp, Homo sapiens
  misc_feature: GYAE6OF01B0JKE.37.25.C03.1.454.CMB.1.raw
tcagtagtgtagatcacgaccggtgctcgatttagtagtgtagatttgggtttggggaggcctggtgcagcctgggggtccctgagactctcctgtgcagcctctggattaatgtttagcaactctggcatgaactgggtccgccaggctccaggcatggggctgcagtggttctcaagtactagtgctcctggtaatagagcagactacgcagactccgtgaagggccggttcaccatctccagagacaattccaagaacacgctctatctgcaaatgaacagcctgagagccgaagacacggccgtatattactgtacgaaaatggcctacggatatgactactattgggactggtacttcgatctctgggccacggaaccctggtcacgtctcctcagcctcaccagggcccatcggtcttcccctggccaccctccctccaacgacgccaccctctcgggggcaccgagccggccctcgggctcgccgtggtcaggactacttccactctacactactggagcggg

SEQ ID NO: 222845 - DNA, 174 bp, Homo sapiens
  misc_feature: GYAE6OF01CICDG.37.25.C03.1.454.CMB.1.raw
  modified_base (174)..(174): a, c, t, g, unknown or other
  misc_feature (174)..(174): n is a, c, g, or t
tcagtagtgtagatcacgaccggtgctcgatttagtagtgtagatttgggtttggggggaagaggaagactgacggtcccccaggagttcaggtgctgggcacagcggccctgggctgcctggtcaaggactacttccatctacactactgagcgggctggcaaggcgcatagn

SEQ ID NO: 222846 - DNA, 233 bp, Homo sapiens; identical to SEQ ID NO: 222840
  misc_feature: GYAE6OF01DIGFV.37.25.C03.1.454.CMB.1.raw
  modified_base (231)..(233): a, c, t, g, unknown or other
  misc_feature (231)..(233): n is a, c, g, or t

SEQ ID NO: 222847 - DNA, 448 bp, Homo sapiens
  misc_feature: GYAE6OF01DWLGG.37.25.C03.1.454.CMB.1.raw
  modified_base (426)..(426): a, c, t, g, unknown or other
  misc_feature (426)..(426): n is a, c, g, or t
  modified_base (442)..(448): a, c, t, g, unknown or other
  misc_feature (442)..(448): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctctccaagagcacctctgggggcacagcggccctgggctgcctggtcaaggctacttccatctacactactgagcgggntggcaaggcgcatagnnnnnnn

SEQ ID NO: 222848 - DNA, 174 bp, Homo sapiens; identical to SEQ ID NO: 222843
  misc_feature: GYAE6OF01BLOC1.37.25.C03.1.454.CMB.1.raw
  modified_base (173)..(174): a, c, t, g, unknown or other
  misc_feature (173)..(174): n is a, c, g, or t

SEQ ID NO: 222849 - DNA, 373 bp, Homo sapiens
  misc_feature: GYAE6OF01CKKNT.37.25.C03.1.454.CMB.1.raw
  modified_base (370)..(373): a, c, t, g, unknown or other
  misc_feature (370)..(373): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccaggggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 222850 - DNA, 178 bp, Homo sapiens
  misc_feature: GYAE6OF01AB9EC.37.25.C03.1.454.CMB.1.raw
  modified_base (173)..(178): a, c, t, g, unknown or other
  misc_feature (173)..(178): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnnnnnn

SEQ ID NO: 222851 - DNA, 173 bp, Homo sapiens; identical to SEQ ID NO: 222839
  misc_feature: GYAE6OF01CEJKR.37.25.C03.1.454.CMB.1.raw
  modified_base (173)..(173): a, c, t, g, unknown or other
  misc_feature (173)..(173): n is a, c, g, or t

SEQ ID NO: 222852 - DNA, 173 bp, Homo sapiens; identical to SEQ ID NO: 222839
  misc_feature: GYAE6OF01A8YID.37.25.C03.1.454.CMB.1.raw
  modified_base (173)..(173): a, c, t, g, unknown or other
  misc_feature (173)..(173): n is a, c, g, or t

SEQ ID NO: 222853 - DNA, 448 bp, Homo sapiens
  misc_feature: GYAE6OF01BMDVE.37.25.C03.1.454.CMB.1.raw
  modified_base (444)..(448): a, c, t, g, unknown or other
  misc_feature (444)..(448): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 222854 - DNA, 172 bp, Homo sapiens
  misc_feature: GYAE6OF01D0EJD.37.25.C03.1.454.CMB.1.raw
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatag

SEQ ID NO: 222855 - DNA, 672 bp, Homo sapiens
  misc_feature: GYAE6OF01DGRUH.37.25.C03.1.454.CMB.1.raw
  modified_base (669)..(669): a, c, t, g, unknown or other
  misc_feature (669)..(669): n is a, c, g, or t
  modified_base (671)..(672): a, c, t, g, unknown or other
  misc_feature (671)..(672): n is a, c, g, or t
tcagtagtgtagatcacgaccggtgctcgatttagtagtgtagatttgggtttgggggaggcctgggtagcacgccctgggggtccctgagacgtcctcctgtgacagtccgtacttggtattaactggtttaagcaaactctaggcagtcgaacgtcgggtcccgccacggctccgggcatggggctgcagtcggtactcgaacgtactaggtgctccctagggtaaataggacgcaggactaacgcgagacgtccgtgaacggtccgttcaccatcctccagagacaattccaagaacacgctactattctgactaaattgaacagcctgacgagaccgaaagaccgaccgaccgttatacttacgtacgtagtagaaaggcgtagggacgtacgggggactacggtcggggccacgggaaccctggtccaccgtctccctcacgtccctacccgaccgaacgggccctaagtaccggttcccttcccccgtcggccctaccctccgtcccgaagtaccgccgtaacccgtccgtacggggccaacgacggccggcccgtcgggcctcggcccgttacggtaccgaaagggtacccttaccgttccgactacctacctaaccttaacgtcggacggtcgggccgtggaccaacgggccacgatacgngnn

SEQ ID NO: 222856 - DNA, 168 bp, Homo sapiens
  misc_feature: GYAE6OF01EUSH0.37.25.C03.1.454.CMB.1.raw
tcagtagtgtagatcacgaccggtgctcgatttagtagtgtagatttgggttgggaagaggaagactgacggtccccaggagttcaggtgctgggcacagcggccctgggctgcctggtcaaggactacttccatctacactactgagcgggctggcaaggcgcatag

SEQ ID NO: 222857 - DNA, 464 bp, Homo sapiens
  misc_feature: GYAE6OF01EIP2R.37.25.C03.1.454.CMB.1.raw
  modified_base (246)..(246): a, c, t, g, unknown or other
  misc_feature (246)..(246): n is a, c, g, or t
  modified_base (442)..(464): a, c, t, g, unknown or other
  misc_feature (442)..(464): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattacngtgtgaaaggctggggatgggggactactggggccagggaaccctggtcaccgtctcctcagcctccaccaagggcccatcggtcttccccctggccaccctcctccaagagcacctctgggggcacagcggccctgggctgcctggtcaaggctacttccatctacactactgagcgggctggcaaggcgcatgnnnnnnnnnnnnnnnnnnnnnnn

SEQ ID NO: 222858 - DNA, 173 bp, Homo sapiens; identical to SEQ ID NO: 222839
  misc_feature: GYAE6OF01CIV9X.37.25.C03.1.454.CMB.1.raw
  modified_base (173)..(173): a, c, t, g, unknown or other
  misc_feature (173)..(173): n is a, c, g, or t

SEQ ID NO: 222859 - DNA, 174 bp, Homo sapiens
  misc_feature: GYAE6OF01A3B0Y.37.25.C03.1.454.CMB.1.raw
  modified_base (173)..(174): a, c, t, g, unknown or other
  misc_feature (173)..(174): n is a, c, g, or t
tcagtagtgtagatcacgaccggtgctcgatttagtagtgtagatttgggtttgggggaagaggaagactgacggtcccccaggagttcaggtgctgggcacagcggccctgggttgcctggtcaaggactacttccatctacactactgagcgggctggcaaggcgcatagnn

SEQ ID NO: 222860 - DNA, 239 bp, Homo sapiens
  misc_feature: GYAE6OF01DYVXX.37.25.C03.1.454.CMB.1.raw
  modified_base (230)..(239): a, c, t, g, unknown or other
  misc_feature (230)..(239): n is a, c, g, or t
tcagtagtgtagatcacgaccggtgctcgatttagtagtgtagatttgggtttggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnnnnnnnnn

SEQ ID NO: 222861 - DNA, 174 bp, Homo sapiens; identical to SEQ ID NO: 222845
  misc_feature: GYAE6OF01DYCOT.37.25.C03.1.454.CMB.1.raw
  modified_base (174)..(174): a, c, t, g, unknown or other
  misc_feature (174)..(174): n is a, c, g, or t

SEQ ID NO: 222862 - DNA, 173 bp, Homo sapiens; identical to SEQ ID NO: 222839
  misc_feature: GYAE6OF01CAI95.37.25.C03.1.454.CMB.1.raw
  modified_base (173)..(173): a, c, t, g, unknown or other
  misc_feature (173)..(173): n is a, c, g, or t

SEQ ID NO: 222863 - DNA, 372 bp, Homo sapiens
  misc_feature: GYAE6OF01B2GJQ.37.25.C03.1.454.CMB.1.raw
  modified_base (369)..(372): a, c, t, g, unknown or other
  misc_feature (369)..(372): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccaggggaaccctggtcaccgtctcctcagcctccaccaagggcccatcggtcttccccctggcaccctcctccaagagcacctctggggacacagcggccctgggctgcctggtcaaggctacttccatctacactactgagcgggctggcaaggcgcatagnnnn

SEQ ID NO: 222864 - DNA, 173 bp, Homo sapiens; identical to SEQ ID NO: 222839
  misc_feature: GYAE6OF01DN08Y.37.25.C03.1.454.CMB.1.raw
  modified_base (173)..(173): a, c, t, g, unknown or other
  misc_feature (173)..(173): n is a, c, g, or t

SEQ ID NO: 222865 - DNA, 518 bp, Homo sapiens
  misc_feature: GYAE6OF01DTJPC.37.25.C03.1.454.CMB.1.raw
  modified_base (513)..(513): a, c, t, g, unknown or other
  misc_feature (513)..(513): n is a, c, g, or t
  modified_base (517)..(518): a, c, t, g, unknown or other
  misc_feature (517)..(518): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccaggggaaccctgggtcaccgtctcctcagcctccaccaagggcccatcggtcttccccctggcaccctcctccaagagcacctctggggcacagcggccctgggctgcctggtcaaggctacttccatctacactactgacgcgggctggcaaggcgnatgnn

SEQ ID NO: 222866 - DNA, 173 bp, Homo sapiens; identical to SEQ ID NO: 222839
  misc_feature: GYAE6OF01BH3MR.37.25.C03.1.454.CMB.1.raw
  modified_base (173)..(173): a, c, t, g, unknown or other
  misc_feature (173)..(173): n is a, c, g, or t

SEQ ID NO: 222867 - DNA, 174 bp, Homo sapiens; identical to SEQ ID NO: 222843
  misc_feature: GYAE6OF01COI1Z.37.25.C03.1.454.CMB.1.raw
  modified_base (173)..(174): a, c, t, g, unknown or other
  misc_feature (173)..(174): n is a, c, g, or t

SEQ ID NO: 222868 - DNA, 231 bp, Homo sapiens
  misc_feature: GYAE6OF01BZWJT.37.25.C03.1.454.CMB.1.raw
  modified_base (231)..(231): a, c, t, g, unknown or other
  misc_feature (231)..(231): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagn

SEQ ID NO: 222869 - DNA, 173 bp, Homo sapiens; identical to SEQ ID NO: 222839
  misc_feature: GYAE6OF01BAZ45.37.25.C03.1.454.CMB.1.raw
  modified_base (173)..(173): a, c, t, g, unknown or other
  misc_feature (173)..(173): n is a, c, g, or t

SEQ ID NO: 222870 - DNA, 173 bp, Homo sapiens; identical to SEQ ID NO: 222839
  misc_feature: GYAE6OF01AZPLA.37.25.C03.1.454.CMB.1.raw
  modified_base (173)..(173): a, c, t, g, unknown or other
  misc_feature (173)..(173): n is a, c, g, or t

SEQ ID NO: 222871 - DNA, 231 bp, Homo sapiens; identical to SEQ ID NO: 222868
  misc_feature: GYAE6OF01C24H0.37.25.C03.1.454.CMB.1.raw
  modified_base (231)..(231): a, c, t, g, unknown or other
  misc_feature (231)..(231): n is a, c, g, or t

SEQ ID NO: 222872 - DNA, 562 bp, Homo sapiens
  misc_feature: GYAE6OF01DZU5B.37.25.C03.1.454.CMB.1.raw
  modified_base (560)..(561): a, c, t, g, unknown or other
  misc_feature (560)..(561): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggagtggggactacgtggggccagggaacccctggtcacgtctcctcacgcctccaccgaacgggcccacgtccggtcctttaccccccgtggccaccccgtccctcccaacgacgccaacccgtcgtcgggggccaacgacgccgggccctgggcctcggcctggtacaacggtactacctccatcctaccactacgtgacggcgggctggacgtaacggcgcatgnng

SEQ ID NO: 222873 - DNA, 233 bp, Homo sapiens
  misc_feature: GYAE6OF01EZRXF.37.25.C03.1.454.CMB.1.raw
  modified_base (232)..(233): a, c, t, g, unknown or other
  misc_feature (232)..(233): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnn

SEQ ID NO: 222874 - DNA, 219 bp, Homo sapiens
  misc_feature: GYAE6OF01B6Z07.37.25.C03.1.454.CMB.1.raw
  modified_base (177)..(178): a, c, t, g, unknown or other
  misc_feature (177)..(178): n is a, c, g, or t
  modified_base (180)..(219): a, c, t, g, unknown or other
  misc_feature (180)..(219): n is a, c, g, or t
tcagtagtgtagatcacgaccggtgctcgatttagtagtgtagatttgggtttgggggaagggaggaagactgacggtcccccaggagttcaggtgctgggcacagcggccctgggctgcctggtcaaggactacttccatctacactactgagcgggctggcaaggcgcgagtagnngnnnnnnnnnnnnnnnnnnnnnnnnnnnnnnnnnnnnnnnn

SEQ ID NO: 222875 - DNA, 527 bp, Homo sapiens
  misc_feature: GYAE6OF01CITG6.37.25.C03.1.454.CMB.1.raw
  modified_base (522)..(522): a, c, t, g, unknown or other
  misc_feature (522)..(522): n is a, c, g, or t
  modified_base (526)..(527): a, c, t, g, unknown or other
  misc_feature (526)..(527): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaaggctggggatggggggactacgtggggccagggaaccctggtcaccgtctcctcagcctccaccaaggcccatccggtccttccccctggccaccctcctccaacgacgccacctctcgggggcacgacgccggccctgggcctggcctggtccaaggactacttccatctacactactgagcggctggcaggcgnatgnn

SEQ ID NO: 222876 - DNA, 233 bp, Homo sapiens; identical to SEQ ID NO: 222873
  misc_feature: GYAE6OF01DBL9O.37.25.C03.1.454.CMB.1.raw
  modified_base (232)..(233): a, c, t, g, unknown or other
  misc_feature (232)..(233): n is a, c, g, or t

SEQ ID NO: 222877 - DNA, 173 bp, Homo sapiens; identical to SEQ ID NO: 222839
  misc_feature: GYAE6OF01EX6RZ.37.25.C03.1.454.CMB.1.raw
  modified_base (173)..(173): a, c, t, g, unknown or other
  misc_feature (173)..(173): n is a, c, g, or t

SEQ ID NO: 222878 - DNA, 450 bp, Homo sapiens
  misc_feature: GYAE6OF01BESL2.37.25.C03.1.454.CMB.1.raw
  modified_base (444)..(450): a, c, t, g, unknown or other
  misc_feature (444)..(450): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggccaccctcctccaagagcacctctgggggcacagcggccctgggctgcctggtcaaggctacttccatctacactactgagcgggctggcaaggcgcatagnnnnnnn

SEQ ID NO: 222879 - DNA, 545 bp, Homo sapiens
  misc_feature: GYAE6OF01C8ICE.37.25.C03.1.454.CMB.1.raw
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatgggggactacgtggggccgagggaaccctggtcaccgtctcctcacgcctccaccaagggcccatcggtcttccccctggccaccctcctcccaacgagccaccctcgtcgggggcaccgacgccggccccgtggggcctcggcccgttgggtcaacgggacctaccgttccactcctacactactgaggcgggctggcaaggcgnatgn

SEQ ID NO: 222880 - DNA, 765 bp, Homo sapiens
  misc_feature: GYAE6OF01B3I2Z.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagacctcgaggacgggtccgtacacactcctacgagacgaactacttaccgaaagaacacgtcctactacttcgtcgaactaaagtacgaaacgacgtccgtaggaaggaccgaaccggaaacgaccggaccggtaccgttaattacttacgtggtggtaaaggaaacggtcgggtaggggtaggggtacgggggtaaccttacggggtacggggaccggaaaccggggtaacccggttcggtacccgtaccggttccctaccgtacgaccgtacccctacccgaaccgggtaacccggccctaacggttccccggttcccccttccccggtcggacccctaccccgttccctaacgaacgccgaccctacccgttcggggacggggacccaacgggaccggtcccggtacccggtcgggtcctcccggtccggttacggtaaaccggaaccggttacccttacccgtacctacttacccgtaaacctaccgttacggtagggacccgggtccggtacgtaccgggaacggacgggccaacgtaagtgcga

SEQ ID NO: 222881 - DNA, 509 bp, Homo sapiens
  misc_feature: GYAE6OF01BLKCT.37.25.C03.1.454.CMB.1.raw
  modified_base (508)..(509): a, c, t, g, unknown or other
  misc_feature (508)..(509): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctgggatgggggactacgtggggccagggaaccctggtcaccgtctcctcagcctccacaacggcccatcggtcttccccctggccaccctcctccaagacgcacctctggggcacagcggcctgggctgcctggtcaggctactcatcacactactgacgcggctggcaggcgacatgnn

SEQ ID NO: 222882 - DNA, 197 bp, Homo sapiens
  misc_feature: GYAE6OF01ELLXI.37.25.C03.1.454.CMB.1.raw
  modified_base (174)..(197): a, c, t, g, unknown or other
  misc_feature (174)..(197): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcggctggcaaggcgcatagnnnnnnnnnnnnnnnnnnnnnnnn

SEQ ID NO: 222883 - DNA, 520 bp, Homo sapiens
  misc_feature: GYAE6OF01DTI7M.37.25.C03.1.454.CMB.1.raw
  modified_base (515)..(515): a, c, t, g, unknown or other
  misc_feature (515)..(515): n is a, c, g, or t
  modified_base (519)..(520): a, c, t, g, unknown or other
  misc_feature (519)..(520): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatccggtcttccccctggccaccctcctccaagacgcacctctggggcacagcggccctgggctgcctggtcaaggactacttccatcctacactactgagcgggctggcaaggcgnatgnn

SEQ ID NO: 222884 - DNA, 255 bp, Homo sapiens
  misc_feature: GYAE6OF01ET2C3.37.25.C03.1.454.CMB.1.raw
  modified_base (203)..(203): a, c, t, g, unknown or other
  misc_feature (203)..(203): n is a, c, g, or t
  modified_base (233)..(255): a, c, t, g, unknown or other
  misc_feature (233)..(255): n is a, c, g, or t
tcagtagtgtagatcacgaccggtgctcgatttagtagtgtagatttgggtttggggggacgtactggggccagggaaccctggtcaccgtctcctcagcctccaccaagggcccatcggtcttccccctggcaccctcctccaagagcacctctggggcacagcggccctgggctgcctggtcaaggactacttccatctanactactgagcgggctggcaaggcgcatagnnnnnnnnnnnnnnnnnnnnnnn

SEQ ID NO: 222885 - DNA, 234 bp, Homo sapiens
  misc_feature: GYAE6OF01CMVR7.37.25.C03.1.454.CMB.1.raw
  modified_base (232)..(234): a, c, t, g, unknown or other
  misc_feature (232)..(234): n is a, c, g, or t
tcagtagtgtagatcacgaccggtgctcgatttagtagtgtagatttggggttgggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnn

SEQ ID NO: 222886 - DNA, 186 bp, Homo sapiens
  misc_feature: GYAE6OF01BFUM1.37.25.C03.1.454.CMB.1.raw
  modified_base (173)..(186): a, c, t, g, unknown or other
  misc_feature (173)..(186): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnnnnnnnnnnnnnn

SEQ ID NO: 222887 - DNA, 550 bp, Homo sapiens
  misc_feature: GYAE6OF01CUTNC.37.25.C03.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (521)..(522): a, c, t, g, unknown or other
  misc_feature (521)..(522): n is a, c, g, or t
  modified_base (524)..(525): a, c, t, g, unknown or other
  misc_feature (524)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(545): a, c, t, g, unknown or other
  misc_feature (541)..(545): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
tcagtagtgtagatcacgaccggtgctcgatttagtagtgtagatttgggtttgggctcaactctcttgtccgccaggctccaggcatcgggctgcagtggtctcaagtactagtgctcctggtaatagagcagactacgcagactccgtgaagggccgttcaccatctcagagacaattccaagaacacgcgtactatctgcaaatgaacaggcctgagagcgaancacggctatattacngtgtgaaaggctggggatgggggactacgtgggccaggaccctggtcaccgtctcctcacgcctccaaccgaagggcccaagtccggtaccttcccccgtggaccaacccctcctcccaaagacgcctacccgtacgttcgggggacacgacggccggacccgtgggtcctgccctcggtacaacggaccttacgttcccattacctaaccgactaacgtggaacggccgggtacgttcggacgtaacggtacgactacgtagcagatananncncncnntnngngngngngngnanannnnncngnn

SEQ ID NO: 222888 - DNA, 453 bp, Homo sapiens
  misc_feature: GYAE6OF01DU29Y.37.25.C03.1.454.CMB.1.raw
  modified_base (445)..(453): a, c, t, g, unknown or other
  misc_feature (445)..(453): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctccaccaaggcccatcggtcttccccctggccaccctctccaagacgcacctcgtcggggcacagcggccctgggctgcctggtcaaggactacttccatctacactactgagcgggctggcaaggcgcatagnnnnnnnnn

SEQ ID NO: 222889 - DNA, 175 bp, Homo sapiens
  misc_feature: GYAE6OF01CVPM5.37.25.C03.1.454.CMB.1.raw
  modified_base (174)..(175): a, c, t, g, unknown or other
  misc_feature (174)..(175): n is a, c, g, or t
tcagtagtgtagatcacgaccggtgctcgatttagtagtgtagatttgggtttggggggaagaggaagactgacggtcccccaggagttcaggtgctgggcacagcggccctgggctgcctggtcaaggactacttccatctacactactgagcgggctggcaaggcgcatagnn

SEQ ID NO: 222890 - DNA, 173 bp, Homo sapiens; identical to SEQ ID NO: 222839
  misc_feature: GYAE6OF01C47ZP.37.25.C03.1.454.CMB.1.raw
  modified_base (173)..(173): a, c, t, g, unknown or other
  misc_feature (173)..(173): n is a, c, g, or t

SEQ ID NO: 222891 - DNA, 174 bp, Homo sapiens; identical to SEQ ID NO: 222843
  misc_feature: GYAE6OF01BIMNP.37.25.C03.1.454.CMB.1.raw
  modified_base (173)..(174): a, c, t, g, unknown or other
  misc_feature (173)..(174): n is a, c, g, or t

SEQ ID NO: 222892 - DNA, 259 bp, Homo sapiens
  misc_feature: GYAE6OF01C3OA3.37.25.C03.1.454.CMB.1.raw
  modified_base (227)..(227): a, c, t, g, unknown or other
  misc_feature (227)..(227): n is a, c, g, or t
  modified_base (233)..(259): a, c, t, g, unknown or other
  misc_feature (233)..(259): n is a, c, g, or t
tcagtagtgtagatcacgaccggtgctcgatttagtagtgtagatttgggtttgggggacgtactggggcccagggaaccctggtcaccgtctcctcagcctccaccaagggcccatcggtcttcccctggcacccctcctccaagagcacctctggggcacagcggccctgggctgcctggtcaaggactacttccatctacactactgagcgggctggcaaggcncatagnnnnnnnnnnnnnnnnnnnnnnnnnnn

SEQ ID NO: 222893 - DNA, 542 bp, Homo sapiens
  misc_feature: GYAE6OF01CIZUH.37.25.C03.1.454.CMB.1.raw
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggcgtatattactgtgtgaaaggctggggagtgggggactacgtggggccagggaaccctggtcaccgtctcctcacgcctccaccgaacggcccatccggtccttcccccgtggccaccctccctaccaacgacgccaccctcgtcgggggcacgacgcggcccgtgggcctcgcctggacgaaggacctacttcccatcctaccacgtactgacggtcggctggacaggcnatagcn

SEQ ID NO: 222894 - DNA, 451 bp, Homo sapiens
  misc_feature: GYAE6OF01C1JYF.37.25.C03.1.454.CMB.1.raw
  modified_base (443)..(451): a, c, t, g, unknown or other
  misc_feature (443)..(451): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatagnnnnnnnnn

SEQ ID NO: 222895 - DNA, 548 bp, Homo sapiens
  misc_feature: GYAE6OF01BSD8N.37.25.C03.1.454.CMB.1.raw
  modified_base (435)..(435): a, c, t, g, unknown or other
  misc_feature (435)..(435): n is a, c, g, or t
  modified_base (534)..(534): a, c, t, g, unknown or other
  misc_feature (534)..(534): n is a, c, g, or t
tcagtagtgtagatcacgaccggtgctcgatttagtagtgtagatttgggtttgggggaggcctggtgcagcctggggggtccctgatactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtagaaggaagggtctagcagtgcctggtactcccactactatatggacgtcgtggggcaaaggatcgcggtcaccgtctcctcacgcctccaccaaggcccatccgtcttccccnggccacccctccccaagacgccaccctcgtcggggccacgcggccggcccgtcgggcctcggccgtcggtacaacggacctacttccacttactaaccncctacgtggaacgg

SEQ ID NO: 222896 - DNA, 173 bp, Homo sapiens; identical to SEQ ID NO: 222839
  misc_feature: GYAE6OF01ACSR2.37.25.C03.1.454.CMB.1.raw
  modified_base (173)..(173): a, c, t, g, unknown or other
  misc_feature (173)..(173): n is a, c, g, or t

SEQ ID NO: 222897 - DNA, 584 bp, Homo sapiens
  misc_feature: GYAE6OF01BYIFT.37.25.C03.1.454.CMB.1.raw
tcagtagtgtagatcacgaccggtgctcgatttagtagtgtagatttgggtttgggctgagctggcttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccaccaggctccaggcagtggggctgcagtgggtctcaagtactagtgctcctggtaatagagcagactacgcagactccgtgaacgggccgttcaccatcctcagagacaattccaagaacacgctctatctgacaaatgaacagcctgagagaccgaagacacggctatatactgtgtagaaggcgtggggagtgggggactacggtcggggaccgagggaccccgtggtccgaccgtctccgtcacgccctccaccgaacggccctagtcccggtcccttcccccgtcggccctaccccgtcctaccgaacgacgccgacccgtcggtccggggaccacggaccggcccggcccgtcggggccgtcccggg

SEQ ID NO: 222898 - DNA, 173 bp, Homo sapiens; identical to SEQ ID NO: 222839
  misc_feature: GYAE6OF01A7FHX.37.25.C03.1.454.CMB.1.raw
  modified_base (173)..(173): a, c, t, g, unknown or other
  misc_feature (173)..(173): n is a, c, g, or t

SEQ ID NO: 222899 - DNA, 175 bp, Homo sapiens
  misc_feature: GYAE6OF01BWOD6.37.25.C03.1.454.CMB.1.raw
  modified_base (173)..(175): a, c, t, g, unknown or other
  misc_feature (173)..(175): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnnn

SEQ ID NO: 222900 - DNA, 452 bp, Homo sapiens
  misc_feature: GYAE6OF01AJQY1.37.25.C03.1.454.CMB.1.raw
  modified_base (444)..(452): a, c, t, g, unknown or other
  misc_feature (444)..(452): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccggtctcctcagcctccaccaagggcccatcggtctccccctggcaccctcctccaagagcacctctgggggcacagcggccctgggctgcctggtcaaggactacttccatctacactactgagcgggctggcaaggcgcatagnnnnnnnnn

SEQ ID NO: 222901 - DNA, 569 bp, Homo sapiens
  misc_feature: GYAE6OF01AL6FH.37.25.C03.1.454.CMB.1.raw
  modified_base (564)..(564): a, c, t, g, unknown or other
  misc_feature (564)..(564): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggcgtggggagtgggggactacgtggggccgacgggaacccgtggtcaccgtctcctcacgcctccaccgaacggcccagtccggtccttcccccgtggccgccctcgcctcccgacggacgccgaccctccggagacgccacgacggccggccctgggcctcgccgtcggtacaacggcctacttcccagtacctacacctacgtcggacggccgggtactacgggcgaagggcgcngtacg

SEQ ID NO: 222902 - DNA, 197 bp, Homo sapiens
  misc_feature: GYAE6OF01C4Q3V.37.25.C03.1.454.CMB.1.raw
  modified_base (176)..(197): a, c, t, g, unknown or other
  misc_feature (176)..(197): n is a, c, g, or t
tcagtagtgtagatcacgaccggtgctcgatttagtagtgtagatttgggtttggggggaagaggaagactgacggtcccccaggagttcaggtgctgggcacagcggccctgggctgcctggtcaaggactacttccatctacactactgagtcgggctggcaaggcgtcatagnnnnnnnnnnnnnnnnnnnnnn

SEQ ID NO: 222903 - DNA, 232 bp, Homo sapiens
  misc_feature: GYAE6OF01CVWZW.37.25.C03.1.454.CMB.1.raw
  modified_base (231)..(232): a, c, t, g, unknown or other
  misc_feature (231)..(232): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnn

SEQ ID NO: 222904 - DNA, 235 bp, Homo sapiens
  misc_feature: GYAE6OF01BYM2G.37.25.C03.1.454.CMB.1.raw
  modified_base (232)..(235): a, c, t, g, unknown or other
  misc_feature (232)..(235): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 222905 - DNA, 513 bp, Homo sapiens
  misc_feature: GYAE6OF01AS7UC.37.25.C03.1.454.CMB.1.raw
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (420)..(425): a, c, t, g, unknown or other
  misc_feature (420)..(425): n is a, c, g, or t
  modified_base (427)..(429): a, c, t, g, unknown or other
  misc_feature (427)..(429): n is a, c, g, or t
  modified_base (431)..(432): a, c, t, g, unknown or other
  misc_feature (431)..(432): n is a, c, g, or t
  modified_base (435)..(436): a, c, t, g, unknown or other
  misc_feature (435)..(436): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(450): a, c, t, g, unknown or other
  misc_feature (448)..(450): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagtagtgtagatcacgaccggtgctcgatttagtagtgtagatttggggtttgggggattcacgttagcgagacgtccgtggaagggccggttcaaccatcgtccagagacaacttccaagtaacacgtctctatctgcaaatgaacagcctgacgaggccgaagacacggccgtatattacctgttgtgaaaggctgggggatggggggactactggggccaggggaaccctgggtcaccgtctcctacagcctccaccaagggcccatcggtcttcccctggccacctcctccaagagtcacctcgtcgggggcacagacggcctgggctcgcctaggtcaaggacttactccgatcctacgactactcggacgcgggtctggcgtaaggcgacgagtacggngcgntgctgnacnnnnnncnnngnnagnngngntntntntnnnanatntntctctntctntgngngagngngnanacgacgatagngcncncncactntctctntc

SEQ ID NO: 222906 - DNA, 175 bp, Homo sapiens
  misc_feature: GYAE6OF01CV3U8.37.25.C03.1.454.CMB.1.raw
  modified_base (175)..(175): a, c, t, g, unknown or other
  misc_feature (175)..(175): n is a, c, g, or t
tcagtagtgtagatcacgaccggtgctcgatttagtagtgtagatttgggtttggggtggaagaggaagactgacggtcccccaggagttcaggtgctgggcacagcggccctgggctgcctggtcaaggactacttccatctacactactgagcgggctggcaaggcgcatagn

SEQ ID NO: 222907 - DNA, 549 bp, Homo sapiens
  misc_feature: GYAE6OF01ES8P1.37.25.C03.1.454.CMB.1.raw
  modified_base (514)..(514): a, c, t, g, unknown or other
  misc_feature (514)..(514): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtagaaaggcgtgggagtgggggactacgtggggcaggggaaccctggtcacgtctcctcacgcctccaccgaagggccccaagtccggtccttcccccgtggccaccctcctacccaagacgccaccctcgtcgggggcaacgacgcggcccgtgggctcgccgtggtcaacggacctacttccatcctaacnctactgacgcgggctggactaaggcganagtagna

SEQ ID NO: 222908 - DNA, 182 bp, Homo sapiens
  misc_feature: GYAE6OF01AF1YB.37.25.C03.1.454.CMB.1.raw
  modified_base (173)..(182): a, c, t, g, unknown or other
  misc_feature (173)..(182): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnnnnnnnnnn

SEQ ID NO: 222909 - DNA, 211 bp, Homo sapiens
  misc_feature: GYAE6OF01EHKOB.37.25.C03.1.454.CMB.1.raw
  modified_base (178)..(211): a, c, t, g, unknown or other
  misc_feature (178)..(211): n is a, c, g, or t
tcagtagtgtagatcacgaccggtgctcgatttagtagtgtagatttgggtttgggggggaaggagggaagactgacggtccccccaggagttcaggtgctgggcaccagcggccctgggctgcctggtcaaggctacttccatctacactactgagcgggctggcaaggcgcatagnnnnnnnnnnnnnnnnnnnnnnnnnnnnnnnnnn

SEQ ID NO: 222910 - DNA, 379 bp, Homo sapiens
  misc_feature: GYAE6OF01DQLKQ.37.25.C03.1.454.CMB.1.raw
  modified_base (372)..(379): a, c, t, g, unknown or other
  misc_feature (372)..(379): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatccggtcttcccccgtggccaccctcctccaagagcacctctgggggcacagcggccctgggctgcctggtcaaggctacttccatctacactactgagcgggctggcaaggcgcatagnnnnnnnn

SEQ ID NO: 222911 - DNA, 565 bp, Homo sapiens
  misc_feature: GYAE6OF01B9VG8.37.25.C03.1.454.CMB.1.raw
  modified_base (434)..(434): a, c, t, g, unknown or other
  misc_feature (434)..(434): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccaccaggcctccaggcagtggggctgcaggtgggtctcaagtactagtgctcctggtaatagagcagactacgcagactccgtgaagggccggttcaccatctccagacgacaattccaaagaacacgctctatctgacaaatcgaacagcctgagacgaccgaaagacacggtccgtaatattactgtgtagaaggcgtaggggagtgggggacgtacggnggggccgacgggacccgtcggtcgaccgtctcctcacgcctccaccgacggcccacgtccgtcctccccgtcgcccaccctcctaccgacgacgccaccgtcgtcgggcacgcggccgcccgtggcgtcgg

SEQ ID NO: 222912 - DNA, 582 bp, Homo sapiens
  misc_feature: GYAE6OF01BCTNG.37.25.C03.1.454.CMB.1.raw
tcagtagtgtagatcacgaccggtgctcgatttagtagtgtagatttgggtttgggctgagcgtgcgttttcttagtggctattttaaaaggtttccagtgtgaggtgcagttgttggagtctgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccgtgaagggccgttcaccatctccagagacaattccaagacacgctctatctgacaaatgaaacagcctgagacgcccgaaagaccgacgggccgtatacttactgtagtagaaaggcgtaggggagtgggggactacggtcggggaccgacgggaacccgtggtccaccgtctcctcgacgcctccgaccgaacgggcccacgtccggtccttccccgtcggccctaccctccgtaccgaacgtacgcctccgtcgtcggggcctacgacggccggcccgtgggcgtcgg

SEQ ID NO: 222913 - DNA, 633 bp, Homo sapiens
  misc_feature: GYAE6OF01DEK3X.37.25.C03.1.454.CMB.1.raw
  modified_base (241)..(241): a, c, t, g, unknown or other
  misc_feature (241)..(241): n is a, c, g, or t
  modified_base (629)..(629): a, c, t, g, unknown or other
  misc_feature (629)..(629): n is a, c, g, or t
  modified_base (633)..(633): a, c, t, g, unknown or other
  misc_feature (633)..(633): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctctggtaatagagcagactacgcagactcgtgaagggccgttcaccatcncagagacaattccaagaacacgctctatctgcaaatgaacagcccgagagacgacgacacgacgtactattactgtgtagaaggacgtcgggaggtgggggacggtacgtacggggacgggacggaaccggtacggtcgtaccgtccgtcctccgacgcctcccaccgaaccggaccgacctccggtccttaccccgtccggtccgacccctaccctcccgtaacgaccggacctacccgtaccggtccggggaccggacccacggacccggacccggtaccgggccgtacggcccgtacggtaccgtaacggtaaccgttaccttccgtactaccgtacctactaccgtacgcgggacggccggtggtaccgacggacgcgatacgngcgn

SEQ ID NO: 222914 - DNA, 446 bp, Homo sapiens
  misc_feature: GYAE6OF01CYWYH.37.25.C03.1.454.CMB.1.raw
  modified_base (440)..(446): a, c, t, g, unknown or other
  misc_feature (440)..(446): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactgggggccaggggaaccctggtcaccgtctcctcagcctccaccaagggcccatcggtcttcccctggcaccctctccagagcacctctggggcacagcgccctgggctgcctggtcaaggctacttccatctacactactgagcgggctggcaaggcgcatagnnnnnnn

SEQ ID NO: 222915 - DNA, 174 bp, Homo sapiens; identical to SEQ ID NO: 222845
  misc_feature: GYAE6OF01BVDWO.37.25.C03.1.454.CMB.1.raw
  modified_base (174)..(174): a, c, t, g, unknown or other
  misc_feature (174)..(174): n is a, c, g, or t

SEQ ID NO: 222916 - DNA, 524 bp, Homo sapiens
  misc_feature: GYAE6OF01BKIY1.37.25.C03.1.454.CMB.1.raw
  modified_base (518)..(518): a, c, t, g, unknown or other
  misc_feature (518)..(518): n is a, c, g, or t
  modified_base (522)..(523): a, c, t, g, unknown or other
  misc_feature (522)..(523): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatatactgtgtgaaaggctggggatggggggactacgtggggccaggggaaccctggtcaccgtctcctcagcctccaccaagggcccatcggtcttccccctggcaccctcctcccaagacgcacctcgtcgggggcacagcggccctcgggctcgccttgggtcaaggactactccatctacactactgagcgggctggcaggcgnatgnng

SEQ ID NO: 222917 - DNA, 175 bp, Homo sapiens; identical to SEQ ID NO: 222899
  misc_feature: GYAE6OF01A5FUC.37.25.C03.1.454.CMB.1.raw
  modified_base (173)..(175): a, c, t, g, unknown or other
  misc_feature (173)..(175): n is a, c, g, or t

SEQ ID NO: 222918 - DNA, 448 bp, Homo sapiens
  misc_feature: GYAE6OF01A1M5U.37.25.C03.1.454.CMB.1.raw
  modified_base (438)..(438): a, c, t, g, unknown or other
  misc_feature (438)..(438): n is a, c, g, or t
  modified_base (444)..(448): a, c, t, g, unknown or other
  misc_feature (444)..(448): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcncatagnnnnn

SEQ ID NO: 222919 - DNA, 174 bp, Homo sapiens; identical to SEQ ID NO: 222845
  misc_feature: GYAE6OF01BELXG.37.25.C03.1.454.CMB.1.raw
  modified_base (174)..(174): a, c, t, g, unknown or other
  misc_feature (174)..(174): n is a, c, g, or t

SEQ ID NO: 222920 - DNA, 186 bp, Homo sapiens
  misc_feature: GYAE6OF01DVSGU.37.25.C03.1.454.CMB.1.raw
  modified_base (175)..(186): a, c, t, g, unknown or other
  misc_feature (175)..(186): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcgggctggcaaggcgcatagnnnnnnnnnnnn

SEQ ID NO: 222921 - DNA, 194 bp, Homo sapiens
  misc_feature: GYAE6OF01A54T7.37.25.C03.1.454.CMB.1.raw
  modified_base (174)..(194): a, c, t, g, unknown or other
  misc_feature (174)..(194): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggtcgcatagnnnnnnnnnnnnnnnnnnnnn

SEQ ID NO: 222922 - DNA, 173 bp, Homo sapiens; identical to SEQ ID NO: 222839
  misc_feature: GYAE6OF01A9O2T.37.25.C03.1.454.CMB.1.raw
  modified_base (173)..(173): a, c, t, g, unknown or other
  misc_feature (173)..(173): n is a, c, g, or t

SEQ ID NO: 222923 - DNA, 611 bp, Homo sapiens
  misc_feature: GYAE6OF01AZK9E.37.25.C03.1.454.CMB.1.raw
  modified_base (607)..(607): a, c, t, g, unknown or other
  misc_feature (607)..(607): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtagaaaggcgtggggagtggggggactacgtggggccagggaacctggtcaccgtctcctcacgcctccaccaacgggcccagtccggtccttcccccgtcggcccacccgtcctaccaacgacgccaccgtcgtcggggaccacgacggccggccccgtcggggcctcggtcccgtcgggtaccgaacgggtacctaccgttccctacgttcctaccgtaaccctaacgtcggtaacgggccggggtccgttacgggaccgaaacggggtccgaccgtaagtacgngtgc

SEQ ID NO: 222924 - DNA, 173 bp, Homo sapiens; identical to SEQ ID NO: 222839
  misc_feature: GYAE6OF01C86TR.37.25.C03.1.454.CMB.1.raw
  modified_base (173)..(173): a, c, t, g, unknown or other
  misc_feature (173)..(173): n is a, c, g, or t

SEQ ID NO: 222925 - DNA, 375 bp, Homo sapiens
  misc_feature: GYAE6OF01ATTPB.37.25.C03.1.454.CMB.1.raw
  modified_base (371)..(375): a, c, t, g, unknown or other
  misc_feature (371)..(375): n is a, c, g, or t
tcagtagtgtagatcacgaccggtgctcgatttagtagtgtagatttgggtttgggattcacgttgcagactcagtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggccaccctcctccaagagccacctctgggggcacagcggccctgggctgcctggtcaaggactacttccatctacactactgagcgggctggcaaggcgcatagnnnnn

SEQ ID NO: 222926 - DNA, 174 bp, Homo sapiens; identical to SEQ ID NO: 222845
  misc_feature: GYAE6OF01EJLF5.37.25.C03.1.454.CMB.1.raw
  modified_base (174)..(174): a, c, t, g, unknown or other
  misc_feature (174)..(174): n is a, c, g, or t

SEQ ID NO: 222927 - DNA, 555 bp, Homo sapiens
  misc_feature: GYAE6OF01CQLZO.37.25.C03.1.454.CMB.1.raw
  modified_base (523)..(523): a, c, t, g, unknown or other
  misc_feature (523)..(523): n is a, c, g, or t
  modified_base (553)..(554): a, c, t, g, unknown or other
  misc_feature (553)..(554): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactcgtgaaggccgttcaccatctccagagacaattccaagaacacgctctatctgcaaatgaacagcctgagagccgaagacacggccgtatattactgtgtgaaaggcgtggggagtgggggactacgtggggccagggaaccctggtcacccgtctcctcacgcctccaccgaagggcccagtccggtaccttccccctggccaccccgtcctcccgaagcgccacccgtcgtgggggcacgacgccggccctgggctcggccgttggtacaacggacctaccttccgatcctaacaccgtacnggacgccgggctggacaagggcagataggnng

SEQ ID NO: 222928 - DNA, 562 bp, Homo sapiens
  misc_feature: GYAE6OF01CPAS0.37.25.C03.1.454.CMB.1.raw
  modified_base (334)..(334): a, c, t, g, unknown or other
  misc_feature (334)..(334): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactcgtgaaggcgttcaccatctccagagacaattccaagaacacgctctatctgcaaatgaacagcctgagagccgaagacacggcatatattattgtgcgaaacgacccaacggtnaccacattggatctttgacttcgtgggaccaagggacaacggtcaccgtctcttcacgcctccaccgaacgggcccaacgtcggtaccttcccccgtggccgcccgtcgcctccgacggacgccaccgtccgaagacgccacgacggccggcccgtgggcctcggccgtggtaccgaagggaccttaccgttccacttcctacctaactacgtacgcggcggtaccgg

SEQ ID NO: 222929 - DNA, 173 bp, Homo sapiens; identical to SEQ ID NO: 222839
  misc_feature: GYAE6OF01AT5PE.37.25.C03.1.454.CMB.1.raw
  modified_base (173)..(173): a, c, t, g, unknown or other
  misc_feature (173)..(173): n is a, c, g, or t

SEQ ID NO: 222930 - DNA, 375 bp, Homo sapiens
  misc_feature: GYAE6OF01D1CXC.37.25.C03.1.454.CMB.1.raw
  modified_base (370)..(375): a, c, t, g, unknown or other
  misc_feature (370)..(375): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccaggggaaccctggtcaccgtctcctcagcctccaccaagggcccatcggtcttccccctggcaccctcctccaagacgcacctctgggggcacagcggccctgggctgcctggtcaaggctacttccatctacactactgagcgggctggcaaggcgcatagnnnnnn

SEQ ID NO: 222931 - DNA, 579 bp, Homo sapiens
  misc_feature: GYAE6OF01D22UZ.37.25.C03.1.454.CMB.1.raw
  modified_base (378)..(378): a, c, t, g, unknown or other
  misc_feature (378)..(378): n is a, c, g, or t
  modified_base (573)..(573): a, c, t, g, unknown or other
  misc_feature (573)..(573): n is a, c, g, or t
  modified_base (578)..(579): a, c, t, g, unknown or other
  misc_feature (578)..(579): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctggcatgaactgggtccgccaggctcaggcatggggctgcagtgggtctcaagtactagtgctcctggtaatagagcagactacgcagactccgtgaagggccgttcaccatctccagagacaattccaagaacacgctctatctgcaaatgaacagcctgagagaccgaagacacggccgtatattactgtgtagaaaggcgtgggagtggggactacggtggggcgaagggaccctggtcacgtctcctnacgcctccaccgacggcccagtccgtccttccccgtggccctaccctcctaccaacgacgaccacccgtcgtcgggggccaacgtacgccggcccgtgggccgtcgccgtcggtacgaaaccggtccttaaccgttccacttcctaaccgtactaccgttggacggccgggactgggaccgaaaggcccgagtanacgtnn

SEQ ID NO: 222932 - DNA, 546 bp, Homo sapiens
  misc_feature: GYAE6OF01BXLL4.37.25.C03.1.454.CMB.1.raw
  modified_base (544)..(544): a, c, t, g, unknown or other
  misc_feature (544)..(544): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggagtgggggactacgtggggccagggaaccctggtcaccgtctcctcagcctcaccaaggcccatccggtcttccccctggccaccctcctcccaagacgccaccgtcgtcgggggcacgacgccggcccgtgggcctcggcccgtggtcaagggtacctacgttccattccaacactactgacggcgggctggcgaacgggcgacatagncg

SEQ ID NO: 222933 - DNA, 535 bp, Homo sapiens
  misc_feature: GYAE6OF01BRJ9F.37.25.C03.1.454.CMB.1.raw
  modified_base (530)..(530): a, c, t, g, unknown or other
  misc_feature (530)..(530): n is a, c, g, or t
  modified_base (534)..(535): a, c, t, g, unknown or other
  misc_feature (534)..(535): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtagaaaggcgtggggagtgggggactacgtggggccagggaaccctggtcaccgtctcctcacgcctccaccgaacggcccagtcggtccttcccccgtggccaccctcctccaagacgcacctcgtggggcacgagccggcccgtgggctgccgtggtccaaggactacttccatcctacactactgacggcggctggcaacggcgacntagnn

SEQ ID NO: 222934 - DNA, 370 bp, Homo sapiens
  misc_feature: GYAE6OF01EHAUV.37.25.C03.1.454.CMB.1.raw
  modified_base (366)..(370): a, c, t, g, unknown or other
  misc_feature (366)..(370): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtctcccctggcaccctcctccaagagcacctctgggggcacagcggccctgggctgcctggtcaaggctacttccatctacactactgagcgggctggcaaggcgcatagnnnnn

SEQ ID NO: 222935 - DNA, 659 bp, Homo sapiens
  misc_feature: GYAE6OF01DWCLE.37.25.C03.1.454.CMB.1.raw
  modified_base (151)..(151): a, c, t, g, unknown or other
  misc_feature (151)..(151): n is a, c, g, or t
  modified_base (656)..(656): a, c, t, g, unknown or other
  misc_feature (656)..(656): n is a, c, g, or t
tcagtagtgtagatcacgaccggtgctcgatttagtagtgtagatttgggtttgggggtaggggcctggtgcgagcctggggggtccctgaggactctcctgtgcagccgtctggattaatgtttagcaactctggcatgaactgggtccnccaggctccaggcctatggggctgcagtgggtctcaagtactagtgcgtcctggtaatagagcagactacgcagactccgtgaaggccggttacaccatctcagagactaattcaagaacacgctactaatcctgacaaactagaaacagaccttagaaggagaccgaaagaccgaccgggccggttaataagtttacctgttcgtagaaaggctaggggagtgggggactacgtaggggaccgagggaacccctggtaccaaccgtctccgtcgacgccctaccgaccaacgggcccaagtcggtccttcccccgtaggtcctacccttccgtaccaacgacgtccaaccgtcgtcgggggaccacgacggccggacccgttggggccttcggccgttagggtaccgaaacgggtctaccgttcctagtccgtaacaccgtaacgttcggaacggtcccgggaccgttcgggaccgtaaacgggtcccgtacctaacgtacgtnacg

SEQ ID NO: 222936 - DNA, 174 bp, Homo sapiens
  misc_feature: GYAE6OF01ECK3R.37.25.C03.1.454.CMB.1.raw
  modified_base (173)..(174): a, c, t, g, unknown or other
  misc_feature (173)..(174): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggaatacttccatctacactactgagcgggctggcaaggcgcatagnn

SEQ ID NO: 222937 - DNA, 864 bp, Homo sapiens
  misc_feature: GYAE6OF01E5HP6.37.25.C03.1.454.CMB.1.raw
  modified_base (861)..(861): a, c, t, g, unknown or other
  misc_feature (861)..(861): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactcgtggcatagacgtcgggtcccgccgaggcctaccgaggcaggtcggggctgcgtagggttcgggtcctacgtaaagttactaggtcgtccttccgttaggttaaataggacgacgaacgtaaccgtaccgacgaacgtacccgttccggtaagggaaccgggggttcccgttacccaacctacgttcctaccgaaggaacgaaaccttaaccttacccgaaaagaaaccaccgtccttacttaactctagaacctaaagtacgaaacacgtccgtaggaacggacgaccggaaagaccgaccgggtaccgttaattaactttacgtggtaggtaaggaaagggtcggtaggggtagggtacggggaacctacgggtcggggaccgaacgggtacccgtcggtaccgtaccgtcctcctacgaccgtccctacccgaaccggtaaccgggcccctacggttcccggttccccctttcccccggcggtacccctacccccttcccgtaaccgaacggaccgacccgtaccccgtcggggtacggggacccaaccggaccgggcccggtcccggtaggggtccctccggtacccgggttaccggtaaccgtaaaccgggtaccctttaacccgttaccctacgtttaacccgaacccgttaaccgttaccggtacgggaaccggggtccgggttaccggtaccgggaaccggtaaccgggccgaacgtaacgtcggnacg

SEQ ID NO: 222938 - DNA, 551 bp, Homo sapiens
  misc_feature: GYAE6OF01DV0H7.37.25.C03.1.454.CMB.1.raw
  modified_base (524)..(524): a, c, t, g, unknown or other
  misc_feature (524)..(524): n is a, c, g, or t
  modified_base (545)..(545): a, c, t, g, unknown or other
  misc_feature (545)..(545): n is a, c, g, or t
  modified_base (549)..(550): a, c, t, g, unknown or other
  misc_feature (549)..(550): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgacaaatgaacagcctagaagacgaccgaagacacggccgtatattactgtgtagaaaggcgtggggagtgggggactacggtggggccgacgggaaccctggtccaccgtctcctcgacgccctaccaccgaacgggcccacgtccggtccttcccccgtggccacccctcctacccaagacgccaccgtcgtcggggcacgagccggccgtgggctgcctggtcaagactactccatcctacacgtacngacggcggctggacaaggcanatgnng

SEQ ID NO: 222939 - DNA, 604 bp, Homo sapiens
  misc_feature: GYAE6OF01CD5WL.37.25.C03.1.454.CMB.1.raw
  modified_base (602)..(604): a, c, t, g, unknown or other
  misc_feature (602)..(604): n is a, c, g, or t
tcagtagtgtagatcacgaccggtgctcgatttagtagtgtagatttggggtttgggggaggcctggtgcagccgtggggggtccctgagactctcctgtgcagcctctggattaatgtttagcaactctggcatgaactgggtcccgccaggctccgggcagtggggctgcagtgggtctcaagtactagtgctcctggtaatagagcagactacgcagactccgtgaacgggccgttcaccatctccagagacaattccaagacacgctctatctgacaaatgaacagcctagagacgaccgaagacacggccgtatattactgtgtagaaaggcgtggggagtgggggactacggtggggaccagggaaccctggccaccgtctcctcgacgcctccaaccgaacgggcccacgtccggtccttcccccgtcggccctaccctccctaccgaacgacgaccgacctcgtcggggccacgacggcccgggcccgtcgggaccgtcggcccgttacgggtaccgaacgggtacctaccgttcccacttcctaacctaccttacgtcggacggccggcgtcggacgaacggcgacgatacgnnn

SEQ ID NO: 222940 - DNA, 565 bp, Homo sapiens
  misc_feature: GYAE6OF01B7NWD.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaaggccgttacacatctccagagacaattccaagaacacgctctatctgacaaatgaacagcctgagacgccgaagacacggccgtatattactgtgtagaaaggcgtaggggacgtgggggactacggtggggccgagggtaacccgtggtactaccgtctccgtcacgcctaccacgaacggcccagtccgtccttccccgtggcctaccctcctacaacgcgacaccgtcgtggggacacgacggcggcccgtggcctcgccgtggtacaacggtacctacgttccatcctaaccacgtacgtgacggccggtcgtggacgaacggcgaccatggctg

SEQ ID NO: 222941 - DNA, 555 bp, Homo sapiens
  misc_feature: GYAE6OF01BWKJJ.37.25.C03.1.454.CMB.1.raw
  modified_base (553)..(553): a, c, t, g, unknown or other
  misc_feature (553)..(553): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctggcatgaactgggtccgccaggctccgggcatggggctgcagtgggtctcaagtactagtgctcctggtaatagagcaggactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaccctggtcaccgtctcctcagcctccaccagggcccatcggtcttcccccctggccaccctcctcccaacgacgccacccgtcgtcgggggccacgacgccggcccgtgggcctcgcccgtgggtccaaacgggcctaccttccattcctacacctacgtgaggccgggctcgggcaacgggccgacatacgngc

SEQ ID NO: 222942 - DNA, 758 bp, Homo sapiens
  misc_feature: GYAE6OF01AK4OR.37.25.C03.1.454.CMB.1.raw
tcagtagtgtagatcacgaccggtgctcgatttagtagtgtagatttgggtttggggggaggcctggtagcgagccgtggggggtcccgtgagactactcctggtgtcagcctcctgggatttaatgtttttagctaacttctggcagtgaactgggtccgccaggctccggaggtctagtcggggctgccagtcgggtctcaagtctagtgcgtccgtagggtaagtacgacgcagaaccttacggcaagacctccggtcgaaacgggtcccgttttacaacccaacttcctaccaagtaagaactaaattccaaacgtaacaccgctactaaactcgtagacaaactcgaaacaggcctggacgacgaccgtaagacggaccggtacccgttaacgtaatttacgtcgggttacgtaggaaacgggtcgttggggaggttacggggggaacgtacgggtcggggccggaacgggtaacccgttggtacctaacccgttccgtccctacaacgtccctacgaacccgaacgggcccctacgttccgggtccccgttcccccgtaggacctaccccgtccgtaccgaacgtacgtcctacccgtcggtcggggaccacgtacgtcccggtcccgttcggtccgttcgccgttcggtaccgaacggtaccgttaccgttaccgagttaccgtaccgtaaccgtaccgttaggacgggtccgggtcgttacgggccgtaacggcgtaactgttcgctacg

SEQ ID NO: 222943 - DNA, 233 bp, Homo sapiens; identical to SEQ ID NO: 222840
  misc_feature: GYAE6OF01B7S2U.37.25.C03.1.454.CMB.1.raw
  modified_base (231)..(233): a, c, t, g, unknown or other
  misc_feature (231)..(233): n is a, c, g, or t

SEQ ID NO: 222944 - DNA, 524 bp, Homo sapiens
  misc_feature: GYAE6OF01BH177.37.25.C03.1.454.CMB.1.raw
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaaggccgttcaccatctccagagacaattccaagaacacgctctatctgcaaatgaacagcctgagagccgaagacacgcgtatattactgtgtgaaaggctgggagtgggggactacgtggggcaggggaaccctggtcaccgtctctcagcctcacaacgggcccactcggtaccttccccctggccacccgtcctaccaacgacgcacccgtcgtcggggcacagcggccctgggctgcctggcaggactctcgatctacactcgtgacgcgggcgtcggcgtaacggcganatagn

SEQ ID NO: 222945 - DNA, 550 bp, Homo sapiens
  misc_feature: GYAE6OF01B5W3C.37.25.C03.1.454.CMB.1.raw
  modified_base (548)..(548): a, c, t, g, unknown or other
  misc_feature (548)..(548): n is a, c, g, or t
tcagtagtgtagatcacgaccggtgctcgatttagtagtgtagatttgggtttgggggaggcctggtgcagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccaacggaaccctggtccaccgtctcctcagccctccaccaacgggcccagtccggtccttcccccgtcggccaccctcctaccaagacgccaccctcgtcggggcacgacgccggcccgtgggctcgcctggtacaacggactacctccactcctacactactgacgcggctggcaaggcgnag

SEQ ID NO: 222946 - DNA, 468 bp, Homo sapiens
  misc_feature: GYAE6OF01BKTUM.37.25.C03.1.454.CMB.1.raw
  modified_base (360)..(360): a, c, t, g, unknown or other
  misc_feature (360)..(360): n is a, c, g, or t
  modified_base (450)..(468): a, c, t, g, unknown or other
  misc_feature (450)..(468): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggggactacgtgggggccagggaaccctggtcaccgtctcctcagcctccaccaaggcccatcggtcttccccctggccaccctcctccaagngcacctcgtgggggcacaggccggccctgggcctgcctggtcaaggctactccatctacactactgagcgggctggcaaggcgcatagcnnnnnnnnnnnnnnnnnnn

SEQ ID NO: 222947 - DNA, 549 bp, Homo sapiens
  misc_feature: GYAE6OF01DKDO4.37.25.C03.1.454.CMB.1.raw
  modified_base (543)..(543): a, c, t, g, unknown or other
  misc_feature (543)..(543): n is a, c, g, or t
  modified_base (548)..(549): a, c, t, g, unknown or other
  misc_feature (548)..(549): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtagaaaggctggggagtgggggactacgtggggccgagggaaccctggtcaccgtctcctcagcctccaccaacgggcccagtccggtccttcccccgtggccacccctcctccaacgacgcaccctcgtcggggccacgacgccggccctgggcctcggccgtggtccaagggacctaccttccactcctacacgtactgacgcgggctggactaaggcganagtgnn

SEQ ID NO: 222948 - DNA, 173 bp, Homo sapiens; identical to SEQ ID NO: 222839
  misc_feature: GYAE6OF01EB5CM.37.25.C03.1.454.CMB.1.raw
  modified_base (173)..(173): a, c, t, g, unknown or other
  misc_feature (173)..(173): n is a, c, g, or t

SEQ ID NO: 222949 - DNA, 567 bp, Homo sapiens
  misc_feature: GYAE6OF01AHC78.37.25.C03.1.454.CMB.1.raw
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatgggggactacgtggggccagggaacccctggtcaccgtctcctcacgcctccaccgaacgggcccagtccggtccttcccccgtggccaccctcctaccaagacgccaccgtcgtggggccacgacgccggcccgtgggctcggcctggtccaagggaccttaccgttccacttcctaaccacctacgtgacggtccgggcgtcggaccgaacgggccganatacggntacg

SEQ ID NO: 222950 - DNA, 589 bp, Homo sapiens
  misc_feature: GYAE6OF01DFKMG.37.25.C03.1.454.CMB.1.raw
  modified_base (319)..(319): a, c, t, g, unknown or other
  misc_feature (319)..(319): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgngtgaaaggcgtggggagtgggggacgtacgtggggccgagggaaccctggtccgaccgtcgtcctcgacgccctcccaaccgaacgggccccacttcccgggttccctttccccccgtcggtacccaccccttacccctcccaaacgacgacccacccgtccgtcggggggccaccgacggccggccccgtcgggcctcggcccgtggtacaacggtactaccttccactcctacacgtactgacggcgggctggcaacggcgcagngnn

SEQ ID NO: 222951 - DNA, 569 bp, Homo sapiens
  misc_feature: GYAE6OF01D3OJQ.37.25.C03.1.454.CMB.1.raw
  modified_base (561)..(561): a, c, t, g, unknown or other
  misc_feature (561)..(561): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaaggccgttcaccatctccagagacaattccaagaacacgctctatctgcaaatgaacagcctgagacgccgaagacacggccgtatattactgtgtagaaaggcgtgggagtagggggactacgtcggggccgaagggaaccctggtccaccgtctccctcacgcctaccgaccgaacgggcccacgtcggtccttcccccgtggaccaccctcctaccaacgacgccaccgtccgtgggggccacgacggccggcccgtgggcctcgcccgtggtcaacggtactacgttccactctacactacgtagacggcgggccgtgggaccaacggcganactagcag

SEQ ID NO: 222952 - DNA, 640 bp, Homo sapiens
  misc_feature: GYAE6OF01DAPJB.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccgttcaccatctcagagacaatccaagaacacgctctatctgcaaatgaacagcctgagagccgaagacacggccctaatatactagtaacgaaaatggcctacggatatagactaactagttggactggtacttcgatctcgtgggccgtggccaccctggtcacttgtctcctcacgccctcccaaccgaacgggccctaagtccgggtttcccttccccccgtgggtcccgcccccgtgcccgttcccgaacgggccgtaccgtaacccttacccgggaacgacggcccaaaccgacggccccggggtaccccgtcgggggcccttcggcccgtttcgggtaccgaaaaaccggggtaaccttaccctttacccaaagttcccttaaaccgaaccgttaaacccggg

SEQ ID NO: 222953 - DNA, 554 bp, Homo sapiens
  misc_feature: GYAE6OF01BF73Z.37.25.C03.1.454.CMB.1.raw
  modified_base (547)..(547): a, c, t, g, unknown or other
  misc_feature (547)..(547): n is a, c, g, or t
  modified_base (552)..(553): a, c, t, g, unknown or other
  misc_feature (552)..(553): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggagtgggggactacgtggggccagggaaccctggtcaccgtctcctcagccctccaccgaacgggcccatccggtccttcccccgtggccacccctcctcccaacgacgccacctcgtcggggcaccgagcggccctggggcctcgtcccgtgggtccaacgggtacctacgttccactcctaacactacgtgacggcgggctggactacggcnactgnng

SEQ ID NO: 222954 - DNA, 175 bp, Homo sapiens; identical to SEQ ID NO: 222889
  misc_feature: GYAE6OF01C0N35.37.25.C03.1.454.CMB.1.raw
  modified_base (174)..(175): a, c, t, g, unknown or other
  misc_feature (174)..(175): n is a, c, g, or t

SEQ ID NO: 222955 - DNA, 234 bp, Homo sapiens
  misc_feature: GYAE6OF01EJ2DO.37.25.C03.1.454.CMB.1.raw
  modified_base (232)..(234): a, c, t, g, unknown or other
  misc_feature (232)..(234): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnn

SEQ ID NO: 222956 - DNA, 571 bp, Homo sapiens
  misc_feature: GYAE6OF01CULP5.37.25.C03.1.454.CMB.1.raw
  modified_base (570)..(570): a, c, t, g, unknown or other
  misc_feature (570)..(570): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtagaaaggcgtggggagtgggggactacgtggggaccgagggaaccctggtcaccgtctcctcacgccctccaccgaacgggccccacgttccggtccttcccccgtcggccacccgtccctccaacgacgccacctcgtcggggcacgacgccggcccgtgggcctcgcctgggtaccaacgggacttaccttccacttcctaccaccgttaacgtgacggcggccgtggacgtaacggcacgatagnc

SEQ ID NO: 222957 - DNA, 571 bp, Homo sapiens
  misc_feature: GYAE6OF01A3KFV.37.25.C03.1.454.CMB.1.raw
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggcgtggggagtgggggactacgtggggccagggaaccctggtcaccgtctcctcacgcctccacccgaagggcccagtcggtccttcccccgtggccaccctccctaccaacgacgccaccgtcgtcggggccacgacgccggccctggggcctcggccgtcggtccgaacggtacctaaccgttccactacctacaccttacgtgacggcggggctagggacgtaacggccganaacgtgngn

SEQ ID NO: 222958 - DNA, 567 bp, Homo sapiens
  misc_feature: GYAE6OF01BCFJU.37.25.C03.1.454.CMB.1.raw
  modified_base (560)..(560): a, c, t, g, unknown or other
  misc_feature (560)..(560): n is a, c, g, or t
  modified_base (565)..(567): a, c, t, g, unknown or other
  misc_feature (565)..(567): n is a, c, g, or t
tcagtagtgtagatcacgaccggtgctcgatttagtagtgtagatttgggtttgggggaggcctggtgcaccctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaaatgaacagcctgagagccgaagacacggccgtatatactgtgtgaaaggctggggatgggggggactacgtggggccagggaaccctggtcaccggtctcctcacgcctccaccgaacgggccccagtccgggtccttccccccgtggccccacccctccctaccgaacgacgacctaccctcgtcgggggcacgacgccgggcccgtgggcctgcccgtggtccaaggacctaccttccattcctacacctacgtggacgcggggctcgggacaacggcncatgnnn

SEQ ID NO: 222959 - DNA, 175 bp, Homo sapiens; identical to SEQ ID NO: 222889
  misc_feature: GYAE6OF01D1PLA.37.25.C03.1.454.CMB.1.raw
  modified_base (174)..(175): a, c, t, g, unknown or other
  misc_feature (174)..(175): n is a, c, g, or t

SEQ ID NO: 222960 - DNA, 370 bp, Homo sapiens
  misc_feature: GYAE6OF01BFSEN.37.25.C03.1.454.CMB.1.raw
  modified_base (368)..(370): a, c, t, g, unknown or other
  misc_feature (368)..(370): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnn

SEQ ID NO: 222961 - DNA, 722 bp, Homo sapiens
  misc_feature: GYAE6OF01DQI8S.37.25.C03.1.454.CMB.1.raw
  modified_base (244)..(244): a, c, t, g, unknown or other
  misc_feature (244)..(244): n is a, c, g, or t
  modified_base (718)..(718): a, c, t, g, unknown or other
  misc_feature (718)..(718): n is a, c, g, or t
tcagtagtgtagatcacgaccggtgctcgatttagtagtgtagatttgggtttgggggaggcctggtgcagcctgggggggtccctgagactctcctgtgcagcctctggattaattgtttagcaactctggcatgaactgggtccgccaggctccaggcagtggggctgcagtgggtctcaagtactagtgctctaggtaatagagcagactacgcagactcgtgaagggccgttcaccatcnccagagacaattacaagaacacgctctatctagacaatgaacacgctagagacgacgaagacgacggacgtaatacttacgtgtagtaggaaaggcggtaggggaggtacgggggtactacgggtcggggaccgacgggtaacccgtggtaccgtaccgtcctccgtcgacgacctacccgaaccgaaccggccctaacgttcccgggttacccttcccccgtacggtacccctaccccgttaccctaacccgaacggtaccgtacccctaacccggtccgggtccgggggacccaacgggaccgggtccccggggtcccgtccggggtccgtccgggtacccggttacgggttaacccgtaaacgggttacccttaaccgtttacccgaacttaccgtaaacccgtaaccgttaccggtagggaaccgggtccggggtacgaacgggtaccgaaacgggccgagtacggtagngacg

SEQ ID NO: 222962 - DNA, 564 bp, Homo sapiens
  misc_feature: GYAE6OF01DGO5E.37.25.C03.1.454.CMB.1.raw
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactcgtgaagggccgttcacatctccagagacaattccaaagaacactctatatctgacaaatgaacagcctagagacgccgacgacacggccatatattatgtgacgaaacgacccaacggtgaccactattggatcgttttgactttcgtcggggaccaaagggactaacggtcaccgtctcttcacgtcctccacgacggccctagtccgtccttccccgtggccnccctcgcctccgaggcnccacctcgacgacgaccacgacgccggccgtggcctcgccgtcggaccgaacggtacttaccttacctatccgtaactacgtaccgtggacggcgggtaccg

SEQ ID NO: 222963 - DNA, 622 bp, Homo sapiens
  misc_feature: GYAE6OF01ANEOE.37.25.C03.1.454.CMB.1.raw
  modified_base (287)..(287): a, c, t, g, unknown or other
  misc_feature (287)..(287): n is a, c, g, or t
  modified_base (515)..(515): a, c, t, g, unknown or other
  misc_feature (515)..(515): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccgtagaagggccgttcaccatctccagagacaattccaagaacacgctctatctgacaaatgaacncgcctaggacgacggaccgaaagaccgaccgggtaccgtaattaacttacgtcggtaggtaaggaaacgggtcgtagggggaggtacggggggacttacgggcgggggaccgaacggggtacccgtcggtaccgtacccgttctccctcgacgccctaccgaaccgaaccggccctacgttccggtcccttccccgtcggaccctaccctcctaccgaacgtacaccnccgtccggtcgggaccacgacggccggccgtcgggctcgccgtgtacgaacgtcttacctcactcaactactacgtgacggcggcgtacggcgtaacggcangtcgn

SEQ ID NO: 222964 - DNA, 610 bp, Homo sapiens
  misc_feature: GYAE6OF01EAVAT.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattaatgtttagcaactctggcatgaactgggtccgccaggctccaggcagtggggctgcaggtgggtctcaagtactagtgctcctggtaatagagcagactacgcagactccgtgaagggccggttcaccatctccagagacaattccaagaacacgctctatctgacaaatgaacagcctgagacgaccgaagaccacggccgtatattactgtgtagaaggcgtggggagtgggggactacggtcggggccgaacgggaacccgtggtccaccgtcctccgtcacgtccctaccacccgaacgggcccctacgtaccggttcccttcccccgtcggaccctaccccgtccctacccgaacggaccgccctacccgtccggtcgggggaccaccggacggaccccgggcccgtcggggccgttcccggg

SEQ ID NO: 222965 - DNA, 571 bp, Homo sapiens
  misc_feature: GYAE6OF01COOGC.37.25.C03.1.454.CMB.1.raw
  modified_base (231)..(231): a, c, t, g, unknown or other
  misc_feature (231)..(231): n is a, c, g, or t
  modified_base (570)..(571): a, c, t, g, unknown or other
  misc_feature (570)..(571): n is a, c, g, or t
tcagtagtgtagatcacgaccggtgctcgatttagtagtgtagatttgggtttggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactcgtgaaggcgttnaccatctccagagacaattccaagaacacgctctatctgcaaatgaacagcctgagagccgaagacacggccgtatattaactgtgtgaaaggcgtgggagtgggggactaacgtggggaccaggggaaaccctgggtcaaccggtctccgtcagcctccaccgaacgggcccaagtccggtacttcccccgtggccacccctcctaccaacgacgccacctctcgggggcacacgccggcccgtggggcctcggcctcgggtacaaacgggtactaaccttccaactcaacctactacgtggacggccgggacgtggcgaaacgggcgtacacgtagnn

SEQ ID NO: 222966 - DNA, 580 bp, Homo sapiens
  misc_feature: GYAE6OF01D7HZF.37.25.C03.1.454.CMB.1.raw
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccgaacgggcccatccggtccttccccctggccaccctcctccaagacgcctaccctcgtgggggccacgacggccggcccgtgggcctcggcccgtgggtaccaaacgggtaccttaccttcccaacttcctaaccaaccgttactcggaggccggggcttcgggacaaacgggccgacaagtaacgngngn

SEQ ID NO: 222967 - DNA, 453 bp, Homo sapiens
  misc_feature: GYAE6OF01EGDCF.37.25.C03.1.454.CMB.1.raw
  modified_base (444)..(453): a, c, t, g, unknown or other
  misc_feature (444)..(453): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatcggtcttccccctggcaccctcctccaagacgcacctctgggggcacagcggccctgggctgcctggtcaaggctactccatctacactactgagcgggctggcaaggcgcatagnnnnnnnnnn

SEQ ID NO: 222968 - DNA, 235 bp, Homo sapiens
  misc_feature: GYAE6OF01DSDIG.37.25.C03.1.454.CMB.1.raw
  modified_base (233)..(235): a, c, t, g, unknown or other
  misc_feature (233)..(235): n is a, c, g, or t
tcagtagtgtagatcacgaccggtgctcgatttagtagtgtagatttgggtttggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnn

SEQ ID NO: 222969 - DNA, 452 bp, Homo sapiens
  misc_feature: GYAE6OF01AZM0S.37.25.C03.1.454.CMB.1.raw
  modified_base (365)..(365): a, c, t, g, unknown or other
  misc_feature (365)..(365): n is a, c, g, or t
  modified_base (440)..(452): a, c, t, g, unknown or other
  misc_feature (440)..(452): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctcngggggcacagcggccctgggctgcctgtcaagctactccatctacactactgagcgggctggcaaggcgcatagnnnnnnnnnnnnn

SEQ ID NO: 222970 - DNA, 651 bp, Homo sapiens
  misc_feature: GYAE6OF01EG1Y0.37.25.C03.1.454.CMB.1.raw
  modified_base (647)..(647): a, c, t, g, unknown or other
  misc_feature (647)..(647): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcagtgggggctgcaggtgggtctcaagtactagtgctccgtaggtaatagagcagactacgcagactccggtaggaacgggtccggttacacctatcctccgagacgaactaactttaccaaagaacacgctactatctgacaaatgaacacgcctgagacgaccggaacgacgacggtccgtaatactttacgtgtgtagaaagggcgtaggggaggtagggggactacggtcggggaccgacgggaacccgtggtaccgaccgtcctcctacgacgtccctaccaaccgaacggccctacgttccggttcccttcccccgtcggaccctacccctcctacccaagcgaccaccgtcggtcggggccacgacgggccggtcccgtacgggcctcggccgtcggtacgacggtaccgttaccttccacgttcctacctaccgtacgtcggacggccgggacgtcgggacgaacgggccgacgtagtagntacg

SEQ ID NO: 222971 - DNA, 648 bp, Homo sapiens
  misc_feature: GYAE6OF01DVFWO.37.25.C03.1.454.CMB.1.raw
  modified_base (203)..(203): a, c, t, g, unknown or other
  misc_feature (203)..(203): n is a, c, g, or t
  modified_base (613)..(613): a, c, t, g, unknown or other
  misc_feature (613)..(613): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcaggtgggtctcaagtactagtgctcgtaggtaanagagcagactacgcagacctcggtaggaacgggtccgttcaccatcctccagagaacaattaccaagaacacgctctatctgacaaatgaacacgcctagacgacgaccgaagacaccggacgttatattaactggtagtaggaaagggcggtagggggtaggtacggggggaacgttacgggtacggggggaccgtaacgggggtaaccccgttcgggtaccctacccggttcctcccgtacgaccgcccttacccgaaccggaacgggcccacggttcccggtcccttcccccgtggcccctacccttccaccgaacgaccgctacccgtcggccgggactacggcgcccggccgtcgggcctcgccgtcggtacgaaccggtcttactctactcctaacacgtacgnggacggcggcgtacggacgacggctagacgtgctg

SEQ ID NO: 222972 - DNA, 661 bp, Homo sapiens
  misc_feature: GYAE6OF01CAQ6E.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccgttcaccgtctccagagacaattccaagaatcggtctatctaggaaatgaacagcctgagagccgaggacacggcctctattactgtgcgagagatcagacgagtatagcagcagctctgactacgtgggaccacggtaaccctggtccaccgtctcctacacgtccctacccgaaccgtaaccggggcccctacgtccccgggttaccctttcccccggtcggtcccacccccttcccgtacccgaaacggaccgtcccgtaaccccgttcggtacgggggcccaaccgacggcccgggtccccgtcggggtacctcgggtcccgttgggtaacccgaacgggtacccttaccttaccctacgttacctaaccctaccgttacgacgggtaccggcgggtcgtacgggaccgtaacgggccgacgtaacg

SEQ ID NO: 222973 - DNA, 593 bp, Homo sapiens
  misc_feature: GYAE6OF01A1PUJ.37.25.C03.1.454.CMB.1.raw
  modified_base (592)..(592): a, c, t, g, unknown or other
  misc_feature (592)..(592): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcaggtggtctcaagtactagtgctcctggtaatagagcagactacgcagactccgtgaagggccgttcaccatctccagagacaattccaagaacacgctctatctgacaaatgaacagcctgagacgccgaagacacggccgtatattactgtgtgaaaggcgtgggagtgggggactacgtggggccgacggggaaccctgggtccaccgtccgtcctcgacgccctaccgacccgaacgggccccacgttccggttccctttccccccgtcggccctacccctcccgtacccgaacgaccgcccaccgtcggtcggggacacgacggcccggcccgtgggcctcggccgtggtaccgaaggtacctacgtcctactcctaactacgtacgtgacggcgggcgtggacaacgggcacagtgnc

SEQ ID NO: 222974 - DNA, 679 bp, Homo sapiens
  misc_feature: GYAE6OF01C4XUB.37.25.C03.1.454.CMB.1.raw
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
  modified_base (286)..(286): a, c, t, g, unknown or other
  misc_feature (286)..(286): n is a, c, g, or t
  modified_base (675)..(675): a, c, t, g, unknown or other
  misc_feature (675)..(675): n is a, c, g, or t
  modified_base (677)..(678): a, c, t, g, unknown or other
  misc_feature (677)..(678): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtgggggctgcaggtgggtctcaagtactagtgctctggtaatagagcagactacgnagactcgtgaagggccgtcacatcncagagacaataccaagaacacgctactatctgacaaatacgaacncgcctaggagaacgaccgaagacgaccggtacgtatattacgtgtagtaggaaggcggtaggggaggtaggggactacgggcggggaccgacggggaacccgtgggtacctacccggttcctccgtacgtaccgccctaccgaaccgaaccggggtcccctacggttccccggttaccccttccccgtacggacccctaccccttcccgtacctaacggaccgtacccgtaacccgtcggtacgggggcctaaccggcgggaccccgggtccggtacggcccgtcggtacccgttacggtaaccgtaacggtaccttaccgtaccgtactacctaaccgtaccgttacgaggtacgggccgggtcgtaggaccgaaggccgaagtacgngnng

SEQ ID NO: 222975 - DNA, 648 bp, Homo sapiens
  misc_feature: GYAE6OF01DRX0W.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtggtctcaagtactagtgctctaggtaatagagcagactacgcagactccgtgaacgggccgttacaccatctccagagacaacttccaagaacacactctatctgacaatgaacagcctagaagaacgtggacgacgacggctgtagtactcacttgcggacgtaaacggtagggggttgagagtcgcgtagcgtagggtaggtgtacgtttgggttttagtagtttacgggtcggggtaaccgtaagggtaacgtaagttcggtacgtacccgttcttaccttacgtacgtccgtaccctaaccggaacggtaccctacgttcccggttcccttccccgtccggtccctacccctacccgtaccgaacgtcgacccgtaccgtccgggtcgggacctacggcggcccggtcggtcggtctccggtccgtcggaccgtaacggtaccttaccttaccatcctaacgtactaccggg

SEQ ID NO: 222976 - DNA, 537 bp, Homo sapiens
  misc_feature: GYAE6OF01AYLGF.37.25.C03.1.454.CMB.1.raw
  modified_base (512)..(512): a, c, t, g, unknown or other
  misc_feature (512)..(512): n is a, c, g, or t
  modified_base (537)..(537): a, c, t, g, unknown or other
  misc_feature (537)..(537): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggagtgggggactacgtgggggccaggggaaccctggtcaccgtctcctcacgcctccaccaagggcccagtccggtccttccccctggccaccctcctccaacgacgccaccgtctggggccacgacggcggccccgtggggcctcgccgtggtcaaggactacttccatcacactacngacggcgggctggcacggcgcatgn

SEQ ID NO: 222977 - DNA, 176 bp, Homo sapiens
  misc_feature: GYAE6OF01ENDOG.37.25.C03.1.454.CMB.1.raw
  modified_base (175)..(176): a, c, t, g, unknown or other
  misc_feature (175)..(176): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcgggctggcaaggcgcatagnn

SEQ ID NO: 222978 - DNA, 175 bp, Homo sapiens
  misc_feature: GYAE6OF01EV0OT.37.25.C03.1.454.CMB.1.raw
  modified_base (174)..(175): a, c, t, g, unknown or other
  misc_feature (174)..(175): n is a, c, g, or t
tcagtagtgtagatcacgaccggtgctcgatttagtagtgtagatttgggtttgggggaagaggaagactgacggtccccccaggagttcaggtgctgggcacagcggccctgggctgcctggtcaaggactacttccatctacactactgagcgggctggcaaggcgcatagnn

SEQ ID NO: 222979 - DNA, 518 bp, Homo sapiens
  misc_feature: GYAE6OF01B65UZ.37.25.C03.1.454.CMB.1.raw
  modified_base (517)..(518): a, c, t, g, unknown or other
  misc_feature (517)..(518): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaaagaacacgctctatctgcaaatgaacagcctgagagccgaagacacggccgtatattactgtgtgaaaaggctggggatgggggactacgtggggccagggaaccctggtcacgtctcctcagcctcaccaagggcccatcggtcttcccctggcaccctcctccaagacgcacctctggggcacagcgccctgggctgccgtgtcaaggactacttccaatctaacactactgaggcggctggcaaggcgacatagnn

SEQ ID NO: 222980 - DNA, 579 bp, Homo sapiens
  misc_feature: GYAE6OF01BZO0G.37.25.C03.1.454.CMB.1.raw
  modified_base (576)..(576): a, c, t, g, unknown or other
  misc_feature (576)..(576): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctcagagacaattccaagaacacgctctatctgcaaatgaacagcctgagagccgaagacacggccgtatattactgtgtgaaaggcgtggggagtgggggactacgtggggccgagggaaccctggtccaccgtctcctcacgcctccaccaacgggcccatccggtccttcccccgtggccaccctcctacccaacgacgccaacctccgtcgggggccacgacggccggccccgtggggcctcggtcccttgggtaccaacggtacctaccttcccacttcctaacacctacgtaggacggccgggcgtcgggacgaacgggcgacgagtagntac

SEQ ID NO: 222981 - DNA, 836 bp, Homo sapiens
  misc_feature: GYAE6OF01A1ERW.37.25.C03.1.454.CMB.1.raw
  modified_base (829)..(829): a, c, t, g, unknown or other
  misc_feature (829)..(829): n is a, c, g, or t
  modified_base (832)..(832): a, c, t, g, unknown or other
  misc_feature (832)..(832): n is a, c, g, or t
  modified_base (834)..(835): a, c, t, g, unknown or other
  misc_feature (834)..(835): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaacgtgggtccgcgaggctccgaggcaggtggggctgcgtaggtgggtctacgaaagtacgtaggtgccttccgtaggtaaataggagcaaggacctaccgcagtacctccggtaggaacgggtccgtacaccatccacagacactactacgaaacgaaccgacgtctactactcgtacgaactaagtacgaacaccggtccgtaggaggaccgaaccggaaacgaccggaccgggtaaccttaattacgtttacgtggttaggaacggaaacggggtcgggtaggggtacgggggtacgggggtaaccgttacgggggaccggggaacccgggtaaccgggtaacccggttccgggtacccgtaccccgtttcccgtacccgtaccgacccgtacccctaccccgaaacccgggaaccgggtcccctacggttcccccggtttacccccgtttccccccgggtacggtaccccctaacccccgttcccgtaaaccgaacgtacccggtacccgtaccccggttcgggggaccgggggacccaacgggtcccgggccccgggttcccgggtacgggtcccgttaccgggtccgggttacggtaacccggaacggttacccttacccttccacgttaccctaaccgccgttacggtacggccggggccggtaccgtacggaacgggacggaccganagngnng

SEQ ID NO: 222982 - DNA, 670 bp, Homo sapiens
  misc_feature: GYAE6OF01AZXVV.37.25.C03.1.454.CMB.1.raw
  modified_base (665)..(665): a, c, t, g, unknown or other
  misc_feature (665)..(665): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcagtggggctgcagtgggtctcaagtactagtgctcctggtaatagagcagactacgcagactccgtgaagggccgttcaccatctccagagacaattccaagaacacgctctatctgacaaatgaacagcctgagagaccgaagacacggccgtatattactgtgtagaaaggcgtaggggagtcggggggtactacggtcggggaccgacgggaaccctggtccaccggtcctacctcgacgccctacccgaaccgaacgggccctacgttcccggttcccttccccccgtcggacccctaccccttccctacccgaacgacgcctaacccgtcggtacgggggccaccggacggcccgggtacccgtcgggtcccgtcggcccgttcgggtaccgtaaacgggtaccctttaccgtaccctacttaccgtaaccgtaaccgttacgtcgggacgggacccggggtcgtaccgggtaaccgaacgggtcccgtacgaacgttaggntcgcg

SEQ ID NO: 222983 - DNA, 382 bp, Homo sapiens
  misc_feature: GYAE6OF01CQJ58.37.25.C03.1.454.CMB.1.raw
  modified_base (379)..(382): a, c, t, g, unknown or other
  misc_feature (379)..(382): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaaatgaacagcctgagagccgaagacacggccgtatattactgtgtgaaaggctggggagtggggggactacgtggggccaagggaaccctggtcaccgtctcctcagcctccaaccaagggcccatccggtccttcccccgtggccaccctcctccaagagcacctcgtgggggcacagccggccctgggctgcctggtcaaggactactccatctacactactgagcgggctggcaaggcgcatagnnnn

SEQ ID NO: 222984 - DNA, 734 bp, Homo sapiens
  misc_feature: GYAE6OF01C3PPN.37.25.C03.1.454.CMB.1.raw
  modified_base (131)..(131): a, c, t, g, unknown or other
  misc_feature (131)..(131): n is a, c, g, or t
  modified_base (148)..(148): a, c, t, g, unknown or other
  misc_feature (148)..(148): n is a, c, g, or t
  modified_base (221)..(221): a, c, t, g, unknown or other
  misc_feature (221)..(221): n is a, c, g, or t
  modified_base (316)..(316): a, c, t, g, unknown or other
  misc_feature (316)..(316): n is a, c, g, or t
  modified_base (729)..(729): a, c, t, g, unknown or other
  misc_feature (729)..(729): n is a, c, g, or t
tcagtagtgtagatcacgaccggtgctcgatttagtagtgtagatttgggtttgggggaggcctggtgcagccgtggggggtccctgagactctcctgtgcagcctctggattaatgtttagcaacctcgnggcatgacgtcgggccncgaggcctacggaggggagggtcgtgggtaggtggtctacgtagtttagttaggtggtaggtggtagtagcanagtatacgcacgaccgtcggaggacggtccgtacactatccacgagaacactaactaccaagcgacacgtcttagttatcgacaatagacgaacncgcgaggagacgaccggagaccgaccgactaagttattactttgtcgacgtaaccgttaacttttcgttagtacgtttagttacttacccgttaccgtagtacccgaccggtacgggtaccggggaaccggtaaccggttaccgttcggtacccttaacccggtcctacccgtacgtaacccggtaccccgtacccggaaaccgggtacccgggtacccttaccgggttccccgtttacccccgttaccccgccggtaccccctaccccgtacccgaacccgaaccgtcccgacccgttaccggtcgggacccgggtacaccggccgggtccggtcccgtcggcctaccggtccgaggtaccgtacgtaccttcgtacacgtactacgtacgtgccggtagcgacgcgagcgngtagc

SEQ ID NO: 222985 - DNA, 616 bp, Homo sapiens
  misc_feature: GYAE6OF01AHWVY.37.25.C03.1.454.CMB.1.raw
  modified_base (312)..(312): a, c, t, g, unknown or other
  misc_feature (312)..(312): n is a, c, g, or t
tcagtagtgtagatcacgaccggtgctcgatttagtagtgtagatttgggtttgggggaggcctggtgcagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattcccaagaatacggtctatctggaaatgaacagcctgagagccgaggacacggccctntattactgtgcgagagatcagacggagtatagcagcagctctgactacgtggggcccacggaaccctggtccaccgtctcccgtcacgccctaccaccgaacggggccccacgtcccggtccctttccccccgtcggccctacccctccctacccaacgacgccacctcggtcggggccacgacgccggcccgtgggcctcgtcccgtcggtacaacgggaccttaccgttaccacgttccctaactaccgtaaccgttcggaacgggcggggtccgttacgggaccgaaacgggcgcgtaacg

SEQ ID NO: 222986 - DNA, 466 bp, Homo sapiens
  misc_feature: GYAE6OF01EKXFZ.37.25.C03.1.454.CMB.1.raw
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
  modified_base (446)..(466): a, c, t, g, unknown or other
  misc_feature (446)..(466): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccacggcccatcggtccttccccctggccaccctccctccaagcncacctcgtggggcacngcggccctgggctgctgtcaaggactacttccatctacactactgagcgggctggcaaggcncatagnnnnnnnnnnnnnnnnnnnnn

SEQ ID NO: 222987 - DNA, 585 bp, Homo sapiens
  misc_feature: GYAE6OF01EZUSX.37.25.C03.1.454.CMB.1.raw
  modified_base (582)..(582): a, c, t, g, unknown or other
  misc_feature (582)..(582): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggcgtggggagtgggggactacgtggggccagggaaccctggtcaccgtctcctcagcctccaccgaacgggcccagtccgtccttccccctggcccaccctcctacccaacgacgccaccgtcgtcgggggccaccgacgccgggcccgtcggggccttcggcccgttcgggtccgaaagggtaccttaaccgttccacttcctaactaccgtacgtggacggcggggcctgggaccgtaacgggccgacagtagngcg

SEQ ID NO: 222988 - DNA, 645 bp, Homo sapiens
  misc_feature: GYAE6OF01EYAPR.37.25.C03.1.454.CMB.1.raw
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtcgtgggggaggcctggtgcagcctggggggtccctgagactctcctgtgcagcctctggattaatgtttagcaactctggcatgaactgggtccgccaggctccgaggcagtggggctgcagtgggtctcaagtactagtgctcctggtaatagagcagactacgcagactccgtgaaggccgttnaccatcncagagacaattccaaagaacacgctactatctagacaaatgaacagcctgacgacgaccgaaanacgacggcctaatattactgttagaggaaggcgtgggagtgggggactacggtcggggaccaacgggtacctagtccaccgtcctccgtcacgtacccgtaccgaccgaacgggcccctaagttcccggtacccgttcccccgtcgggtacccctaccccttaccccgttacccgaaacgtaccgtaacccgtacccggttccgggtacgggggaccccgaaccggtaccgggtaccccgggtccccgttcgggggtcccgtcccggg

SEQ ID NO: 222989 - DNA, 270 bp, Homo sapiens
  misc_feature: GYAE6OF01C21RU.37.25.C03.1.454.CMB.1.raw
  modified_base (232)..(270): a, c, t, g, unknown or other
  misc_feature (232)..(270): n is a, c, g, or t
tcagtagtgtagatcacgaccggtgctcgatttagtagtgtagatttggggtttggggggactactggggccagggaaccctggtcaccggtctcctcagcctccaccaagggcccatcggtcttcccctggcaccctcctccaagagcacctctggggcacagcggccctgggctgcctggtcaaggactacttccatctacactactgagcggctggcaaggcgcatagnnnnnnnnnnnnnnnnnnnnnnnnnnnnnnnnnnnnnnn

SEQ ID NO: 222990 - DNA, 386 bp, Homo sapiens
  misc_feature: GYAE6OF01A4F3L.37.25.C03.1.454.CMB.1.raw
  modified_base (377)..(386): a, c, t, g, unknown or other
  misc_feature (377)..(386): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctgggggagtggggggactacgtggggccagggaaccctggtcaccgtctcctcagcctccaccgaagggcccatccggtccttccccgtggccaccctcctccaagagcacctcgtggggcacagcggccctgggctgccgtggtcaaggctacttccatctacactactgagcgggctggcaaggcgcagtagnnnnnnnnnn

SEQ ID NO: 222991 - DNA, 192 bp, Homo sapiens
  misc_feature: GYAE6OF01EVL6C.37.25.C03.1.454.CMB.1.raw
  modified_base (177)..(192): a, c, t, g, unknown or other
  misc_feature (177)..(192): n is a, c, g, or t
tcagtagtgtagatcacgaccggtgctcgatttagtagtgtagatttgggtttgggggggaagaggaagactgacggtccccccaggagttcaggtgctgggcacagcggccctgggctgcctggtcaaggctacttccatctacactactggagcgggctgggcaaggcgcatagnnnnnnnnnnnnnnnn

SEQ ID NO: 222992 - DNA, 518 bp, Homo sapiens
  misc_feature: GYAE6OF01A2JTG.37.25.C03.1.454.CMB.1.raw
  modified_base (513)..(513): a, c, t, g, unknown or other
  misc_feature (513)..(513): n is a, c, g, or t
  modified_base (517)..(518): a, c, t, g, unknown or other
  misc_feature (517)..(518): n is a, c, g, or t
tcagtagtgtagatcacgaccggtgctcgatttagtagtgtagatttgggtttgggggaggcctggtgcagcctggggggtccctgagactctcttgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatcggtcttccccctggccaccctcctccaagagcacctctgggggcacagcggccctgggctgcctggtcaaggactacttccatctacactactgagcgggctggcaaggcgnatgnn

SEQ ID NO: 222993 - DNA, 907 bp, Homo sapiens
  misc_feature: GYAE6OF01BX61K.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagccgtggggggtccctgagactctcctgtgcagcctctggattaatgtttagcaactctggcatgaacgtgggtccgccaggcctccgaggcagtggggctgcgtaggtcgggtctacaagttactaggtcgccttccgttagggtaataggacgcaacgtacctacggcaacggtaccgtccggtaggaacggggtcccggtttaccaaccctacgttccctacccgaaggaacgaacctaaacttacccaaaacggaaaccctaccgtaccttacttaacgttccgtacgaaacctaaaagtaccggaaaccgtacggtaccccgtaagggaacggaaccgggaaacccggaaaacggaacccggtaacccggggttacccgtttaaagtttaaccgtttaaccggttagggttaacggttaaggggtaaaacggggtccggggttaaggggggtacggggttaacgggggggtaaccgttaaccggggtccgggggaacccggtaaaccggggtaaccccgttcgggtacccgtaacccggttccgtacccgtaccgtaccgtaccccgtacccgaaccgggtaacccgggaccccgttacggttccccgggttccccgttacccccccgtaccgggtaccccctacccccgttaccccgtaacccggaacggtacccggtacccgtaaccccggtccgggtacccgggggaccctaacccgggaccgggacccccggtccccgggtcgggtcccggtacccggg

SEQ ID NO: 222994 - DNA, 389 bp, Homo sapiens
  misc_feature: GYAE6OF01DDLDV.37.25.C03.1.454.CMB.1.raw
  modified_base (379)..(389): a, c, t, g, unknown or other
  misc_feature (379)..(389): n is a, c, g, or t
tcagtagtgtagatcacgaccggtgctcgatttagtagtgtagatttgggtttgggattcacgttgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccctggctgctggtcaagacgtacttccatctacactactgtagcggctggcaaggcgcatagnnnnnnnnnnn

SEQ ID NO: 222995 - DNA, 733 bp, Homo sapiens
  misc_feature: GYAE6OF01EDIYI.37.25.C03.1.454.CMB.1.raw
  modified_base (145)..(145): a, c, t, g, unknown or other
  misc_feature (145)..(145): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccaggcagtggggctgcagtgggtctcaagtactagtgctctggtaatagagcagactacgcagactccgtaggaacggccgttcaccatcctacagaacactaatccaagaacacgctactatctgacaaatacgaacacgcctagagacgaccgaagacgaccggtacgtattacgttactggtagtaaggaaaggtcggtaggggagggtacggggacttacgggtacggggaccgaacggggtacccgtcgggtacctaccggttcctacccgtcgaccgccctaccgaacccgaaccgggtccctaacgttccccggttaccccttacccccgtacggtacccctaccccgtacccgtaccgaacggtaccgacccgtacccggtacggttaccgggggactaaccggaccgggcccggttacccgggttacgggtacctaccgggtacggttaccggtaacgtaaaccgggtaacctttacccggtacctaaccttacggtaaaccctaccggtaaccgtagggacccggtcgggtacccgtaaggaccggtaacgacgtaaccagttccgatcg

SEQ ID NO: 222996 - DNA, 563 bp, Homo sapiens
  misc_feature: GYAE6OF01CUJDG.37.25.C03.1.454.CMB.1.raw
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(547): a, c, t, g, unknown or other
  misc_feature (543)..(547): n is a, c, g, or t
  modified_base (549)..(558): a, c, t, g, unknown or other
  misc_feature (549)..(558): n is a, c, g, or t
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaaagacacggccgtatattactgtgtgaaaggctggggagtgggggactacgtggggccagggaaccctggtcaccgtctcctcacgcctccaccgaacgggcccagtccggtccttcccccgtggccaccctcctccaagacgccaccgtcgtgggggcacgacggccggcccgtgggacctcggcccgtggtaccaaagggtaccttaccttacctaacttcctaacctaccgtaacgttcggaacggccggggtaccgttcgggacctaaacggggccgaccgtaagttacggntacgacgngnncagcgngngnnnnngnnnnnnnnnncnngn

SEQ ID NO: 222997 - DNA, 446 bp, Homo sapiens
  misc_feature: GYAE6OF01CV44C.37.25.C03.1.454.CMB.1.raw
  modified_base (417)..(418): a, c, t, g, unknown or other
  misc_feature (417)..(418): n is a, c, g, or t
  modified_base (420)..(446): a, c, t, g, unknown or other
  misc_feature (420)..(446): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtagaaaggcgtgggggagtggggggactacgtggggccagggaaccctggtcaccgtctcctcgacgccctccaaccgaacgggccctagtccggttcccttcccccgtggccacccctcctaccaacgacgccaccgtcggtcgggggccacgacggccggcccgtgggctcggccgtggtacaacggactaccttccatcctaactactactggacggcgggctggcgaaggcgacatagnncnnnnnnnnnnnnnnnnnnnnnnnnnnn

SEQ ID NO: 222998 - DNA, 760 bp, Homo sapiens
  misc_feature: GYAE6OF01DPQT1.37.25.C03.1.454.CMB.1.raw
  modified_base (374)..(374): a, c, t, g, unknown or other
  misc_feature (374)..(374): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtcgtgggggaggcctggtgcagccgtggggggtccctgagactctcctgtgcagcctctggattaatgtttagcaactctggcagtcgaacgtcgggtccgccgaggcctccgaggcagtggggctgcgagtggatctacgaagtactagtcgcctccgtaggtaatagagcaagacctacgcacgacctcggtaggaacgggtccgttacacctatcctaccgaagaacgaactaaacgttaccaaagaaaccncgcttactaactcgtagaacctaaaagtacgaaacgacgaccgtagacggacgaccggaaagaccgaaccggtccttaagttacttacgtggttagtaaggaaacgggtcggtaggggtacgggtacgggggtacgtacggggtacggggaccggaaccgggtacccggtcggtacccgtaccggtcccttaccgtccgaaccgtccccgtacccgaaccggaacccgggtacccctacggttccccggttaccccgttcccccggtccggacccccttaccccgtccccgtaaccggaaccggtacccgtaccccgtacccggtccgggtcccggggtaacctacccgggaccgggtccccgggtcccggttcggggtaccccgg

SEQ ID NO: 222999 - DNA, 673 bp, Homo sapiens
  misc_feature: GYAE6OF01CM430.37.25.C03.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (665)..(665): a, c, t, g, unknown or other
  misc_feature (665)..(665): n is a, c, g, or t
  modified_base (670)..(670): a, c, t, g, unknown or other
  misc_feature (670)..(670): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtggtctcgaagtactagtgctcctaggtaatagngcagactacgcagactcgtagaaggccgttcaccatcncaganacaattccaagaacacgctctatctagacaaatagaacagcctaggaacgacgacccggaaagtaccgaacggtccgtaattacttacgtgtagtagaaaaggcgtaggggagtaggggactacggtcgggaccgaaggtacccgtggtccgacccgtctaccgtcgacgtccctaccgaaccgaaccggacccgtacgttaccggtcccgttacccccgtcggaccctaaccccgttacccgtacccgaacgaccgacccgtaacccgtccggtaccgggggaccaacggaccgggccggtaccccgtcgggtaccttaccgggcccgttcggttaacgaaaccggtaccttaaccgttaccgtacttacctaaccgtaactaccgtggacggcgggcgtacggacgacggtacganactgnacg

SEQ ID NO: 223000 - DNA, 633 bp, Homo sapiens
  misc_feature: GYAE6OF01BMT0C.37.25.C03.1.454.CMB.1.raw
  modified_base (145)..(145): a, c, t, g, unknown or other
  misc_feature (145)..(145): n is a, c, g, or t
  modified_base (633)..(633): a, c, t, g, unknown or other
  misc_feature (633)..(633): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccaggcatggggctgcagtgggtctcaagtactagtgctcctggtaatagagcagactacgcagactccgtgaagggccgttcaccatctccagagacaattccaagaacacgctctatctgacaaatgaacagcctgagacgccgaagacacggaccgtatattactgtgtagaaggcgtggggagtgggggactacggtggggaccgaacgggaaccctggtcaccgtctcctcacgccctaccaccgaacggccctatccggtacccttccccgtggccaccctccctaccgaacgacgaccaccgttcgtcgggggacctacgacgggcccggtccccgtacggggtccctccggtacccgttacgggtacgaaccgggtacccttaaccttccctaacttacccgtaaccgtaaccgttaccggtaggaaccgggtcggggaccgtagggaccgaaacgggtccgaacacgtagcn

SEQ ID NO: 223001 - DNA, 690 bp, Homo sapiens
  misc_feature: GYAE6OF01BNTSG.37.25.C03.1.454.CMB.1.raw
  modified_base (186)..(186): a, c, t, g, unknown or other
  misc_feature (186)..(186): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
tcagtagtgtagatcacgaccggtgctcgatttagtagtgtagatttgggtttggggggaggcttggtacagcctggggggtccctgagactctcctgtgcagcctctggtttcatctttagcaactacgccatgagctggggtccgccaggctccgagggaaggggctggagtgggtctcaggtnttacgtggtagtggtaataccgcatactacgcagactccgtgacgggtccggttcaccgtctccagagacaattccaagaatcggtctatctaggaatgaacngctgagancgagcacgcctntatactgngcgagagatcgagacggatatagcagcagtctcgtgactacggtcgggaccaaccggtacctcggtaccacgttcctccacgacgaccctaccgaccgaacggcctacgtaccggttccccttaccccgtcggtaccctacccctacccgtaccgtaacgaccgtacccgaccggtaccggtcggggaccacggaccggtcccggtacccggtcggggtaccgttccggtcccggtacgggtacgtaaccggtaaccgttaccctttacccggtaaccttacccgttaaacctacccgttaccggttacgggacccggggtaccggggttaccggtacgggaccggtaaacgggcccggacgtaacggtacgg

SEQ ID NO: 223002 - DNA, 240 bp, Homo sapiens
  misc_feature: GYAE6OF01DQGOJ.37.25.C03.1.454.CMB.1.raw
  modified_base (232)..(240): a, c, t, g, unknown or other
  misc_feature (232)..(240): n is a, c, g, or t
tcagtagtgtagatcacgaccggtgctcgatttagtagtgtagatttgggtttggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaggcgcatagnnnnnnnnn

SEQ ID NO: 223003 - DNA, 173 bp, Homo sapiens
  misc_feature: GYAE6OF01B6FPH.37.25.C03.1.454.CMB.1.raw
tcagtagtgtagatcacgaccggtgctcgatttagtagtgtagatttgggtttggggggaagaggaagactgacggtcccccaggagttcaggtgctgggcacagcggccctgggctgcctggtcaaggactacttccatctacactactgagcgggctggcaaggcgcatag

SEQ ID NO: 223004 - DNA, 707 bp, Homo sapiens
  misc_feature: GYAE6OF01CMB2L.37.25.C03.1.454.CMB.1.raw
  modified_base (705)..(705): a, c, t, g, unknown or other
  misc_feature (705)..(705): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcaggtgggtctacaagtactagtgcctcgtaggtaatagagcaagactacgcacgacctccggtaggaacgggtccgttacaacctatcctccgaagacgaactaacttaccaaagaaccacgcttactatactagaacaaagtacgaacacgctagaagacgaccgaacgaccgaccggtacttataacgttacgtggtagtaggaaaggtcggtaggggaggtcggggtaactacgggtcgggaccgaacgggtaaccgtggacctaccgtctccgacgacctccctaccgaccggtaaccggacccgtacgttcccggttccccgttccccgaccggtacccaccccttacccgtaccgaacgacggtaccctaccggtcgggtaccggggacaccggaccgggtccggtcccggtacggaccggtcggtaccggtcggtaccgtaacggtaccttaaccttaccgtacgttacctaccgtaacctacgggtggaaccgggtccgggacgtacgacggacggtacgagaactgngc

SEQ ID NO: 223005 - DNA, 625 bp, Homo sapiens
  misc_feature: GYAE6OF01C0BP3.37.25.C03.1.454.CMB.1.raw
  modified_base (117)..(117): a, c, t, g, unknown or other
  misc_feature (117)..(117): n is a, c, g, or t
  modified_base (171)..(171): a, c, t, g, unknown or other
  misc_feature (171)..(171): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
tcagtagtgtagatcacgaccggtgctcgatttagtagtgtagattttgggtttgggctgagcggtgtgtttctaggcggctaattttaaaggttcagtgtgagtgcagttgttggngtcgtggggagcctggtgcagccgtgggggtcctgagctcgtctgtgcagcctntggattaatgttagcaactgtgcatcgacgtggccgcaggtctcgagcngtggctgagtgtggtctgaaagtcngttgcttctggaatacgagcctaggacctacganaacgtacgtccgtagaacggggtccttccaacntcgtaccaancgtaactacgttaacaacgaacagtcccttntatcgtagaacaagacgaacgtcggtcaaggagtaccggacagaccgtagtactattcgtagttgtaggtaagacggtggtagggtaggtagggtacgtacggtcggacggacgtaccgtcgtaccgtacgtacgtaccgtacgtaccgtccgaccgtaccgtacggtacctacgttaccgtccctacccgtaccgcccaccgttccgacgacgtcgtaccggtcgtccgggacggaccctacgggtccgtcccggtacgtcggtcgtacgg

SEQ ID NO: 223006 - DNA, 616 bp, Homo sapiens
  misc_feature: GYAE6OF01EJSY6.37.25.C03.1.454.CMB.1.raw
  modified_base (574)..(574): a, c, t, g, unknown or other
  misc_feature (574)..(574): n is a, c, g, or t
  modified_base (603)..(603): a, c, t, g, unknown or other
  misc_feature (603)..(603): n is a, c, g, or t
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagcctggggggtccctgagactctcctgtgcagcctctggattcaacttttggtagctattggatggactgggtccgccagtctccgaggggagggctgggagtgggtgccaacatacgaggggaggtggtaggtaacgaaaaactgtgtggactctgtggcgggcattcacatctcagagacaacgaccaaaactcactgtactctagactaaagtcgggaccggcctaggaagacgtaccggaggaccgacggtctgtagtatttagtgtgacgagtagtattagactaagtaagttcgagtgacgtgtatagatgtacttagtagtactaccggtgggaccgtaacggacctagtcggtaccgtaccgttcttcctacgtaccgccctacccgaccgaaccgggtaccctacgttcccgttcccttcccccgnggtccccgtccctcgcctaccgaggaccnccgccgtacccgg

SEQ ID NO: 223007 - DNA, 235 bp, Homo sapiens
  misc_feature: GYAE6OF01DO047.37.25.C03.1.454.CMB.1.raw
  modified_base (231)..(235): a, c, t, g, unknown or other
  misc_feature (231)..(235): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnnnn

SEQ ID NO: 223008 - DNA, 178 bp, Homo sapiens
  misc_feature: GYAE6OF01CWMSG.37.25.C03.1.454.CMB.1.raw
  modified_base (175)..(178): a, c, t, g, unknown or other
  misc_feature (175)..(178): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcgggctggcaaggcgcatagnnnn

SEQ ID NO: 223009 - DNA, 587 bp, Homo sapiens
  misc_feature: GYAE6OF01AKRUE.37.25.C03.1.454.CMB.1.raw
  modified_base (345)..(345): a, c, t, g, unknown or other
  misc_feature (345)..(345): n is a, c, g, or t
  modified_base (443)..(443): a, c, t, g, unknown or other
  misc_feature (443)..(443): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccgtctccagagacaattccaagaatacggtctatctggaaatgaacagcctgagagccgaggacacggcctctattactgtgcgagagatcagacggagtatagcagnagctctgactacgtcggggaccacgggaaccctggtcctaccgtctcctcacgcctcccacgaacggcccacgtcccggtccttccccgtcggacccnccctccctaccgaacgcgaccaccgtcggcggggccacgacggcccggacccgtcgggctcgtcccgtggtaccgaacggtaccgttacttcccgacttacctaaccgtaccgttaccgtaggtacggtccgggtgtaccgggg

SEQ ID NO: 223010 - DNA, 708 bp, Homo sapiens
  misc_feature: GYAE6OF01DASX4.37.25.C03.1.454.CMB.1.raw
  modified_base (145)..(145): a, c, t, g, unknown or other
  misc_feature (145)..(145): n is a, c, g, or t
  modified_base (243)..(243): a, c, t, g, unknown or other
  misc_feature (243)..(243): n is a, c, g, or t
  modified_base (705)..(705): a, c, t, g, unknown or other
  misc_feature (705)..(705): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggcctccaggcagtggggctgcaggtggtctacaaagtactagtcgctcgtaggtaatagagcagactacgcagactcgtaggaagggtccgtanacctatccacagagaactaactaccaaagaacacgtctactactccgtagacaaagtacgaactacggacctaggacgacggaccgaaacgtaccgaccggaccgttaattaacgttactaggtagtacggaaaggtcggtaggggtaggtacgggggtaactacgggtcggggaccgaaccggggtaacccgtggtaccgtaaccggtcctcccgtacgtaaccgcccgtacccgtaaccgaaccgggtcccctacgttcccgggtcccttaccccggtcgccctaccccgtcctaccgaacgtacgtccgacccggtcggtacgggcccaaggtccggccgggtcccgtcgggtcctccggtaccggtcgtaaccgtaaccggtaccttacctaccgacttacccgtacaaccgttcggagtaccgggcggacggtacggacgacggtacagttagacgngcg

SEQ ID NO: 223011 - DNA, 175 bp, Homo sapiens
  misc_feature: GYAE6OF01B4CYI.37.25.C03.1.454.CMB.1.raw
  modified_base (174)..(175): a, c, t, g, unknown or other
  misc_feature (174)..(175): n is a, c, g, or t
tcagtagtgtagatcacgaccggtgctcgatttagtagtgtagatttgggttttgggggaagaggaagactgacggtcccccaggagttcaggtgctgggcacagcggccctgggctgcctggtcaaggactacttccatctacactactgagcgggctggcaaggcgcatagnn

SEQ ID NO: 223012 - DNA, 609 bp, Homo sapiens
  misc_feature: GYAE6OF01EODB3.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgttttagcaactctggcatgaactgggtccgccaggctccaggcatggggctgcagtgggtctcaagtactagtgctcctggtaatagagcagactacgcagactccggtggaacgggtccggttcaccatcctccagacgactaattccaagaacacgctctatctgacaaatgaacagcctgagacgccgaagacgacggccgtatattactgtgtagaaaggcgtggggagtagggggactacggtggggccgaacgggacccgtgggtccaccgtcctcctacgacgccctaccgaaccgaacgggcccacgtccggttccttcccccgtcggccctaccccgtccctaccaacgaccgccaccgtccggtcgggggcacgacggccggcccgtgggcctcgtccgtcggtacaacggaccttaccttacctactcctaacctaccgtacgtaggacggcgggcgtggaccgaacggccgacagtacgcg

SEQ ID NO: 223013 - DNA, 786 bp, Homo sapiens
  misc_feature: GYAE6OF01EQVE1.37.25.C03.1.454.CMB.1.raw
  modified_base (145)..(145): a, c, t, g, unknown or other
  misc_feature (145)..(145): n is a, c, g, or t
  modified_base (781)..(781): a, c, t, g, unknown or other
  misc_feature (781)..(781): n is a, c, g, or t
tcagtagtgtagatcacgaccggtgctcgatttagtagtgtagatttgggtttgggggaggcctggtgcagccgtggggggtccctgagactctcctgtgcagcctctggattaatgtttagcaactctgcatgaactgggtccncaggctccaggcagtggggctgcagtggtctacaagtactagtgcttcgtaggtaatagagcagactacgcagaccgtccggtaggaacgggtcccgttacaacctacttccgtaccgaaggaacgaactaaacttaccgaaagaaccacgtcctacgtattacgtagaacaaagtacgaacaggtcctaggaacggacgaaccggaaagaccgtaccggtaccgttaattaacgtttacgtggttagtaaggaaagggtcggtaggggacggttacgggggaactacgggtcggggaccgaacggggtacccgtgggtaccacgtccgtccgtacaccgtaccccgtaccgaacggtaaccggtccctaacggttccggttaccccgttaccccgtcggtaccctaccctaccgtaaccgaacgtaccgtaccctacccgtcgggtacgggacctaccgggaccggtcccggtcccggttacgggcccgttaccgggtaccgttacgggttaacccgaacggttacccttaaccgttaccgtaaccttacccgttaaaccgtacccgttaacggtacggaaccggggtcccggtacggtaccgggaaccgtacgggtaccgtaacgtaacgtcgngtacg

SEQ ID NO: 223014 - DNA, 637 bp, Homo sapiens
  misc_feature: GYAE6OF01DVAYZ.37.25.C03.1.454.CMB.1.raw
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
tcagtagtgtagatcacgaccggtgctcgatttagtagtgtagatttgggtttggggctgagctggctttttcttgtggctattttaaaagggtttccagtgtgaggtgcagttgttggagtcgtggggaggcctggtgcagcctggggggtccctgagactctcctgtgcagcctctggattaatgtttagcaactctggcatgaactgggtccgccaggctccaggcatggggctgcagtgggtctcaagtctagtgcttcctggtaatgagcagactagcagactcgagaagggccgttcacntcnccagagacaattccaaagacacgctntactcagactaaagtcgaaacagcctggagacggcgaaagaccacggtccgtaattattactgtgtagaaggtcggtaggggagtacgggggaactcgggtaggggccgtaagggaaccccgtggtaccgtaccggtctacccttcgaacgtcccgtaccgaaccgtaccggccctacgttcccggtccctttaccccgcggtacccaccccgtccgtaaccgtaaggaccgaccgttacccgtaccggtacggggaccctaacggaacggtcccgggacccgttcgggcccgttacccggg

SEQ ID NO: 223015 - DNA, 696 bp, Homo sapiens
  misc_feature: GYAE6OF01CP1BZ.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtggtctcaagtactagtgctcctggtaatagagcagactacgcagactccgtagaacgggtccgttcaccatctaccgagagacaattaccaagaacacgcttactatctgacaaatagaacacgcgtagagacgaccgaagacgacggtccgtatattactgtagtaggaaaggtcgtaggggtagtcggggactacggtcggggccgaacgggaacccgtggtacctaccgtccttacctcgacgccctaccgaaccgaaccgggtccctacgtcccgggttaccccttcccccgtcggtaccctaccccgttaccgtacccaacgtaaccgtcccgtacccgtaccggtacgggggaccaaccggtaccgggcccgggtcccgtacggggtccttccggtaccggttcgggtaaccgtaaccgggtaccttaacccgttacccgtacttacccgtacgtaaccgtacgtacggacgggtccgggaccggttacgggaaccgtacgggtacagtacgtagtgcg

SEQ ID NO: 223016 - DNA, 579 bp, Homo sapiens
  misc_feature: GYAE6OF01BW164.37.25.C03.1.454.CMB.1.raw
  modified_base (483)..(483): a, c, t, g, unknown or other
  misc_feature (483)..(483): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
tcagtagtgtagatcacgaccggtgctcgatttagtagtgtagatttgggtttgggggaggcctggtgcagcctggggggtccctgagactctcctgtgcagcctctggattaattgtttagcaactctggcatgaactgggtccgccaggctccaggcatggggctgcagtggtctcaagtactagtgctcctggtaatagagcagactacgcagactccgtgaagggccgttcacatctaccagagacaattccaagaaccacgctctatctgacaaatgaacagcctgagagacgaagacacggcgtatattactgtgtagaagcgtgggagtggggactacgtgggaccgagggaacccgtggtcaccgtctcctcgacgcctccgaccgaacgggcccacgttccggttccctccccgttggccctaccctcctaccgacgacgccacccgtacgtcgggcacgacgccggtacccgngggtccgtcgtccgttggtaccgaagtaccttacttccacttacctacctacgtaccgtagacggccggacgtcggacgacgcgactacgngtcng

SEQ ID NO: 223017 - DNA, 577 bp, Homo sapiens
  misc_feature: GYAE6OF01DK62C.37.25.C03.1.454.CMB.1.raw
  modified_base (574)..(575): a, c, t, g, unknown or other
  misc_feature (574)..(575): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaattccaaagaacacgctctaatctgacaaatgaacagcctgagacgccgaagacacggcgtatattactgtgtgaaaggcgtggggagtggggggactacgtggggccagggaaccctggtcaccgtctctcacgcctccaccgaacgggcccagtccggtccttcccccgtggcccaccctcctaccgaacgacgccaccgtcggtcggggccacgacgccggcccgtgggcctcggccgtggacaacggtacctaccttaccactcctaccaactacgtggaacggccgggctacgggacgaacgggtccgacaagtagnngc

SEQ ID NO: 223018 - DNA, 616 bp, Homo sapiens
  misc_feature: GYAE6OF01C4FX5.37.25.C03.1.454.CMB.1.raw
  modified_base (234)..(234): a, c, t, g, unknown or other
  misc_feature (234)..(234): n is a, c, g, or t
  modified_base (612)..(612): a, c, t, g, unknown or other
  misc_feature (612)..(612): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaaggccgttnaccatctccagagacaattccaagaacacgctctatctgacaaaatgaacagcctgagagccgaagacacggccgtatattactgtgtagaaaggcgtggggaagtgggggactacgtggggaccgagggaacctggcaccgtcgtctcgagcctaccaccgaacgggcccacgtccggtccttacccccgtggcccaccctcctaccaagacgcaacccgtcgtacggggccacgacgccggtccctggggcctcggccgtggttaccaaacgggtccttaaccgttacctaactccgttaaccaaccgtttaccgtagggaacgggtccgggaccgttacgggaccgtaaacggggaccctaccggaaactagggngacg

SEQ ID NO: 223019 - DNA, 630 bp, Homo sapiens
  misc_feature: GYAE6OF01D47YG.37.25.C03.1.454.CMB.1.raw
  modified_base (628)..(628): a, c, t, g, unknown or other
  misc_feature (628)..(628): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactcgtgaacggccgttcaccatctaccagacgacaattccaagaacacgctctatctgacaaatgaacagctgagagaccgaagacgacggcctatattactgtgtaggaaaggcgtggggagtgggggactacggtcggggaccgaacgggtaacccgtggtccgtaccgtcctcccgtcgacgtccctacccgaaccgaacgggcccacgttccggtcccttcccccgtcggccctaccccttaccctaccgaacgtacgcccgtacccgtcggtacgggggaccacggaccgcccgggtcccgtgggcctcggtccgtacgggtacaacgggtaccttacgttacccgactcctacctaacgttcgtaggaccggtcgggcgtcgggacgtacgggcacgtagtcgncg

SEQ ID NO: 223020 - DNA, 412 bp, Homo sapiens
  misc_feature: GYAE6OF01BQSTU.37.25.C03.1.454.CMB.1.raw
  modified_base (402)..(412): a, c, t, g, unknown or other
  misc_feature (402)..(412): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtagaaaggcgtggggagtggggggactacgtggggccacgggaaccctggtcaccgtctcctcagcctccaccgaacgggcccagtccggtccttcccccgtggccaccctcctccaagacgccaccgtcgtgggggccacgacggccggccctggggctcgcctgggtacaaggccttacttccagtctaacactacgtgacgcgggctggacaaggcgacagtagnnnnnnnnnnn

SEQ ID NO: 223021 - DNA, 603 bp, Homo sapiens
  misc_feature: GYAE6OF01CPX7E.37.25.C03.1.454.CMB.1.raw
  modified_base (592)..(592): a, c, t, g, unknown or other
  misc_feature (592)..(592): n is a, c, g, or t
  modified_base (602)..(603): a, c, t, g, unknown or other
  misc_feature (602)..(603): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagacctccgtgaagggccgttcaccatctccagagacaattccaagaacacgctactatctgacaaatgaacagcctgagagccgaagacacgccgtatattactgtagtagaaggcgtggggagtgggggactacggtcggggccgaacgggaacccgtggtaccgaccgtctcctcgacgcctccaccgaacggccctacgtccggttacccttcccccgtcgcctaccctaccctccgaacgacgccacctcggcgggtcacgacggccggtccccgtgggaccctcggtccgttcgggtaccgaacgggtccttaacttcccaacttcctaacgtaccgtacgtcggacggcgggccgtacggacgaacggtcnctaagtcggnn

SEQ ID NO: 223022 - DNA, 611 bp, Homo sapiens
  misc_feature: GYAE6OF01DIKFI.37.25.C03.1.454.CMB.1.raw
  modified_base (611)..(611): a, c, t, g, unknown or other
  misc_feature (611)..(611): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccgtgaagggccgttcaccatctccagagacaattaccaagaacacgctctatctgacaaatgaacagcctagagagaccgaagacgacggcgtatattactgtgtagaaaggcgtgggagtggggacgtacgtcggggaccgagggaaccctggtcaccgtctcctcgacgcctccaaccgaacgggcccctagtcccgttccttccccgtcggcctacccctcccgtaccaacgacgccacccgtcggtcggggacacgaccggtccggcccgttgggccttcggtcccgtcggtacgaaccggtacttaaccgttacctactacctaccaaccgttacgtacggacggtccgggacgttcgggaccgaaacgggccgacgactggtcn

SEQ ID NO: 223023 - DNA, 482 bp, Homo sapiens
  misc_feature: GYAE6OF01DNAGO.37.25.C03.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (407)..(411): a, c, t, g, unknown or other
  misc_feature (407)..(411): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (437)..(441): a, c, t, g, unknown or other
  misc_feature (437)..(441): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(448): a, c, t, g, unknown or other
  misc_feature (447)..(448): n is a, c, g, or t
  modified_base (451)..(454): a, c, t, g, unknown or other
  misc_feature (451)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (463)..(464): a, c, t, g, unknown or other
  misc_feature (463)..(464): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
tcagtagtgtagatcacgaccggtgctcgatttagtagtgtagatttgggtttgggattcacggttgcagactccgtgaagggccggttcaccatctccagagacaattccaagaacacgctctatctgcaaatgaacagcctgagagaccgaagacacggccgtatattactgtgtagaaggcgtggggagtgggggactagtcgggccacgggaccgtggtacaccgtctcctcacgcctaccacgaacggccagtccgtcctcccngccaccctctacaagcgccactcggngggacacgacgccgccgnggactcgcctggacagtactactccatctatactagtcggacggcggtcgtgacgaacggtcgactagagntanagngnancagcngacngacnnnnnacacgacgngngatnatntactacannnnnanangnncannnncngangcanncgcanacacacancngnc

SEQ ID NO: 223024 - DNA, 201 bp, Homo sapiens
  misc_feature: GYAE6OF01AI4LS.37.25.C03.1.454.CMB.1.raw
  modified_base (175)..(201): a, c, t, g, unknown or other
  misc_feature (175)..(201): n is a, c, g, or t
tcagtagtgtagatcacgaccggtgctcgatttagtagtgtagatttgggtttgggggggaagaggaagactgacggttcccccaggagttcaggtgctgggcacagcggcctgggctgcctggtcaaggctacttccatctacactactggagcgggctggcaaggcgcatagnnnnnnnnnnnnnnnnnnnnnnnnnnn

SEQ ID NO: 223025 - DNA, 553 bp, Homo sapiens
  misc_feature: GYAE6OF01DMD5S.37.25.C03.1.454.CMB.1.raw
  modified_base (248)..(248): a, c, t, g, unknown or other
  misc_feature (248)..(248): n is a, c, g, or t
  modified_base (314)..(314): a, c, t, g, unknown or other
  misc_feature (314)..(314): n is a, c, g, or t
  modified_base (525)..(553): a, c, t, g, unknown or other
  misc_feature (525)..(553): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtaatatttacngtgtgaaaggcgtggggatggaggggactacgtggggcacgggaaccctggtccaccgtctcctcncgcctccaccgaacgggcccagtccggtcctttcccccgtacggcccaaccctcccgtaccaaacgacgccaccgtccgtcgggggccaacgacggccggcccgtgggccgtcgcccgtcgggtaccgaacggtaccttaccgttccaacttcccgttaacaccgtacgtggacgggcgggtacgtcgggacgaaggcccgcaagtacggnnnnnnnnnnnnnnnnnnnnnnnnnnnnn

SEQ ID NO: 223026 - DNA, 179 bp, Homo sapiens
  misc_feature: GYAE6OF01APB2O.37.25.C03.1.454.CMB.1.raw
  modified_base (175)..(179): a, c, t, g, unknown or other
  misc_feature (175)..(179): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcgggctggcaaggcgcatagnnnnn

SEQ ID NO: 223027 - DNA, 651 bp, Homo sapiens
  misc_feature: GYAE6OF01EQM87.37.25.C03.1.454.CMB.1.raw
  modified_base (646)..(646): a, c, t, g, unknown or other
  misc_feature (646)..(646): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaacggccgttcaccatctccagagacaattccaagaacacgctctatctgacaaatgaacagcctgagacgaccgaagacgacggccgtatattacgtgtagtaggaaaggcgtaggggaggtgggggactacgtcggggccgacgggaacccgtcggtccgaccgtcctcctcgacgccctaccgaaccgaacgggccctacgtccggtccttcccccgtcggtccctacccctccctaccgaacgacgccacccgtccgtcgggggtaccaccgacggcccgggtccccgtcggggtccgtccggtccgttcgggttacgtaaccgggtaccttacccgttccgacgttacctaacctaacccgttaccgttagggacggtcccgggacgttcgggaccgaacgggcgactacgtaacgngtacg

SEQ ID NO: 223028 - DNA, 174 bp, Homo sapiens; identical to SEQ ID NO: 222845
  misc_feature: GYAE6OF01B8SHH.37.25.C03.1.454.CMB.1.raw
  modified_base (174)..(174): a, c, t, g, unknown or other
  misc_feature (174)..(174): n is a, c, g, or t

SEQ ID NO: 223029 - DNA, 619 bp, Homo sapiens
  misc_feature: GYAE6OF01B1MTG.37.25.C03.1.454.CMB.1.raw
  modified_base (249)..(249): a, c, t, g, unknown or other
  misc_feature (249)..(249): n is a, c, g, or t
  modified_base (614)..(614): a, c, t, g, unknown or other
  misc_feature (614)..(614): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccgtgaagggccgttcaccatctccaganacaattccaagaacacgctctatctgcaaatgaacagcctgagagccgaagacacggccgtatattactgtgtaggaaaggcgtaggggagtgggggactacggtcggggccgagggaacccgtggtccaccgtctcctcgacgccctccaaccgacgggcccacgttccggtcccttcccccgtggccctaccccgtccctaccaacggcgacctacccgtcggtcggggaccacgacggccggtcccgtagggccgtcgccgttcgggtaccgaacgggtacctaccgttccctactacccgtaactaccgtacgtaggacgggccggggtctacggggaccgaacgggaccgacgaactagngtacg

SEQ ID NO: 223030 - DNA, 442 bp, Homo sapiens
  misc_feature: GYAE6OF01BK9ZP.37.25.C03.1.454.CMB.1.raw
  modified_base (425)..(442): a, c, t, g, unknown or other
  misc_feature (425)..(442): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggcgtggggagtggggggactacgtggggccgacgggaaccgtggtcaccgtctcctcacgcctccaccgaacgggcccacgtccggtccttcccccgtggccacccctcctccaagacgcctacctcgtcgggggccacgacggccggcccgtgggccgtcgcccgtggtaccgaacgggtacctaccttccactccgtaccactacgtggacggccggggtctggaccgaacggcgacagtagnnnnnnnnnnnnnnnnnn

SEQ ID NO: 223031 - DNA, 705 bp, Homo sapiens
  misc_feature: GYAE6OF01E0XR7.37.25.C03.1.454.CMB.1.raw
  modified_base (216)..(216): a, c, t, g, unknown or other
  misc_feature (216)..(216): n is a, c, g, or t
  modified_base (288)..(288): a, c, t, g, unknown or other
  misc_feature (288)..(288): n is a, c, g, or t
  modified_base (702)..(702): a, c, t, g, unknown or other
  misc_feature (702)..(702): n is a, c, g, or t
tcagtagtgtagatcacgaccggtgctcgatttagtagtgtagatttgggtttggggaggcctggtgcagcctgggggtccctgagactctcctgtgcagcctctggattaatgtttagcaactctggcatgaactgggtccgccaggctccaggcatggggctgcagtggtctcaagtactagtgctctggtaatgagcagctacgcagctccgngacggccgttcaccatctccagtagactaattccaagtaacacgctctatctgacaatcgaacagcctgagngacgaagaccacggccgttataattacgtgtacggtaggaaaacggtcggtacgggggtagtaggggggaccttaacggtcgggggacccgaacggggtaaacccccgtgggtacccgaccggttccctaccgtaccgacggtcccctacccgaaccggtaaccgggtcccctacgttcccgggttccctttaccccccgtcgggtaccctacccccgttcctaacccgaacgaccggtaccctaaccggtccggtcgggggacctaccgaaccgggccggtaccccgttggggccgttccggtacccggttaggtccgtaaacggtaccttacccgtttacacgttaccgtacctaccgtacgtcggacgggtcccggtacggttagggacccgaacggaccgtagaacgagnggc

SEQ ID NO: 223032 - DNA, 670 bp, Homo sapiens
  misc_feature: GYAE6OF01CBJZK.37.25.C03.1.454.CMB.1.raw
  modified_base (665)..(665): a, c, t, g, unknown or other
  misc_feature (665)..(665): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcagtggggctgcagtgggtctcaagtactagtgctcctggtaatagagcagactacgcagactccgtgaagggccgttcaccatctcagagacaatccaagaacacgctctatctgacaaatgaacagcctgagacgaccgaagacacggccgtatattactgtgtagaaaggcgtaggggagtggggggactacggtcggggaccgaacgggaccctggtccaccgttctcctacgacgccctacccgaaccgaacggggcccctagtcccggttccctttccccccgtcggaccctaccccgtccctacccgaacgacgaccgtaacccgtccgtacggggggacctaaccggacgggcccgggtccccgtcggggtccgttcggcccggttacgggtaccgaaacgggtacccttaccgtttaccctaacgttacccgtaacctaaccgttaccgtcggtacgggccggggtacgtcgggacgtaaacgggtccgactaaggtcntgacg

SEQ ID NO: 223033 - DNA, 667 bp, Homo sapiens
  misc_feature: GYAE6OF01BRU60.37.25.C03.1.454.CMB.1.raw
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
tcagtagtgtagatcacgaccggtgctcgatttagtagtgtagatttgggtttgggggaggcctggtgcagcctggggggtccctgagactctcctgtgcagcctctggtttcatctttagcaactacgccatgagctgggtccgccaggctccgagggaagggctggagtgggtctcaggtattacgtggtagtggtaataccgcatactacgcagactccgtgacgggtccgttcaccgtctccagagacaattccaaagaatacggtntatctaggaaatgaacagcctgagagccgaggacacggccctntattactgtgcgagagatcagacggagtatagcagcagctctgactacgtcggggacctaaccggaaccctgggtacccaccggtcctccgtccacgccctacccaccgaaccgggccctacgttcccggttcccttcccccgtcggccctacccctccctacccaacgacgcccacccgtcggtcggggacccacggaccggcccgggtaccccgtgggtccttcgggtcccgttacgggtaaccgtaacgggtacccttacccgttaccctaccgttaccgtaacctaaccgttaccgtacggtaccgggaccgggtcgttacgggaacgtaaccgggccgtacgtaacgg

SEQ ID NO: 223034 - DNA, 680 bp, Homo sapiens
  misc_feature: GYAE6OF01CCXBG.37.25.C03.1.454.CMB.1.raw
  modified_base (147)..(147): a, c, t, g, unknown or other
  misc_feature (147)..(147): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtcccnccaggctccaggcagtggggctgcagtgggtctcaagtactagtgctcctggtaatagagcagactacgcagacctccgtggaagggtcccgttcaccatcctccaganactaattaccaagaacacgctactatctgacaaatgaacngcctagagacgaccgaacgacacggacgtatatactgtgacgaagaaccggtaggccgggtacggtacggaacgggggtaacttacgtttaagttaattaacttaactactagttcggacggttcggtaggggtacgaacggggtaccgtaccggtaccgacccgttcctcccgttacccgacgtccctacccgaaccggaccgggtccctacgttcccggttcccttccccgcggaccctacccctcccgtaccgaacgaccgtcccgacccgtcggtccggggaccaccggaccggccggtcccgtcggaccgtcggacccgttggaaccgtaccggtacctacccttacgtaccgttactaccaaccttcgtcggtacggg

SEQ ID NO: 223035 - DNA, 816 bp, Homo sapiens
  misc_feature: GYAE6OF01CJCWQ.37.25.C03.1.454.CMB.1.raw
  modified_base (311)..(311): a, c, t, g, unknown or other
  misc_feature (311)..(311): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtggtctacaagtactagtgcttcctaggtaatagagcagactacgcagacctcggtaggaacgggtcccggttacaacctatcctaccaagtacgaacaattaccaagaaacacgctactagtctagacaaatcgaaacngcctagagaagccgaagacgacggaccgtatattacgtgtagtaggaaacggtcggtaggggacggtacgggggaaccttacgggtcggggaaccgaacggggtaacccgtcgggtaccgtaacccgtccttaccccgtacgacccgtacccttacccgaaacccggtaaaccgggtacccctaaccggttccggttaccccccgtttcccccgtccgggtacccctaacccccgttacccgtaacccgaacggtaacccggtacccgtaaccccgttccgggtaaccggggggtacccaacccggtaccggggccccgggtccccggttaggggtcccctacggggtttaccccggtacgggttaacccgtaaacggtttaccccttaacccgttaccctaacgtttacccgtaaactacccgttaaccgggtacggtaaccggggtcccggggtacggttacggaacccggtaacggggtaacccataaacgtaggcaaacgg

SEQ ID NO: 223036 - DNA, 732 bp, Homo sapiens
  misc_feature: GYAE6OF01CI0HE.37.25.C03.1.454.CMB.1.raw
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
tcagtagtgtagatcacgaccggtgctcgatttagtagtgtagatttggggtttgggggaggcctggtgcagcctgggggggtccctgagactctcctgtgcagcctctggattaatgtttagcaactctggcatgaactgggtccgccaggctccaggcagtgggggctgcaggtgggtctcaagtactagtgccttctggtaatagagcagactacgcagacctccggtggaacgggtccggttcaccatccnccaganactaattaccaacagcacgcttagtatttgcacatagaacacggcctggagacggaccggaggaccaccgggactatattattagtttgtggaccgtaaactttccttttagactttaggttaacttaccttccctacggtcgtacccgtacggtcggggacccgaacggggtaaccctgggtacctacccgttccttccctacgaccgtcccctacccgaaccgtaaccgggccctaacgttcccggttaccccgttcccccgtacggtccccgtaccccttcccgtacccaaacggtaccgacctacccggtcggttacgggggaccctacgaccgggtcccgggtacccggttcggggcccttcgggtaccccgttacgggtaaccgtaaccggtaacctttacccgttacctacgttaccctaacacccgttacgtacggacgggtccggggtcgtcgggaaccggg

SEQ ID NO: 223037 - DNA, 460 bp, Homo sapiens
  misc_feature: GYAE6OF01B7R95.37.25.C03.1.454.CMB.1.raw
  modified_base (443)..(460): a, c, t, g, unknown or other
  misc_feature (443)..(460): n is a, c, g, or t
tcagtagtgtagatcacgaccggtgctcgatttagtagtgtagatttgggtttgggattcacgttgcagatgtaggtctgggtgcccaagctgctgaagggccggttcaccatctccagagacaattccaagaacacgctctatctgcaaatgaacagcctgagagccgaagacacggccgtatattactgtgtgaaaggctggggagtggggggactacgtggggccagggaaccctggtcaccgtctcctcacgcctccaccaagggcccagtccggtccttccccctggccacccctcctaccaacgcgccaccgtcgtggggggccacgacggccggcccgtcgggcctcggcccgtgggtacaaacgggtaccttaccttcccacttcctaacacctacgtggacggcgggcgtcgggacgaacgggcgacagtacgnnnnnnnnnnnnnnnnnn

SEQ ID NO: 223038 - DNA, 188 bp, Homo sapiens
  misc_feature: GYAE6OF01ATEVZ.37.25.C03.1.454.CMB.1.raw
  modified_base (173)..(188): a, c, t, g, unknown or other
  misc_feature (173)..(188): n is a, c, g, or t
tcagtagtgtagatcacgaccggtgctcgatttagtagtgtagatttgggtttggggggaagaggaagactgacggtcccccaggagttcaggtgctgggcacagcggccctgggctgcctggtcaaggactacttccatctacactactgagcggctggcaaggcgcatagnnnnnnnnnnnnnnnn

SEQ ID NO: 223039 - DNA, 826 bp, Homo sapiens
  misc_feature: GYAE6OF01EMLLW.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagccgtggggggtccctgagactctcctgtgcagcctctggattaatgtttagcaactctggcatgaacgtgggtccgccaggcctccaggcagtggggctgcaggtgggtctacaagtactagtcgctcctaggtaatagagcagactacgcacgactccgtaggaacgggtccgtcaccgtatccgaccaagacgaacctaacttacccaaaggtaaaccacgtccttacgtaatcgttagaaccaaaagtcgaaacgacgtcccgtaggaacggacggaacccggaaacggaccgtaacccgggtaccgttaacgttaacgtttacgtacggttacggtaagggtaaacggggtcgggttacggggggaaacgggttcggggggggtaaaccgttacggggtaccgggggaaccccggtaaccgggggtaaccccggttacgggtacccgtaccccggttacccgttcccgtaccggaccgtacccccgtaccccggaaacccggtaaccgggtacccccgaccggttacccgggtttacccccgtttccccccggtaccgggtaccccctaccccccgttacccgttaacccggaaccggtacccggtcccctacccggttacccgggtacgggggaccccgtaacggacccggcccggtccccgggtcgggtccgtacccggg

SEQ ID NO: 223040 - DNA, 747 bp, Homo sapiens
  misc_feature: GYAE6OF01B731T.37.25.C03.1.454.CMB.1.raw
  modified_base (150)..(150): a, c, t, g, unknown or other
  misc_feature (150)..(150): n is a, c, g, or t
  modified_base (218)..(218): a, c, t, g, unknown or other
  misc_feature (218)..(218): n is a, c, g, or t
tcagtagtgtagatcacgaccggtgctcgatttagtagtgtagatttgggtttgggggaggcctggtgcagcctggggggtccctgagactctcctgtgcagcctctggaattaatgtttagcaactctggcatggaacgtggggtcccnccgaggtcctccgaggctaggtggggctgcaggtgggtctacgaagtactagtcgcctcgtaggtaanagacgacaacggactacgcagaccttcggaggaacgggtcccgttaccaacctatcctaccgaagacgaactaactaccgaaacgaaccacgtctactatctagaacaaatcgaacacgtctaggacgacggaccgaagaccgacggtacttaagtacttacgtaggtaggaacggtaaacgggtggtagggggtaacgggttacgggggtacgtaccggggtaccgggggaaccgtaccgggtaacccggtcggtacccgtaccgttcgtaccccgtatacccggccctaaacccggacggaacccgtcccgtacggttcccgtcccccgttcccgacgaccccttacccgtaccacccgaagccgtcccgtaccggtcgggacggaccaacgggtaccggcccgtccggtcgggaccgttcccggtacggtaccgtaaccggtactaacccgtttcctacgtactaaccgaactacggtcggtacggacgggttaccggcgtaacgggaccgtacggctagactggc

SEQ ID NO: 223041 - DNA, 687 bp, Homo sapiens
  misc_feature: GYAE6OF01CCJ8V.37.25.C03.1.454.CMB.1.raw
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (672)..(672): a, c, t, g, unknown or other
  misc_feature (672)..(672): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaacgggccgttcaccatctccgagggactaatttcaaagaactcactgaatctgacaaatgaacagcctagagagccgagacacggtcgtatattacgtgtgacgagaacggtaggcgggtcgtcggaagggggtaacttcgttttaactaatttacttaactaacacgtaggaacgttcgtaggggaacgtaaacggaccgaacggtccaaccgtctcctcgacgcctaccaaccgaacggaccctacgttccggtacccttccccgtacggaccctaccctccgtaccgaaacgacgaccgtaccgttcgggtacgggggacaaccgacgggacccggtcccggtggggtacctcggtcccgttagggtaaccgtaaacgggtaccttacctttaacccgaccttaacctaaccgtaacgttaacgtaaccggacgggtacccggggaccttacggggaacccgtaacggggtcccgaacgtaaagttacgccgtgacgcgacgacgcganancacanacgcganancngngn

SEQ ID NO: 223042 - DNA, 752 bp, Homo sapiens
  misc_feature: GYAE6OF01ENRIO.37.25.C03.1.454.CMB.1.raw
  modified_base (277)..(277): a, c, t, g, unknown or other
  misc_feature (277)..(277): n is a, c, g, or t
tcagtagtgtagatcacgaccggtgctcgatttagtagtgtagatttgggtttggggaggcctggtgacagccctgggggtccctgagacctctcctgtgcagcctctggattaagtgtttagccaactctggcattgaactgggtccgcaggctcaggcagtgggctgcagtggtctacagtactagtgctcgtggtaatagagcgagactacggcacgacttccgtaggaacgggtccggttcaacctatcctccgagagactaattcaagaacncgtactctatctgactaatgaacagtcctgacgagccgaagacgacggccgtattagttacgtgtcgtagaaacggcgtaggggagtacggggtactacggtacggggaccgtaacgggaacccgttggtaccgaccggttccgtaccgtccgggaccttacccgaaccgtaaccggggcccctaacggttcccggttacccttcccccgtaggacccctaacccgttacccgtaacccgaaagtaccgtacccgaacccgtttcgggtacgggggacctaaccggtacccgggcccggtcccggtaacggggtccttaccgggacccgttacgggtaacccgtaaccgggtacctttacccggttacctaacgttacccgtaccgtaacccgtttaacgggccgggttaacggccggggttcgtaccgggaaacggtaaaccggggtcctacggtaaccgtaggtagtcgtacg

SEQ ID NO: 223043 - DNA, 574 bp, Homo sapiens
  misc_feature: GYAE6OF01CYWI5.37.25.C03.1.454.CMB.1.raw
  modified_base (540)..(540): a, c, t, g, unknown or other
  misc_feature (540)..(540): n is a, c, g, or t
  modified_base (548)..(548): a, c, t, g, unknown or other
  misc_feature (548)..(548): n is a, c, g, or t
  modified_base (550)..(574): a, c, t, g, unknown or other
  misc_feature (550)..(574): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaaagaacacgctctatctgcaaatgaacagcctgagagccgaagacacggccgtatattactgtagtagaaggctgggggagtggggggactacgtggggccagggaaccctggtccaccgtctccctcacgccctcccaccgaacgggccctacgtccgggttcccttccccccgtggccccaccccttccctacccaaagacggcctaacccgtcggtcgggggccacgacgcccgggcccgtgggctcggccgtagggtaccaaacgggtaccttaccgttccacttaccctaactaccttaacgtggaacggtccggggtcgtcgggacgtaagggccgaccaagttacgngacagtangnnnnnnnnnnnnnnnnnnnnnnnnn

SEQ ID NO: 223044 - DNA, 554 bp, Homo sapiens
  misc_feature: GYAE6OF01APYIZ.37.25.C03.1.454.CMB.1.raw
  modified_base (359)..(359): a, c, t, g, unknown or other
  misc_feature (359)..(359): n is a, c, g, or t
  modified_base (482)..(482): a, c, t, g, unknown or other
  misc_feature (482)..(482): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
  modified_base (527)..(529): a, c, t, g, unknown or other
  misc_feature (527)..(529): n is a, c, g, or t
  modified_base (532)..(554): a, c, t, g, unknown or other
  misc_feature (532)..(554): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagacgccgaagacacggcctatattactgtagtagaaaggcgtgggggagtggggggactacgtggggccaaggggaccctggtccaccggtctcctcacgccctaccgaccgaacgggcccagtccggtcccttcccccgnggccctacccctcctaccgaaggcgccaccgtcggtcgggggacaccgacggcccgggcccgtgggcctcggccgtgggtaccgaacggtacccttacttaccgacttcctaaccacttacgnggtacgggccgggtcgtacgggaccgaacgggcncgtatagntgnnncgnnnnnnnnnnnnnnnnnnnnnnn

SEQ ID NO: 223045 - DNA, 750 bp, Homo sapiens
  misc_feature: GYAE6OF01CALY1.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattcaactttggtagctattggatggactgggtccgccagtctccgaggggaaggggctgggagtgggtggccaacatacgaggggaggtggtaggtaacgaaaaactagtgtggactcgtgtggcggggccgattcaccatcctccagacgacaacgaccaaaactcactgtatctagacaaagtcggaccggcctaggagactccggaaggaccgacggcttaggttagttatttagttggtacggacggtaggtaagtaattttaacgaacttaaacgtaaaaggtttcgaagtagtacgttggtatgtatgtactttaagtgtacgtaccgggtacggggacccgaaacgggacctagtaccgggtaccgtaccgttccttccgttccgaccgtccccgtaccccgaacccgaaccgggtccctacggttcccggttaccccgttccccggtccgggtccccgtcccgtacgtcccgtaccgacgggtaccgacccgtaacccgtacgacggaccgaccgaaccggaccggcccgggtcccggtccgggtccgtaccgggtccgtacgggtacctaaacgggtacccttaccgttaccctacttaccctaccgtaccgttacgtgggcgggtccggg

SEQ ID NO: 223046 - DNA, 602 bp, Homo sapiens
  misc_feature: GYAE6OF01EHE62.37.25.C03.1.454.CMB.1.raw
  modified_base (601)..(602): a, c, t, g, unknown or other
  misc_feature (601)..(602): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtggaacgggccggttcaccatcctccagagacaattccaagaacacgctctactctgacaaatacgaacagcctagagacggaccgaagaccgacggaccgtaatacttacgtgtagtaggaaaggcgtaggggaggtagggggacgtacgggtcggggaccgaacgggtacccgtcgggtccgacccgtcctccgtacgacgtccctaccgaacccgacgggaccctacgtccggttcccttcccccgtcggccctaccctcctaccgacgacgtccaccgtcgcggggcacgacggccgccgtcgggctcgtcgtcggacgacgtacctactcactctacactacgtagacggcggcgtggacgtaacggcacatgnn

SEQ ID NO: 223047 - DNA, 814 bp, Homo sapiens
  misc_feature: GYAE6OF01BOZYF.37.25.C03.1.454.CMB.1.raw
  modified_base (175)..(175): a, c, t, g, unknown or other
  misc_feature (175)..(175): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
tcagtagtgtagatcacgaccggtgctcgatttagtagtgtagatttgggtttgggctgagcgtggcttttctgtggctattttaaaaggttccagtgtgaggtgcagttgttggagtctgggggaggcctggtgcagccgtggggggtccctgagacctctcctgtgcagcctntggattaatgtttagcaactcgtggacatcgaacgtcgggtcccgcgaggcctccgaggcagtcggggctgcgtaggtcgggtctacaagtactaggtcgtcctcgtaggtaaataggacggacaggtacctaccgacacggtaccgtccggtaggaacgggtcccgttacaacctctccgtacgaagaacgtaacctaacttaaccgaaacggaaaccnccgtaccttacttactacggttanaaacctaaaacgtacgaaacccgagtacccgagggaacgaaccgggaacccgtaaagaacccgtaccggtaacgtttaattaactttacggtggttagggtaacggtaaagggtccgggtaagggggtacgggttaggggggtaaccttcggggaccgggggtacccggaacgggtacccggttcggtacccgtcccgttcccgtccgtacgacccgtacccctacccggaaaccgggtacccggtacccctcggttaccccggttccccgttcccgtcccggtaccccctccccgttacccgacccgaacgtacccggccggtaaccgtcccgggggtcggaacccgaccgggtaccgggtccccgggaccccggttcgggtcggttacccggg

SEQ ID NO: 223048 - DNA, 856 bp, Homo sapiens
  misc_feature: GYAE6OF01CHBZS.37.25.C03.1.454.CMB.1.raw
  modified_base (148)..(148): a, c, t, g, unknown or other
  misc_feature (148)..(148): n is a, c, g, or t
  modified_base (186)..(186): a, c, t, g, unknown or other
  misc_feature (186)..(186): n is a, c, g, or t
  modified_base (851)..(851): a, c, t, g, unknown or other
  misc_feature (851)..(851): n is a, c, g, or t
  modified_base (853)..(853): a, c, t, g, unknown or other
  misc_feature (853)..(853): n is a, c, g, or t
tcagtagtgtagatcacgaccggtgctcgatttagtagtgtagatttggggtttgggggaggcctggtgcagccgtggggggtccctgagactctcctgtgcagcctctggattaattgtttagcaactctggcatgaacgtgggccncaggcctccgggcaggtggggctgcgtaggtggtctanaagtactagtcgcttcgtaggtaatagagcaagactacgcacgtaccgtccggtaggaaccgggtccgttacaacctcttcctaccgaaggaactaacctaaacgttaccgaaacgaaccgaccgttactactaactcgtagaaactaaagtacgaacgtcgtccgaggaacgaaccggaaccggaacgtaaccggacggttacctaagtttacttacggtagtaggtaaagggtaggtacgggtagggggtagggtacggggggtaactacggggtacggggaccggaaccgggtacccgttcgggtacccgtaacccgtcccgttacccgacgaccgtacccctaacccggaacccgggtaacccgggtccccgttacccggtttccccggttcccccgtttacccccggtacccgggtaacccccttaaccccgttacccggaaacgtaaccggtacccgtacccggttacccggtccggggtccgggacctaacccgggtaccgggtcccggtacgggtccggtacccggttccggtaccggttccgggtaaccgtaaccgttaccgtttacccgtacctaaccgtaccgtaaccgtaacggttcggaccggtacgggcggtacggtacccgggaacgtaccgggacctacgggatacggngngcg

SEQ ID NO: 223049 - DNA, 621 bp, Homo sapiens
  misc_feature: GYAE6OF01B89SO.37.25.C03.1.454.CMB.1.raw
  modified_base (459)..(459): a, c, t, g, unknown or other
  misc_feature (459)..(459): n is a, c, g, or t
  modified_base (482)..(482): a, c, t, g, unknown or other
  misc_feature (482)..(482): n is a, c, g, or t
  modified_base (616)..(616): a, c, t, g, unknown or other
  misc_feature (616)..(616): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagacctccggtggaacgggccgttccaccatctccagacgaacaactccaagaacacgctctatcctgacaaatgaacacgccgtagagacgaccgaagaccgacggaccgtatatactgtagtagaaggcgtaggggagtaggggtacgtacggtagggaccgacgggtaaccgtcggtccgtaccgtccgtcctcgaccgccctaccgaaccgaccggtccgtaccgtttccgtttccccgnggcccctacccgtcaccgagacncctaaccgtcggacgggccacgtccggaccggtccgtcggctcggtccgtcgtacgacgtaccgtactcctataccgtacctacgtacggtcggaacggccgggtcgtcgggaacaccgggtccacgtagacgngctcg

SEQ ID NO: 223050 - DNA, 369 bp, Homo sapiens
  misc_feature: GYAE6OF01BBO53.37.25.C03.1.454.CMB.1.raw
  modified_base (367)..(369): a, c, t, g, unknown or other
  misc_feature (367)..(369): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaagcgcatagnnn

SEQ ID NO: 223051 - DNA, 790 bp, Homo sapiens
  misc_feature: GYAE6OF01CWZG1.37.25.C03.1.454.CMB.1.raw
tcagtagtgtagatcacgaccggtgctcgatttagtagtgtagatttgggtttgggctgagctggctttttcttgtggctattttaaaaggtttccagtgtgaggtgcagttgttggagtctgggggaggcctggtgcagccgtggggggtccctgagactctcctgtgcagcctctggatttaatgtttagcaactctggcatgaactgggtccgccaggctccaggcagtggggctgcagtggtctcaagtactgtgctcctggaatagagcagactacgcagactccgtaggaacgggccggtttacaccatcctccgaagacgacaattaccaaagaaccacgctctatcctgaacctaaatgaaacacgtccgtagaagaacgaccgaaagtaaccgaccggtaccggttaatacgtttaacgttacggtggttaaggaaacgggtcggtagggggtacgggtacgggggggtaaaccgttaccgggttacgggggaacccgtaaccgggggtaaccccgtcggggttacccgtaccccggtttaccgttaccccgttaccgtaacccggtccccgttaaccccgaaacccggtaaccggggtaccccctaccggttaacccgggtttcccccgtttacccccccggtccggtaacccccgtacccccttacccggttaaccccgaaaacgggtaccgaccccggtacccgttacccgggtccggggggaaaccctacccggaaccggggccccggtaccccggtggggtcccgttaacccgggg

SEQ ID NO: 223052 - DNA, 604 bp, Homo sapiens
  misc_feature: GYAE6OF01CCX5K.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaaggccgttcaccatctccagagacaattccaagaacacgctctatctagcaaatgaacagcctgagagccgaagacacggccgtatatactgtgtagaaaggcgtagggagtgggggactacgtggggaccagggaaccctggtcaccgtctcctcagtcctccaaccgaacgggcccagtccggtccttcccccgtcggcccaccctcctaccaacgacgccaccgtacgtcgggggaccacgacggccggcccgtggggtcctcggacccgtggtaccgaaacggtaccttaccgttacctactccttaaccgacctacgttcggacggtaccggggccgttacgggaccgaaacgggcccgtacaaagttagcagc

SEQ ID NO: 223053 - DNA, 179 bp, Homo sapiens
  misc_feature: GYAE6OF01D4TSA.37.25.C03.1.454.CMB.1.raw
  modified_base (177)..(179): a, c, t, g, unknown or other
  misc_feature (177)..(179): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcgggctgggcaaggcgcaatagnnn

SEQ ID NO: 223054 - DNA, 561 bp, Homo sapiens
  misc_feature: GYAE6OF01ARECF.37.25.C03.1.454.CMB.1.raw
  modified_base (523)..(523): a, c, t, g, unknown or other
  misc_feature (523)..(523): n is a, c, g, or t
  modified_base (561)..(561): a, c, t, g, unknown or other
  misc_feature (561)..(561): n is a, c, g, or t
tcagtagtgtagatcacgaccggtgctcgatttagtagtgtagatttgggtttgggggaggcctggtgcagcctggggggtccctgagactcgtcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagactaattccaagaacacgctctatctgcaaatgaacagcctgagagccgaagacacggccgtaatacttaactgtgtgaaagggcgtggggagtggggggactacgtgggggccagggaaccctgggtcaccgtctccgtcacgcctccaccgaagggcccatcggtcctcccctgccaccctcctaccagacgccaccgtcgcggggcacgacgcggcccgtgggcctcgcctggtaccaaggacctaccttccacttcctaacaccgtacgnggacggcgggccgttggacctaagggcgacattacgtn

SEQ ID NO: 223055 - DNA, 176 bp, Homo sapiens; identical to SEQ ID NO: 222977
  misc_feature: GYAE6OF01CFJUJ.37.25.C03.1.454.CMB.1.raw
  modified_base (175)..(176): a, c, t, g, unknown or other
  misc_feature (175)..(176): n is a, c, g, or t

SEQ ID NO: 223056 - DNA, 746 bp, Homo sapiens
  misc_feature: GYAE6OF01C8YWZ.37.25.C03.1.454.CMB.1.raw
  modified_base (145)..(145): a, c, t, g, unknown or other
  misc_feature (145)..(145): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccgaggcagtggggctgcagtgggtctacaagtactagtgctccgtaggtaatagagcagactacgcagactccggtagaacgggtccgttacacattccaccgagaagactaataccaagaacacgctctatcctagacaaatagaaacacgcctaggacgacggaccgaacgaaccgacggtaccgttaattaacttacgttaggtaggtaaggaaacgggtcggtaagggggtagggtaacggggggtaacctaccgggtacgggggaccggtaaacgggtaaccccgttcgggtaccaacccgttccgtacccgtacgacccgtaccctaccccggaaccggaccgggaccccttaacggttccccgggtttccccttacccccggtcggtacccctacccccgtaccgtaaccgaacggtaccgtacccgtaccggtccgggtacggggacccacggtaccgggccggtcccgggttcgggccgtaccgggtcgttacgggtaccaacggtaccttaccttaccactacctaccgtaaccgtcggtaggacggtcggtcggtacggacgtaacggctacgagttacggc

SEQ ID NO: 223057 - DNA, 687 bp, Homo sapiens
  misc_feature: GYAE6OF01DAQ9L.37.25.C03.1.454.CMB.1.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (575)..(575): a, c, t, g, unknown or other
  misc_feature (575)..(575): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactcgtggcatgaactgggtccgccaggctccaggcagtggggctgcagtgggtctcagtactagtgctcctagtaatagngcaggactacgcagactccggtaggaacgggtccgttcaccatctccaaganacaataccaagaacacgctactagtctagacaaaatcgaacncggtacctaggaacgacgaccgaaagaccggtacgccgttaatacgttacgtcgagcgtaaggatagtacgaggtaacggtagtacgacgacgaaacgcgtagtcctcgttacgaccgttacggtcgggacccgtaaccgggtaacccttggggtaccctaccgttctaccccgtactacggacccctaaccggaacccggtacgggaccccttccggttaccgtcccccttcccggacgggtcccgtacccgttcgcccgtaccgggaggtacccncccgtaccgacgaacggccaccgtaaccgggccggtcccggtaccggtcgggctaccggcgttaccggacgtaaccttacccttcttaccgtatacccgtacgttccgtagg

SEQ ID NO: 223058 - DNA, 497 bp, Homo sapiens
  misc_feature: GYAE6OF01BFKGP.37.25.C03.1.454.CMB.1.raw
  modified_base (450)..(450): a, c, t, g, unknown or other
  misc_feature (450)..(450): n is a, c, g, or t
  modified_base (454)..(497): a, c, t, g, unknown or other
  misc_feature (454)..(497): n is a, c, g, or t
tcagtagtgtagatcacgaccggtgctcgatttagtagtgtagattttgggtttgggattcacgttgcagactccgtgaagggccggttcaccatctccagagacaattccaagaacacgctctatctgcaaatgaacagcctgagagccgaagacacggccgtatattactgtgtagaaaggcgtggggagtgggggactagtggggccagggaccctggtcaccgtctcctcacgcctaccaccgaacggcccacgttccggtcccttcccccgtggcccacccctcctaccgaagacgcctaccctcggtcggggccacgacggccggcccgtcgggccgtcggccgtaggtacgaacggtaccttaccttaccacttaccgtaacctacgttaactgggaccggtcggggtacgtcgggaaccgtaacggccgacgtaacgtaggntcgnnnnnnnnnnnnnnnnnnnnnnnnnnnnnnnnnnnnnnnnnnnn

SEQ ID NO: 223059 - DNA, 740 bp, Homo sapiens
  misc_feature: GYAE6OF01BVP1L.37.25.C03.1.454.CMB.1.raw
  modified_base (145)..(145): a, c, t, g, unknown or other
  misc_feature (145)..(145): n is a, c, g, or t
  modified_base (158)..(158): a, c, t, g, unknown or other
  misc_feature (158)..(158): n is a, c, g, or t
  modified_base (735)..(735): a, c, t, g, unknown or other
  misc_feature (735)..(735): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccgggnagtggggctgcaggtgggtctcaagtactagtgcttcctaggtaatagagcaagactacgcagaccttcgaggaagggccgttacaccattccaccaagacaactaacttaccaagaacacgctactatctgacaatagaacacgcgtgagacggaccgaagacgacggaccttaatacttactgtacgttaagaaacggtcggtaggggaggtacggggggaactacggcggggtacccgaacgggaacccgtttcggtacctaaccgtccctccgtacgaaccgtcccctaccgaaccggtacggacccccgtacggttcccggttacccccgtttaccccccgtcgggtaccccctaacccccgttcccgtaacccgtaaacggacccgtaccgtaacccggtcgggttaccggggacctaaccggacgggtcccggtcccggtcgggtaccgtccgccgggttacgtaaccgtaaacggtcccttacctacccgtaacttacccgtacctaaaccgtcgtacggtaccgggcgggcctacggggaacctaccggggacttacggaacgttcgngcacg

SEQ ID NO: 223060 - DNA, 613 bp, Homo sapiens
  misc_feature: GYAE6OF01ESW8U.37.25.C03.1.454.CMB.1.raw
  modified_base (574)..(574): a, c, t, g, unknown or other
  misc_feature (574)..(574): n is a, c, g, or t
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (608)..(613): a, c, t, g, unknown or other
  misc_feature (608)..(613): n is a, c, g, or t
tcagtagtgtagatcacgaccggtgctcgatttagtagtgtagatttgggtttgggctcaaactcgtcttgtccgccaggctccaggcatggggctgcagtgggtctcaagtactagtgctcctggtaatagagcagactacgcagactccgtgaagggccggttcaccatctccagagacaattccaagaacacgctctaatctgcaaatgaacagcctgagagccgaagacacggcgtatattactgtgtagaaaggcgtggggatggggggactacgtggggccgagggaaccctggtcaccggtctcctcagcctccaccgaacgggcccacgtccggtccttcccccgtggccaccctccctccgaacgacgccaccgtcgtgggggccacgacggccggtccccgtggggtacctcggtcccgttcgggtaccaaacgggtacccttaacccgttaccctacgttacccttaaccctaaccgttaaccgtggtaaccgggtccggggtccgttacgggaccgtaaacgggccgtacgaacgttaacggcgtacgacagcgacgtccgntcgctcgtcgacgcgagagngtgcgnagncgcgnnnnnn

SEQ ID NO: 223061 - DNA, 542 bp, Homo sapiens
  misc_feature: GYAE6OF01EFQD7.37.25.C03.1.454.CMB.1.raw
  modified_base (259)..(259): a, c, t, g, unknown or other
  misc_feature (259)..(259): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (520)..(522): a, c, t, g, unknown or other
  misc_feature (520)..(522): n is a, c, g, or t
  modified_base (524)..(542): a, c, t, g, unknown or other
  misc_feature (524)..(542): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgaagggccgttcaccatctccagagacaattccaagaacacgctctatctgacaaatgaacagcctgagagaccgaagacacggccgtatattactgtgtagaaggngtagggggagtgggggactacgggtcggggaccgaagggtaaccctggtccgtacccgttcgtccgtcgacgccctaccgaaccggaacgggccccgtaacgttccccggttcccttcccccgtcgaccctacccctccctacgaacggacgccacccgtcggtcgggccacgacggccggccgtggcctcgccgtagtacgaagtccttacctcatacctacgaccgtagtgacggtcgggctcggacgngccatagngnnngnnnnnnnnnnnnnnnnnnn

SEQ ID NO: 223062 - DNA, 849 bp, Homo sapiens
  misc_feature: GYAE6OF01BQ7K4.37.25.C03.1.454.CMB.1.raw
  modified_base (206)..(206): a, c, t, g, unknown or other
  misc_feature (206)..(206): n is a, c, g, or t
  modified_base (841)..(841): a, c, t, g, unknown or other
  misc_feature (841)..(841): n is a, c, g, or t
  modified_base (847)..(847): a, c, t, g, unknown or other
  misc_feature (847)..(847): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaacgtgggtccgccaggctccaggcagtggggctgcaggtgggtctacaagtactagtgctccgtaggtaanagagcagactacgcagacctccggtggaaccgggtcccggttacaccctatcctaccgaagacgaactaacttaccaaacgaaccaccgtcctacttactctagactaaaagtacgaacgacgcctaggaggaccggacccggaaacggaccggtaccggtaccgttaattaacgtttacgtgggttaacgggtaacgggaaacggggtcgggtaggggggtaacgggggttacggggggtaccgttaccggggcggggggtaacccggtaaccggggtaaccccggtcgggtacccgtcccgttaccgtcccgtaccgaccgtccccgtacccgaacccgggtaaccgggtccccgttacgtccccgggtttacccccttcccccggtaccggacccccttacccccgtacccgtaacccgaacggtacccggtcccctaacccggtccgggggtaccggggcccaccgggacccgggtcccggtcccgggtacgggtcccggttccggtacccggttacgggtaaccgtaaaccggttaccctaacccttaccgactttacccgtaacctacggtaccggttacggggccggacccggggttacgtccgggaaaccggtcggacgttaacggntacggnag

SEQ ID NO: 223063 - DNA, 610 bp, Homo sapiens
  misc_feature: GYAE6OF01CUDXQ.37.25.C03.1.454.CMB.1.raw
  modified_base (145)..(145): a, c, t, g, unknown or other
  misc_feature (145)..(145): n is a, c, g, or t
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (466)..(466): a, c, t, g, unknown or other
  misc_feature (466)..(466): n is a, c, g, or t
  modified_base (606)..(606): a, c, t, g, unknown or other
  misc_feature (606)..(606): n is a, c, g, or t
  modified_base (609)..(610): a, c, t, g, unknown or other
  misc_feature (609)..(610): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccnccaggctccaggcagtggggctgcagtgggtctcaagtactagtgctctggtaatagagcagactacgnagactcgtgaaggcgtcacatctcagagacatcaagacncgctatatctgacaaatcgaacagcctaggacgacgacgtaacgacgacgtactattactagtagtagaaggaacggtgggagggtaggggtacgggtaacgtacggggcgggaacggaaccgggtaccgtcggtccgtaccgtcctccgacgcccgtaccaaccgaacggccgtcgtacggttcccgtccccgttaccgcgtacccctaccnccgtaacgacgtacctaccgtaccgtcgggacggacctaggccggtccggccggcgtcgccgtcgtacgaaccgtaacgttacctacctactacctaccgtacacgtacgacgcgggcgccggtagaccgacggctaagntgnn

SEQ ID NO: 223064 - DNA, 495 bp, Homo sapiens
  misc_feature: GYAE6OF01DEPBD.37.25.C03.1.454.CMB.1.raw
  modified_base (459)..(495): a, c, t, g, unknown or other
  misc_feature (459)..(495): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtagaaaggctggggagtgggggactacgtggggccagggaaccctggtcaccgtctcctcacgccctcccaaccgaacgggccctacgtccggttcccttcccccgtggcctaccccctcctacccaagacgccaccgtcgtcgggggccacgacggccgggtcccgtggggccgtcgtcccgtgggtaccgaacggtaccttacccgttcctacttacctaaccgtaaccttacgtagggacggaccggggtcgtacgggaacgaacgggccggacgaagtagnnnnnnnnnnnnnnnnnnnnnnnnnnnnnnnnnnnnn

SEQ ID NO: 223065 - DNA, 744 bp, Homo sapiens
  misc_feature: GYAE6OF01D3WZ8.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccggtaggaacgggtccgttcaccatcctccaagagacaattaccaagaacacgctctatctagacaaatagaacacgccgtagagacggaccggaagaccgaccggaccgttatacttacgtgtagtaggaaagggcggtaggggaggtgggggacctacgggtcggggaccgaacgggtaacccgtggtacctacccgtcgtcccgtcgaccgtccctacccgaccgaaccgggccctacgttcccggttcccttcccccgtcggaccctacccctacccgtacccgaacggaccgtacccgtacccgtccgggtacgggggaccctaaccggaccgggtccccgggtccccgggtacgggtccgtccggtcccggtaccgggttaaccggtaaccggttacccttaacccttacccgtaacctttacccgtaacccgtacccgttaaccggtagggaaccgggtccggggtaccgtccggggtaaccggtaacgggtacccgaacggtaacgtcggcgtcg

SEQ ID NO: 223066 - DNA, 770 bp, Homo sapiens
  misc_feature: GYAE6OF01A0DIA.37.25.C03.1.454.CMB.1.raw
  modified_base (147)..(147): a, c, t, g, unknown or other
  misc_feature (147)..(147): n is a, c, g, or t
tcagtagtgtagatcacgaccggtgctcgatttagtagtgtagatttggggtttgggggaggcctgggtgcagcctggggggtccctgagactctcctgtgcagcctctggattaatgtttagcaactctggcatgaactgggtccncaggctccaggcagtggggctgcagtgggtctacgaagtactagtgcctccgtaggtaatagagacacgactacgcacgacgtccggtaggaacgggtcccggttaccaaccgatcctaccgaaggacgaacctaactaccaaaacgaaaccgaccgaccttacttaactcctacgaacaaaattacggaacaacggcctaggaacggacgacggaaacgtaccgaccggtacgtactattacgtaggtacggtaaggaaggtcgggtaggggacgggtagggggacttacggggtcgggaaccggaacgggacccgtcggtaccgacccgttaccgtccctaccgacgtaccctacccgtaaccgggacccggtacctaccggttcccggttcccccgtccccgtacggccccggttcccgacggtaccctccgggaacggtacccgacccgtacccgacgtacggcgtaaccgacggccgggaccccggtccggtacggggtcctccgggtacccggttggaacccgttaacgggtccctaaccgtccgtaaccctaccgtaacctaacccgtaggtaacgggccggaccggggtcaaccgggagtaccgggcaggtacag

SEQ ID NO: 223067 - DNA, 698 bp, Homo sapiens
  misc_feature: GYAE6OF01BC94M.37.25.C03.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (697)..(698): a, c, t, g, unknown or other
  misc_feature (697)..(698): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctggcatgaactgggtccgccaggctccgaggcagtggggctgcagtggtctnaagtctagtgctcctggtaatagagnagactacacagtactccgtagaagggccgttacacccgtatcctccagacgaacaacttccgaaagaacacgtactctaacgttctacgacaaagtacgaacacgcctagagacgaccgaacgacgacggtaccgtaatacttacgtgttacgtaggaaaaggtcgtaggggtaggtacgggggtaacgttacggcgggggtaccgaacggggtaacccgttcgggttaccgaacccgtttcctacccgtagaccggtccctaaccgaccgaacccggacccgtaaccgttccgggttcccctttcccccgttaggtcccccgtaaccctaccctaccgaacggacgtacccgacctttccgggcgggacgtaacccgccggtccggcccgtacgggtccgtacgtcccgtagggtaccaacgggtcctaaccgttctaaccgtactaacctacgtactaggtacggcggacgtcgacgaacggcacgatggnn

SEQ ID NO: 223068 - DNA, 717 bp, Homo sapiens
  misc_feature: GYAE6OF01AKPP9.37.25.C03.1.454.CMB.1.raw
  modified_base (510)..(510): a, c, t, g, unknown or other
  misc_feature (510)..(510): n is a, c, g, or t
  modified_base (601)..(601): a, c, t, g, unknown or other
  misc_feature (601)..(601): n is a, c, g, or t
tcagtagtgtagatcacgaccggtgctcgatttagtagtgtagatttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcgagtgaaggtctcctgcaaggcttctggttataccgtttagctaaattatggtatcaacgtgggtgcgacacggcccctggacaaggccagtgagtggagtgggatggatcgacgtcgtacttaacaaataaacgtaaacaccaactaactacgtagacaacgaaggtaacgttaccgaaggggcaaggtaccgtacctaaccccgtacggaaacccacgaacgtaaactaaccgaacgttacccgaacggaacaccgaaccaaccgtacccttaacgaagttacggggaanacggttagggaacggtacggacctacgggaacgtacttacggtacggaaccggtaccggtacccgggttcccggtttaaggttttaaccgnggttaccgggacggtaagtaaacggttaacgtaagttaaacgtttaaggttagttaaacggtaaccgggtaccgttaaaccgggcggggtaaccccgtacggggttaaacccccgg

SEQ ID NO: 223069 - DNA, 588 bp, Homo sapiens
  misc_feature: GYAE6OF01B3L6A.37.25.C03.1.454.CMB.1.raw
  modified_base (178)..(178): a, c, t, g, unknown or other
  misc_feature (178)..(178): n is a, c, g, or t
  modified_base (216)..(216): a, c, t, g, unknown or other
  misc_feature (216)..(216): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (557)..(557): a, c, t, g, unknown or other
  misc_feature (557)..(557): n is a, c, g, or t
  modified_base (561)..(588): a, c, t, g, unknown or other
  misc_feature (561)..(588): n is a, c, g, or t
tcagtagtgtagatcacgaccggtgctcgatttagtagtgtagatttgggtttgggctcaactctcttgtccgccaggctccaggcagtggggctgcagtgggtctcaagtactagtgctcctaggtaatagagcagactacgcagactccgtggaagggccgttcaccatctcaganacaattccaaagaacacgctctatctgacaaatgaacngcctgaagacgaccgaagaccgacggtcgttatattacgtgtagtagaaaggtcgtggggacggtgggggactacggtcggggaccgaacggggaacccgtggtcctacccgtacgttccacgtacgccctacccaccgaacgggccctacgtcccgttccttcccccggngtccacccctcctaccgaagcgcccacgttccggngggggaccaaccgcggccggtccccgcgggaccgtcgtacccggttggtaaccgtaacggtaccttacccttacccgtaatacctaacaaccgttacgtaaggcggccgggcgtcggacgaacgggccgaactanacgnnnnnnnnnnnnnnnnnnnnnnnnnnnn

SEQ ID NO: 223070 - DNA, 827 bp, Homo sapiens
  misc_feature: GYAE6OF01CVIOG.37.25.C03.1.454.CMB.1.raw
  modified_base (345)..(345): a, c, t, g, unknown or other
  misc_feature (345)..(345): n is a, c, g, or t
  modified_base (823)..(823): a, c, t, g, unknown or other
  misc_feature (823)..(823): n is a, c, g, or t
tcagtagtgtagatcacgaccggtgctcgatttagtagtgtagatttgggtttgggggaggcctggtgcagccttggggggtccctgagactctcctgtgcagcctctggattaatgtttagcaactctggcatgaactgggtccgccaggcctccgggcagtggggctgctaggtgggtctacaagttactagtgccttccgtaggtaactaggagcgaagacctacgcaacggaccttcggtagggaaacggggtcccgtttaccaccgtattcctaccaagaacgactaacttaccgaaagtaaccacgtccttacttagtcctagaacaaagtacgaaacncggcctaggaacgacggaccgtaagaaccgacgggtaccttaagttactttacggtggttacgtaagggaaacggtcgggtggggagggttacgggggacttacggggtacggggacccgaacggggtaaccgttcggaccgtacccgttccctcgaccgacgtcccgtacccaaaccgggtaaccgggcccttaccgttcccgggtttacccccttacccccggtaccggacccccttaacccccgttaccgtaacccggaacggtaccgtaccccgtacccggttacggggtccggggaaccctacggaccgggtacccgggtcccggttacgggtccgtccggtacccggttcggaaccgaaccggtttacctttacctacccgtacttaacccggacctaacgttacggacgggtacgggtaccggtcccggttaacgggaaccggttacgggacccttaacggagtttaacgncgag

SEQ ID NO: 223071 - DNA, 765 bp, Homo sapiens
  misc_feature: GYAE6OF01EYW2V.37.25.C03.1.454.CMB.1.raw
  modified_base (216)..(216): a, c, t, g, unknown or other
  misc_feature (216)..(216): n is a, c, g, or t
tcagtagtgtagatcacgaccggtgctcgatttagtagtgtagatttgggtttgggctgagctggctttttctgtggctattttaaaaggtttccagtgtgaggtgcagttgttggagtcgtgggggagcctggtgcagccgtgggggtccctgagactctctgtgcagcctcgtaggaatttaatgtttagcaactctggcatgacgtgggtccnccgaggcctccgaggctagtggggctgcgaggttcgggtctacgaagttacgtagtcgccttccgtaggttaaactaggacgccaagacgtaaccgcaacggtacccgtcggtaaggaaccgggtccggttcacctacgtcctcgaagacaacctaacgttaccaaaagacctaccgcttactaactccgtacgaaaccttaaaagtacggaaaacgcgtccgtaaggaacgaccggtaaccccggaaagtaaacccggccgggttacctttaaactagtttacgtaggtacggtaagggaaggtcgggttaggggaacgggttacgggggtacctaccggggagggtacccggaaaccggttcccgcggttaaccctcggttcctcccgacgccgtaccctaaccgaacccggtaaccggtacccgtaccgttccggttaccccttcccccgcggtaccccgtaccctacccgaaccgtacgaacccgtccgttaacccggccgggtacgggccgtaccgcggcccccggtcggtggtcccgtaccgg

SEQ ID NO: 223072 - DNA, 722 bp, Homo sapiens
  misc_feature: GYAE6OF01D768F.37.25.C03.1.454.CMB.1.raw
  modified_base (291)..(291): a, c, t, g, unknown or other
  misc_feature (291)..(291): n is a, c, g, or t
  modified_base (720)..(720): a, c, t, g, unknown or other
  misc_feature (720)..(720): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgcaggctccaggcagtggggctgcagtgggtctcaagtactagtgactcctggtaatagagcaagactacgcagactccgtggaacggtccgttcaccatctccagagactaattaccaagaacacgctctatcgtgacaatgaacnggcctagaacggacgaccgaaagaccgtaccggaccgttataacgtttacgtgtaggtacggaaaggtcgtaggggacggtacggggactacgggtcggggaccgtaacggggtaacccgttggtacccgaaccggttccctcccgtacgaccgtacccgtacccgaaaccggaaccggtaccgtaccggtcccggttaccccgttaccccccggtacggacccctaccccgtacccgtacccgaacggtaaccgtcccgtacccgtacgggtaccggggaccaaccggtaccgggcccggtccggtaccggggtcttaccgggtaccgttacgggtacaaccggtaccgttaaccttaccacttaccgtaaccctacggtactagggacggtcgggacgttacgggacggaacggtccgaatacgtgncg

SEQ ID NO: 223073 - DNA, 831 bp, Homo sapiens
  misc_feature: GYAE6OF01EZKX0.37.25.C03.1.454.CMB.1.raw
  modified_base (218)..(218): a, c, t, g, unknown or other
  misc_feature (218)..(218): n is a, c, g, or t
  modified_base (829)..(829): a, c, t, g, unknown or other
  misc_feature (829)..(829): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgcaggctccgaggcagtcggggctgcaggtgggtctcaagtactagtgctcgtaggtaatagagcagactacgnagactccgtagacggccgttcacatctacgagagaactaacttccaagaacacgtctcgtatctacgaactaaactacgaaacgacgtaccgtaggaaacgacgggaacccggaacgaaaccggaacccgggtaccgtttaagttaaacgttttacgtttaagggtagttaacgggtaaaacgggtccgggtaaggggggtacggggtacggggggtaacccttacgggggaccgggggtacccggaaacggggtaccccgttacggggtacccctacccgggttcctacccgtccgtaaccggtacccttaccccgaaaccggtaccggggtccccttaaccgggttcccggttaacccccgttcccccgttacggtaccccctaaccccgttcccgttaacccgaacggaacctacccggtaacccgttacggggtccgggaacccgtaccgacccgggggcccgttacccgggacggtcccggttaccggtacccgttaggtaaccgtaaacggttaccgttaacctaccgtacctaccgtaactacgtaacggttgggaaccgggtcggggaccgtacggaccgtaaacggccgtaagaacgtacgngc

SEQ ID NO: 223074 - DNA, 634 bp, Homo sapiens
  misc_feature: GYAE6OF01AJ6PW.37.25.C03.1.454.CMB.1.raw
  modified_base (602)..(602): a, c, t, g, unknown or other
  misc_feature (602)..(602): n is a, c, g, or t
  modified_base (606)..(607): a, c, t, g, unknown or other
  misc_feature (606)..(607): n is a, c, g, or t
  modified_base (611)..(634): a, c, t, g, unknown or other
  misc_feature (611)..(634): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccgttcaccatctccagagacaacttccaagaacacgctctatctgacaaatgaacagcctgagagaccgaagaccgacggccgttaatattactgtgtaggaaggtcgtaggggagtgggggactacggtcggggccgaacggggaaccctgggtaccctacccggtcctcccgtcgaccgtccctacccgaacccgaaccgggccctacgttcccggttcccctttacccccgtcggcccctacccctcccgtaccaaacggacgcccgtaccgtccgggtcggggtaccaccggacggcccggtcccggtgggtccgtccggtccggttcgggtaaccgtaacggtaccctttaccgttacctaacttaccgtacctaacgttacggtaggaccgggccggggtaccgttacgggaccgtacgggaccggtactaacgtgcnacgnngtcnnnnnnnnnnnnnnnnnnnnnnnn

SEQ ID NO: 223075 - DNA, 910 bp, Homo sapiens
  misc_feature: GYAE6OF01CA1QY.37.25.C03.1.454.CMB.1.raw
  modified_base (240)..(240): a, c, t, g, unknown or other
  misc_feature (240)..(240): n is a, c, g, or t
  modified_base (905)..(905): a, c, t, g, unknown or other
  misc_feature (905)..(905): n is a, c, g, or t
tcagtagtgtagatcacgaccggtgctcgatttagtagtgtagatttggggtttgggggaggcctggtgcagcctggggggtccctgagactctcctgtgcagcctctggattaatgtttagcaactctggcatgaactgggtccgccaggctccaggcatggggctgcagtgggtctcaagtactagtgctctggtaatagagcagactacgcagactccgtgaagggtccgttcaccntctcagagaacaattcaagaacacgctactatctagacaaaatgaaacacgcctaggaacgtacgaccggaaacgacccgaaccgggtaccgtaattaacgtttacgtggttacggtaagggaaaacggtcgggttaggggggaacggggttacgggggggtaaaccgttacgggttaccggggggaccccgtaaaaccgggggtaacccccgttcgggtacccgtaacccggtttccgtaccccgttacgaacccggtccccgttaaccccggaaacccgggtaacccggggtacccccttaaaccgggtttcccccgggtttaccccccgttttacccccccgggttacccggtacccccttaacccccccgtttaccccgtaaccccgtaaaacgggtacccgtaccccgtaaccccggttttcccggggtaacccggggggtacccaacccgtaaccggggtccccgggtccccgggtttacccggggtcccgtttacccgggtaccccgggttacggggttaacccgggtaaacccgggttacccctttaaccccgttttacccgtaaccgtttaccctaacccgttaacccgttaacggtacgggaaccgggtccggggtacgtaccgggaaccgggtaacggccggtaactacgttgntaacg

SEQ ID NO: 223076 - DNA, 425 bp, Homo sapiens
  misc_feature: GYAE6OF01E2UDP.37.25.C03.1.454.CMB.1.raw
  modified_base (292)..(292): a, c, t, g, unknown or other
  misc_feature (292)..(292): n is a, c, g, or t
  modified_base (390)..(390): a, c, t, g, unknown or other
  misc_feature (390)..(390): n is a, c, g, or t
  modified_base (398)..(425): a, c, t, g, unknown or other
  misc_feature (398)..(425): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatacttactgtgtgaaaggctgggggagtggggggactacgtggggccagggaaccctggtcaccgtctcctcacgcctccaccacgggcccactccggtccttccccctggccaccctcctccgaagngccaaccctcgtggggggccacgagccggcccgtgggcctggtcctgggtacaagggcctacttccatctacactactgagcgggctggcgaaggccncagtacgnnnnnnnnnnnnnnnnnnnnnnnnnnnn

SEQ ID NO: 223077 - DNA, 637 bp, Homo sapiens
  misc_feature: GYAE6OF01EI21G.37.25.C03.1.454.CMB.1.raw
  modified_base (220)..(220): a, c, t, g, unknown or other
  misc_feature (220)..(220): n is a, c, g, or t
  modified_base (388)..(388): a, c, t, g, unknown or other
  misc_feature (388)..(388): n is a, c, g, or t
  modified_base (557)..(557): a, c, t, g, unknown or other
  misc_feature (557)..(557): n is a, c, g, or t
tcagtagtgtagatcacgaccggtgctcgatttagtagtgtagatttgggtttggggcgtgagctggctttttcttgtggcttattttaaaaggtttccagtgtgaggtgcagttgttggagtctgggggagcctggtgcaggccgtgggggtccctgagactctcctgtgcagcctctggtattaatgtttagcaactcgtggcatgaacgtgggtccncgaggctcaggcagtggggctgcaggttcggtctacgaagtactagtgccttccgttaggtaataggagccaagacctacgcagaccttccggtggaacggggccgttcaccacgtcctaccgagagactaattccaaagaacacgctctatcagacaaaatgaaacngcctagaagcgaccgaagacacggtctatattacgtggtgtagaaggcggtagggagtagggggactacggtgggaccgacgggtaccgtggtaccgaccgttcctcctcgaccgtccctaccgaaccgaacggccctacgtcccggttaccctttccccgcgtacccncccctaccgtaccgaacggacgacctacccggtcgggtacgggcctaccggcggtcccggtacccggtgggccgtcccgg

SEQ ID NO: 223078 - DNA, 961 bp, Homo sapiens
  misc_feature: GYAE6OF01A212W.37.25.C03.1.454.CMB.1.raw
  modified_base (105)..(105): a, c, t, g, unknown or other
  misc_feature (105)..(105): n is a, c, g, or t
tcagtagtgtagatcacgaccggtgctcgatttagtagtgtagatttgggtttgggggagcctggtgcagcctggggggtccctgagactctcctgtgcagcctntggattaatgtttagcaactctggcatgaactgggtccgccaggctcgaggcagtgggctgctagtgggtctacgaagtactaggtcgccttccgtaggtaaatacggacgcacgacctaacggctaacggaccgttccggtaggaaaccgggggtcccgtttacaaccctatcccgtaccgaaaggtaacgaacctaacttacccgaaaaggaaccctaaccggcctttaccttaacttcccgttaggaaccctaaaagttccgaaaaccgtaccggtacccgttagggaaaccggacggaaccccggaaacggaaccgaacccgggttacccgtttaaagttaacctttacggttaggttaagggtaacgggtaaaacgggttcggggtaacggggggtaacgggggttacggggggtaacccgtacggggttaccggggggacccggtaaaccggggttaccccggttacgggttaaccccggtacccgtttaccccgtccccgtaggtaccccgtacccccgttaaccccgaaacccgggtaacccgggtacccctttaccgggttaccccggtttcccccgttaacccccgggttcccggaccccttaccccgttacccggtaacccaacgggtacccgtaccccgttacccgtaccggggtacccgggaccgtaaccgggtacccgggcccgggtccccggtcgggtccgttaccgggtccgttacggggtaaccgtaaccgggtaccctttaccgtccgtaaacttacccgaacccgttaaccgtcggtacgggtaccgggcggtaccggtagggaccccgtaacgggacccgtatacggtagctacgg

SEQ ID NO: 223079 - DNA, 671 bp, Homo sapiens
  misc_feature: GYAE6OF01DLQM5.37.25.C03.1.454.CMB.1.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (635)..(636): a, c, t, g, unknown or other
  misc_feature (635)..(636): n is a, c, g, or t
  modified_base (638)..(641): a, c, t, g, unknown or other
  misc_feature (638)..(641): n is a, c, g, or t
  modified_base (643)..(643): a, c, t, g, unknown or other
  misc_feature (643)..(643): n is a, c, g, or t
  modified_base (645)..(646): a, c, t, g, unknown or other
  misc_feature (645)..(646): n is a, c, g, or t
  modified_base (648)..(648): a, c, t, g, unknown or other
  misc_feature (648)..(648): n is a, c, g, or t
  modified_base (650)..(653): a, c, t, g, unknown or other
  misc_feature (650)..(653): n is a, c, g, or t
  modified_base (655)..(657): a, c, t, g, unknown or other
  misc_feature (655)..(657): n is a, c, g, or t
  modified_base (659)..(662): a, c, t, g, unknown or other
  misc_feature (659)..(662): n is a, c, g, or t
  modified_base (664)..(666): a, c, t, g, unknown or other
  misc_feature (664)..(666): n is a, c, g, or t
  modified_base (668)..(669): a, c, t, g, unknown or other
  misc_feature (668)..(669): n is a, c, g, or t
  modified_base (671)..(671): a, c, t, g, unknown or other
  misc_feature (671)..(671): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgagggtccgttcacatctcaganacaatccaaagaacacgctctatctgacaaatgaacngccgtgaagacgaccgaaagaccacggccgtaatacttcgtgtagtaggaaaggcggtggggaggtacgggggtaacctacgggtcggggaccgaaccgggtaacccgtcggtccaccggtcctccgtacgaccgccctaccgaaccggaaccggccccgtaacgttccccgttacccgtttccccccgcggaccccctacccctacccgtaaccgaaacgccgaccccttacccgtacgggtccggggaccaaccgtacggtccccgggacccgttcgggtcctaccgggtccggttaacgggtacggaaaccggttaaccttacccggttccctaataacccgttaccgtaaccgtttacgggacgaaccgggtttccgggcgttaacggggaccgtaacgggtccctaagtacgaggacnncnnnngnannanannnngnnncnnnncnnncnngn

SEQ ID NO: 223080 - DNA, 651 bp, Homo sapiens
  misc_feature: GYAE6OF01BGLFT.37.25.C03.1.454.CMB.1.raw
  modified_base (291)..(291): a, c, t, g, unknown or other
  misc_feature (291)..(291): n is a, c, g, or t
  modified_base (648)..(648): a, c, t, g, unknown or other
  misc_feature (648)..(648): n is a, c, g, or t
tcagtagtgtagatcacgaccggtgctcgatttagtagtgtagatttgggtttgggggaggcctggtgcagcctgggggggtccctgagactctcctgtgcagcctctggattaatgtttagcaactctggcatgaactgggtccgccaggctccaggcatggggctacagtgggtctcaagtactagtgctctggtaatagagcagactacgcagactcgtgaaggccgttcaccatctccagagacaattccaagaacacgctctatctgcaaaatgaacagcctgganaggccgaagacacggccgtaatattaactgtgtagaaaggctaggggtatggggtacggacttacgggtacgggacgaaccgggtaaccgtcggtaccgtaccgtccctacctacgaccgtccctacccaaccgggaaccggacctacggtcccgtttccccttacccccggtcgtaccctaccccgttcccaaccgaacgacgaccctaccggtcgggtccgggtaacaacgccgggacccggtccgggacggtccgtccggtccgttcggaacgtaacgtaccgtaccgtacctacttaccgtaacctaaccgttacgagaccgggcggtacggtcggacgacggacgactatgnacg

SEQ ID NO: 223081 - DNA, 751 bp, Homo sapiens
  misc_feature: GYAE6OF01DE9U9.37.25.C03.1.454.CMB.1.raw
  modified_base (145)..(145): a, c, t, g, unknown or other
  misc_feature (145)..(145): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (719)..(719): a, c, t, g, unknown or other
  misc_feature (719)..(719): n is a, c, g, or t
  modified_base (722)..(724): a, c, t, g, unknown or other
  misc_feature (722)..(724): n is a, c, g, or t
  modified_base (726)..(737): a, c, t, g, unknown or other
  misc_feature (726)..(737): n is a, c, g, or t
  modified_base (739)..(751): a, c, t, g, unknown or other
  misc_feature (739)..(751): n is a, c, g, or t
tcagtagtgtagatcacgaccggtgctcgatttagtagtgtagatttgggtttgggctcaactctcttgtccgccaggctccaggcagtggggctggcagtgggtctcaagtactagtgctcgtaggtaaatgagcagactacgnagactcggtaggaacgggtccgtacaccatccncgaaganaccttaaactaccaaagaaaccngtccttactagtacagaacaaaagtcgaaacagcctaggaaacgacgaccgaaagaccgtacggtaccgtaattacgttacgtggtacggtaaggaaagggtcgggtagggggtacgggtaggggggtaaaccttaaccggggcggggggaacccaacgggggtaaccccgttcggaccccgtaacccttcggtaccctacgaaccgttccccgaaacccgaacccggaacggggcccctaacggtccccggttttcccctacccccggtcggaaaccccctacccccgttaccaaccggaacgtacccgaccctacccgggttcggggacggggaacccctaacggtccggtcccggggccctttcgggggaccttcggtaacccgggtagtaaacccgggtaaccggtaccctttacccgactaaccttacctaaaccccggaacgtttacggacggggaaccgggttccgggggaacgacgggaaaccggaacggcgaaaccgttagngcnnngnnnnnnnnnnnngnnnnnnnnnnnnn

SEQ ID NO: 223082 - DNA, 641 bp, Homo sapiens
  misc_feature: GYAE6OF01DRFFP.37.25.C03.1.454.CMB.1.raw
  modified_base (127)..(127): a, c, t, g, unknown or other
  misc_feature (127)..(127): n is a, c, g, or t
  modified_base (142)..(142): a, c, t, g, unknown or other
  misc_feature (142)..(142): n is a, c, g, or t
  modified_base (214)..(214): a, c, t, g, unknown or other
  misc_feature (214)..(214): n is a, c, g, or t
  modified_base (517)..(517): a, c, t, g, unknown or other
  misc_feature (517)..(517): n is a, c, g, or t
  modified_base (606)..(606): a, c, t, g, unknown or other
  misc_feature (606)..(606): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactcnggcatgaactggccncaggctcaggcagtggggctgcagtggtctacaagtctagtgcttcgtaggtaatacggagcagactacggnacgactccgtaggaacgggtccttacactatcctccaagacgactaattaccaaagaaccaacgtctactactctagactaatcgaacacgtcctaggaagacggaccgaaacgacgaccggtaccttataacttacgtaggtgtacggaaggcggtagggtaggacggggtactacgggtcgggacgacggaccgttggacctaccgtctcccgacgacgtccgtaccgaccgaccggccctacggttcccggttcccgttcccccgtggcccctaccccgtccgtaaccgacgacgtaccnccgtcgggtcggacgcgaaccggccggtccgaggccgtcgtcgtcggacaggtacctacgtctacgtcctacgtacgtcgtagaccggnggtaccgtacggagtacccggngaacncgtgntcg

SEQ ID NO: 223083 - DNA, 177 bp, Homo sapiens
  misc_feature: GYAE6OF01D6329.37.25.C03.1.454.CMB.1.raw
  modified_base (174)..(177): a, c, t, g, unknown or other
  misc_feature (174)..(177): n is a, c, g, or t
tcagtagtgtagatcacgaccggtgctcgatttagtagtgtagatttgggtttgggggaagaggaagactgacggtccccccaggagttcaggtgctgggcacagcggccctgggctgcctggtcaaggactacttccatctacactactgagcgggctggcaaggcgcatagnnnn

SEQ ID NO: 223084 - DNA, 973 bp, Homo sapiens
  misc_feature: GYAE6OF01CF66W.37.25.C03.1.454.CMB.1.raw
  modified_base (130)..(130): a, c, t, g, unknown or other
  misc_feature (130)..(130): n is a, c, g, or t
  modified_base (142)..(142): a, c, t, g, unknown or other
  misc_feature (142)..(142): n is a, c, g, or t
  modified_base (366)..(366): a, c, t, g, unknown or other
  misc_feature (366)..(366): n is a, c, g, or t
  modified_base (969)..(969): a, c, t, g, unknown or other
  misc_feature (969)..(969): n is a, c, g, or t
tcagtagtgtagatcacgaccggtgctcgatttagtagtgtagatttggggtttgggggaggcctggtgcagccgtggggggtccctgagactctcctgtgcagccttcgtggtaatttaattggtttanacaaaccttcgnggctagtaggtaacgtcggggtcccgccgaaggtcctccgaggtactaggtcgggggtctggacgtaggtcgggttctacgtaaaggtacgtagtcgtccttacgtaggtaatagacgactagacctacggacgacgtccgttacggtaggaacggtcccgttacacctagtccacgaacggactaaactaacgtacccgaaaggtaaccgtaccgtacctttntaacgttacgtaccgaataaaagtcgaaaacgtccggtacctaaaggggaaccggaccggtaaaccggaaaccggtaaaccgtacccggggttaccttttaagtaaaccgttttagtacgggtagggtaaacgggaaacgggttcgggtaaggggggttacgggtaccggggtaaccgtaccggggtacgggacccggtaaaccgggtcccgtccggttaccgtaacccgtcgtcccgtagtaccccggaccctaacccggacggtaacccggccgttaccgtcccggttccccctaccccggacccgtcccctacccgtacgtacccggacgtacccgaccccgttaacgggtccggtcccggggaaaccgtacccggtaccggggtcccccgggttcccggtacccgggttaccgttaccccgggttacccgggtttaaccgggttaaaacccggtaaccccgggttttaaccctttaccccgtaccccgtttacccgttaaaccggttaaccccgtaccgggtttacccggtacggggaaccccgggtacgggttacccgttaacgggaccggaaccggttacgaacccggttgaaccgngacg

SEQ ID NO: 223085 - DNA, 712 bp, Homo sapiens
  misc_feature: GYAE6OF01ENXXE.37.25.C03.1.454.CMB.1.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcaggtgggtctcaagtactagtgctcctggtaatagagcagactacgnacgactccgtaggaacgggtccgttacaccatcnccagacgacaattccaaagacacgctctatctgacaaatgaacagtcctagaagacggaccggaaagaccgacccggtacccttnttaacgtttaacgtggttcgacggtaagagtacttacgaaggtaaccggagttaacgtacgacgacgacgaacgcttacgtacggtaccgtaacgggtccggggaccctaaacccgggtacccgtgggtaccctaccggtcctttacccgaccaccgtacccctacccgaaaccgtaacccgggacccttaacgtcccggtttccccttacccccggcgtaccccctaacccgttacccgtacccgaaacgtcccgaaccgtacccgtcggggtacgggccctaacgccgggtccgacccggttcggtccgtcggtccgtacggtacgtaaccggtaccttaccgtcctattacccaactcgtagcggtaacccggg

SEQ ID NO: 223086 - DNA, 849 bp, Homo sapiens
  misc_feature: GYAE6OF01EAKR9.37.25.C03.1.454.CMB.1.raw
  modified_base (845)..(845): a, c, t, g, unknown or other
  misc_feature (845)..(845): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgaggcagtggggctgcgtaggtgggtctacaagtactagtgcttccgtaggtaaatagagcagactacgcaagacctccggtaggaacgggtccgttacacctatcctaccgagaacgaactaacttaccaaagaaccacgtcctactactcgtgactaaatacgaacacgccgtagaacggacggaccgaaacggaccgaaccgggtaccgtaattaactttacgtggttaggtaaggaaaacgggtccgggttaggggggtaacgggttacggggggtaaaccgttacggggtaccgggggacccggtaaaccggggtaaccccgttcgggtaccgtacccgttccctacccgttaccgaccgtcccctacccgaacccgggaacggtaccctaccggttcccggtttcccccgttacccccgttcccgggacccctacccccttaccccgtaacccgaacggtacccgtacccgtacccggttccggggtaccggggtacccaaccgggtaacccgggcccgggtccccggttacggggtcccttcccgggttaccggttaccgggttaacccgaaccgggttaaccctttacccgttacctaccgtttaccgtaacccgtaacctacgggtacggaccgggtccgggtaccggtacggtaacccggaacgggtccgaattacggtgngacg

SEQ ID NO: 223087 - DNA, 827 bp, Homo sapiens
  misc_feature: GYAE6OF01DGE3X.37.25.C03.1.454.CMB.1.raw
  modified_base (107)..(107): a, c, t, g, unknown or other
  misc_feature (107)..(107): n is a, c, g, or t
  modified_base (184)..(184): a, c, t, g, unknown or other
  misc_feature (184)..(184): n is a, c, g, or t
  modified_base (800)..(800): a, c, t, g, unknown or other
  misc_feature (800)..(800): n is a, c, g, or t
  modified_base (825)..(825): a, c, t, g, unknown or other
  misc_feature (825)..(825): n is a, c, g, or t
tcagtagtgtagatcacgaccggtgctcgatttagtagtgtagatttgggtttgggggaggcctggtgcagccgtggggggtccctgagactctcctgtgcagcctntggattaatgttagcaactcgtggcatgaacgtgggtccgcaggctccgaggcaggtggggctgcgaggtggtctanaagtactagtgcctcgtaggtaaataggacgacgagacctacggacaacgtacgtccgtaggaacgggtccgttacaacctatccgtacgaagaacgtacaacttaccgaaagaacaccgtctactactcctagaactaaacgtgaaaccgtcggacgagaacgacggaaccgaacgtaaccgtaccgggtactttaacgttaattcggtttaggaggttaaaggaaacgggtcgggtaaggggtaggggtaccggggtaacgttaccgggtacgggggaaccgaaaccggggttcccctacgggttaccgaaccccgtttcggaacccttaccggacctaccccgtaacccggaaacccgggtaaccggtccccgttaacggttcccccggtttcccccttaccccccggacggttaccccttaacccccgtaccgtaaccgaaccggtccgacccgttaacccgggtcgggaccggggacctacggaccgggcccgggtcccgtacgggtccgtaccgttaccggtaccgttaaacggtaacccgttaccgtttaccgtaacccttagtaccccgtaaagtacccgttcggggacggaccgggtccggtacggnggtaacccgcgggaacagtagtcgntg

SEQ ID NO: 223088 - DNA, 759 bp, Homo sapiens
  misc_feature: GYAE6OF01DC4TX.37.25.C03.1.454.CMB.1.raw
  modified_base (370)..(370): a, c, t, g, unknown or other
  misc_feature (370)..(370): n is a, c, g, or t
  modified_base (754)..(754): a, c, t, g, unknown or other
  misc_feature (754)..(754): n is a, c, g, or t
tcagtagtgtagatcacgaccggtgctcgatttagtagtgtagatttgggtttgggggaggcctggtgcagccctggggggtccctgagactctcctgtgcagcctctggattaatgtttagcaactctggcatgaactgggtccgccaggctccaggcagtggggctgcaggtgggtctacgaagtactagtgtcttccgtaggtaatagagcagacctacgcagacctccggtaggaagggtccgttaccaccatcctcaagacgactaattaccaagaacacgctactaactctagacaaatagaacacgtcctagacgacggaccgaacgacgaccggacgtatattacgtgtacgaggaaacggnggtaggggtaaggtcgggggaacgtacgggtacggggacccgtaacgggtaaacccgtcgggtaccgtaacccgttccttcccgtaccgtaccgtcccctaacccgaacccgaaaccgggtacccgtaaccggtttcccggttccccgtttaccccccggtaccggtccccgtaacccccggtacccttaacccggaacgtaaccgtacccgacccgttccggggtaccggggtccgaaccggaccgggtacccgggtacccggtcgggtacccgtcggtcccgtaccggtaccgtaacggtacccttaccttaccgtactaaccctacctaacgtactacgggtacggccgggacggtacggacgtaacgggaccaggtaacngctag

SEQ ID NO: 223089 - DNA, 689 bp, Homo sapiens
  misc_feature: GYAE6OF01B2S4Y.37.25.C03.1.454.CMB.1.raw
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
tcagtagtgtagatcacgaccggtgctcgatttagtagtgtagatttggggtttgggggaggcctggtgcagcctgggggggtccctgagactctcctgtgcagcctctggattaatgtttagcaactctggcatgaactgggtccgccaggctccgaggcagtggggctgcagtgggtctcaagtactagtgcctccgtggtaatagagcagacctacgcaacgtaccgtccggtaggaacggggtccggttacccaacctatacctccgaagacgaacctaacgttacccaaaacgaaacctaccgcctacttactcgtgaacctaaaatcgaaacacgcctgacgacggaccgaagacgaccggtccgttattacttacgtggtagtaaggaaggtcgggtaggggaggtacgggggactacgggcggggaccggaacgggtacccgtggtaccncccgtcgtccncaccgccacccgaccgaaccggccctacgttcccgttccccgttccccgtcgccctacccgttccgacctacggccgtcccgaccgtcgggcgggacaccggtcggacccggtccgtcgggcctcgccggtaggtacgaacggtacctaccttaccgtactacctaccgtacgtcggacggtacggtccgggacgtcggacgacgggtacatacgngngc

SEQ ID NO: 223090 - DNA, 724 bp, Homo sapiens
  misc_feature: GYAE6OF01CFC1M.37.25.C03.1.454.CMB.1.raw
  modified_base (149)..(149): a, c, t, g, unknown or other
  misc_feature (149)..(149): n is a, c, g, or t
  modified_base (561)..(561): a, c, t, g, unknown or other
  misc_feature (561)..(561): n is a, c, g, or t
  modified_base (687)..(687): a, c, t, g, unknown or other
  misc_feature (687)..(687): n is a, c, g, or t
  modified_base (720)..(720): a, c, t, g, unknown or other
  misc_feature (720)..(720): n is a, c, g, or t
tcagtagtgtagatcacgaccggtgctcgatttagtagtgtagatttgggtttgggggaggcctggtgcagcctggggggtccctgagactctcctgtgcagcctctggattaattgtttagcaactctggcatgaacgtggggtcccnccagggctccgaggcagtggggctgcaggtgggtctacaagtctagtgcttccgtaggtaaatagagcagacctacgcagaccttccggtggaacgggtccgttacaccatcctaccagagaacctaacttaccaaagtaaccaccgtctctaactctagaacctaaatacggaacacgtccgtaggaacggaccggaccggaaaggacccgaccgggtaccttaatatttacgtggtaggtaggaaagggtcggtgggggtagggtgggggtacctacgggtacgggggacccgtaacggggtaccccgttcggtacccgtaccgtcccgtccctacgacccggtcccgtacccgaaccggaacccgggtcccttaccgttcccggttccccgttcccccgcggtaccccnccccttacccgacccgaacgaccgcccgtaacccgtccgggtacgggacccaccggtccgggcccggcccggtcgggtccgtcccggcgtacggtacgaacggtaccttccgtccactcctaaccncgtacgcggcggtcggcgtcgacgggacgcagntcgc

SEQ ID NO: 223091 - DNA, 190 bp, Homo sapiens
  misc_feature: GYAE6OF01D3X1X.37.25.C03.1.454.CMB.1.raw
  modified_base (173)..(190): a, c, t, g, unknown or other
  misc_feature (173)..(190): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnnnnnnnnnnnnnnnnnn

SEQ ID NO: 223092 - DNA, 650 bp, Homo sapiens
  misc_feature: GYAE6OF01B1JPQ.37.25.C03.1.454.CMB.1.raw
  modified_base (610)..(610): a, c, t, g, unknown or other
  misc_feature (610)..(610): n is a, c, g, or t
  modified_base (619)..(619): a, c, t, g, unknown or other
  misc_feature (619)..(619): n is a, c, g, or t
  modified_base (627)..(627): a, c, t, g, unknown or other
  misc_feature (627)..(627): n is a, c, g, or t
  modified_base (631)..(633): a, c, t, g, unknown or other
  misc_feature (631)..(633): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (645)..(648): a, c, t, g, unknown or other
  misc_feature (645)..(648): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcacatctcagagacaattccaagaacacgctctatctagcaaatgaacagcctgagagccgaagacgaccgtcgtaatattactgtgtgaaaggcgtggggagtgggggactacgtggggccgagggaacctggtccaccgtctcctcacgtcctacccgaccgaacggccctaagtcccggttcccttacccccgtggacccctaccccttacccgtacccgaacggacgcctaccgttccggtacgggggcccacgaccgggcccggtcccgtacggggcctcggcccgttgggtaaccgaaacgggtccctttaaccgttacccgtaatttacccgtaaccgtaaccgttaacgtcgggtaacccggggtaccgggtacccggttaacggggaccgtaaaccggggtccgtaactacggtttaacgcggactcggattccgaantcacgacgncgcgcacncgcnnncacncncncnannnncg

SEQ ID NO: 223093 - DNA, 682 bp, Homo sapiens
  misc_feature: GYAE6OF01APIC0.37.25.C03.1.454.CMB.1.raw
  modified_base (106)..(106): a, c, t, g, unknown or other
  misc_feature (106)..(106): n is a, c, g, or t
  modified_base (127)..(127): a, c, t, g, unknown or other
  misc_feature (127)..(127): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (448)..(448): a, c, t, g, unknown or other
  misc_feature (448)..(448): n is a, c, g, or t
  modified_base (480)..(480): a, c, t, g, unknown or other
  misc_feature (480)..(480): n is a, c, g, or t
tcagtagtgtagatcacgaccggtgctcgatttagtagtgtagatttgggtttgggggaggcctggtgcagcctggggggtccctgagactctcctgtgcagcctntggattaatgtttagcaactntggcatgaactgggtccgccaggctcgagcagtggggctgcaggtggtctagagtactagtgctcgtaggtaatagngctagactaggcagtacgttccgaggacggtccgttacaccnttccncgagacgaatacttaccgaaacgacctaccgtgttcctcgtcgactaaatacgaaacctaaccgtacggaggaacgccggaaacggtaccgaaccgtaccctaagtttaacgttaccgtaacgtaacgaaaacggttcgaaccgtagactatacgacgttactaaggtgacgtgttaactcgatccgtcgcgggtcncgtacgtacgtgtactacgtctaccgtacctntcccggtcctacccgtaacggtacccgccgttaccgtccggtacccgttccccgtgcccgtccgtacgtcctaccgaaggcgtcccaccggtaccgaggtacgaccctacgggccgtaccgggcccgttagggcgtttcccgggagttcggtaaccggttactacccgttaactccgtaacgtacttacgagttcgaccggg

SEQ ID NO: 223094 - DNA, 622 bp, Homo sapiens
  misc_feature: GYAE6OF01EYJGX.37.25.C03.1.454.CMB.1.raw
  modified_base (421)..(421): a, c, t, g, unknown or other
  misc_feature (421)..(421): n is a, c, g, or t
  modified_base (592)..(595): a, c, t, g, unknown or other
  misc_feature (592)..(595): n is a, c, g, or t
  modified_base (597)..(608): a, c, t, g, unknown or other
  misc_feature (597)..(608): n is a, c, g, or t
  modified_base (610)..(622): a, c, t, g, unknown or other
  misc_feature (610)..(622): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtggaagggccggttcaccatctccagagacaattccaaagaacacgctctatctgacaaaatgaacagcctgagacgaccgaaagaccgacggccgttatattactggtagtagaaaggcgtaggggaggtgggggactacggtggggccgaacgggaaccccgtggtccgtacccgttctccgtcgacgccctacccgaaccggaacggccctacgttcccggttccctttcccccgtcgcccaccccgtaccctaccgaaacggaccncctacccgtcgggtcggggaccaccggacggtcccgggcccgtgggtcctacggtcccggttagggtaccgtaaacggtaccctttaacctccgtaacttaccctaactaaccgttacgtcggaccgggtccgggtacgtacgggaacgaacgggtccgaacgtaacgtgnnnngnnnnnnnnnnnncnnnnnnnnnnnnn

SEQ ID NO: 223095 - DNA, 900 bp, Homo sapiens
  misc_feature: GYAE6OF01CLAXM.37.25.C03.1.454.CMB.1.raw
tcagtagtgtagatcacgaccggtgctcgatttagtagtgtagatttgggtttgggggaggcctggtgcagccgtggggggtccctgagactctcctgtgcagcctgtggattaatgtttagcaactctggcatagaacgtcggggtccgccgaggtcctaccgaggtcaggtggggcctgcgtaggttgggtctacgaagttacgtagtcgccttccgtaggtaaacgaggacgacgaagtacctacgactacggtaccttaccggtagggaaccgggtcccggttacacctattccaccgaagacgtaacctaacgttaaccgaaacgaaccaccgtcttacgtacgttccgtaaggaacctaaaagtacgaaccgaacggtcccggtaggaacggaaccggaaccggaaacggtacccggtaaccgggtacgtttaaatttacgtttaaacggttcgggttaagggtaacggaaacggggtcggggtaacgggggtacggggtacggggtaaccgtaacgggtaccggggaacccgtaacgggtacccgtacgtcccgtacccgtaccttacccgtaccggtaccgtacccgtacccggaaccggtacccgggtacccgttacccgttcccggttacccccttaccccccgggacgtaaccccgtaccccgttcccgtaaacggaccggaccgtaccccggtaccggtcccggggtacggaccgtaacccggccgggtaccccggtccggtaccgggtccttaccgggtcccgttaacgggacctaaccggttacttacccccgttagtacccgttcctaaacccgttacggtaccggtacggggaccggttccgggtaccggacggtaacggaccggtacgacggtatcggctagg

SEQ ID NO: 223096 - DNA, 734 bp, Homo sapiens
  misc_feature: GYAE6OF01C7H6T.37.25.C03.1.454.CMB.1.raw
  modified_base (728)..(728): a, c, t, g, unknown or other
  misc_feature (728)..(728): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcagtggggctgcagtgggtctcaagtactagtgctcctaggtaatagagcagactacgcagactccgtggaagggccgttcaccatctcagagacaattaccaagaacacgctactatctagacaaatgaacacgcctaggacgacgaccgaagaccgacggtcctatacttactgtagtagaaggtcgtggggaagtggggactacggtacggggaccgaacgggtaacccgttcggacctacccggtcctacccgtacgacggtaccctaccgaaccggaaccgggtcccctaacggttccccggttcccgttccccccgtcgggtacccctaaccccttccgtaaccgtaacggaccgtccctaacccggtccgggtaccgggggaaccaccggaccgggtacccggtcccgggtcgggtcccgttaccggtcccggttacggtaacccgtaaacgggtacccttaccgtttaaccccgtaacttacccggttaacctacccgttaaccggtagggaaccgggtccgggtaccggtacgggaacccgtaacggggacctaccgtaagngcgacg

SEQ ID NO: 223097 - DNA, 771 bp, Homo sapiens
  misc_feature: GYAE6OF01BRTW9.37.25.C03.1.454.CMB.1.raw
  modified_base (259)..(259): a, c, t, g, unknown or other
  misc_feature (259)..(259): n is a, c, g, or t
  modified_base (399)..(399): a, c, t, g, unknown or other
  misc_feature (399)..(399): n is a, c, g, or t
  modified_base (767)..(767): a, c, t, g, unknown or other
  misc_feature (767)..(767): n is a, c, g, or t
tcagtagtgtagatcacgaccggtgctcgatttagtagtgtagatttgggtttgggggagcctggtgcagccgtggggggtccctgagactctcctgtgcagcctctggattaatgtttagctaactctggcatgaacgtcgggtccgccaggctccaggcagtgggctgcaggtcggtctataagtatagtcgcttcgtaggtaatagagcaagtactacgcaacgtactccgggtagaacgggtcccgtacaacctntccgtacgagacgtactaacgttaccaaacgaaccacgtccttacgtattcgtacgaactaaacgtacgaacctaagtcccgtagaaccggaacgtaaccgaaacgtaccgaaccggtaccgttaagttactttaaccgngttaggtaacggaaagggtcggtaaggggacggttacggggaaccgttacggggacgggtaccgaaacggggtaccccttgggtaccctaccggttctacccggtacgacccgtcccgtaacccggaaccgtaacccgggtcccttaaccggttcccggttacccccttacccggtaccggaccccctaccgttaccctaacggactaaccgccgtaacgtcggtacgggtacccaacggcggtacccgtccggtcggtacgtcccgggtacgtacggtaacgtaaccgtccgttaactccgtactaccgtaactccggtacgtagggtccggccgggttacacggtaaacgccggtaacagagtcgngtcg

SEQ ID NO: 223098 - DNA, 683 bp, Homo sapiens
  misc_feature: GYAE6OF01BE1TC.37.25.C03.1.454.CMB.1.raw
  modified_base (679)..(679): a, c, t, g, unknown or other
  misc_feature (679)..(679): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctctggtaatagagcagactacgcagactcgtgaacgggccgttcaccatctccgagagacaattaccaagaacacgctctatctgacaaatgaacagcctgagacgccgaagaccgcggacctatattactgtgtagaaaggcgtgggaggtgggggaactacggtcggggaccgaaggggaaccctgggtacctacccgtacctcccgtcgaaccgtccctacccgaaccgtaacgggccctacggttccgttcccttcccccgtcgaccctaccctacccgacccgtaacgacgtaccctaccgtccgggtacggggaccaaccgaccgggccggtaccccggtgggtaccgtccggtacccggttacgggtaacgtaaccgggtaccctttaaccgttaccgtaacttaccgtaaaccttaccgtaacgttacgggaccgggtccggggaccgttaggaccggtaacgggacgagtaacgttacgngacg

SEQ ID NO: 223099 - DNA, 185 bp, Homo sapiens
  misc_feature: GYAE6OF01DFEOJ.37.25.C03.1.454.CMB.1.raw
  modified_base (169)..(185): a, c, t, g, unknown or other
  misc_feature (169)..(185): n is a, c, g, or t
tcagtagtgtagatcacgaccggtgctcgatttagtagtgtagatttgggtttgggggaagaggaagactgacggtcccccaggagttcaggtgctggcacagcggccctggctgcctggtcaaggctactccatctacactactgagcgggctggcaaggcgcatagnnnnnnnnnnnnnnnnn

SEQ ID NO: 223100 - DNA, 737 bp, Homo sapiens
  misc_feature: GYAE6OF01AK1XF.37.25.C03.1.454.CMB.1.raw
  modified_base (695)..(695): a, c, t, g, unknown or other
  misc_feature (695)..(695): n is a, c, g, or t
  modified_base (697)..(697): a, c, t, g, unknown or other
  misc_feature (697)..(697): n is a, c, g, or t
  modified_base (703)..(703): a, c, t, g, unknown or other
  misc_feature (703)..(703): n is a, c, g, or t
  modified_base (706)..(706): a, c, t, g, unknown or other
  misc_feature (706)..(706): n is a, c, g, or t
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (730)..(730): a, c, t, g, unknown or other
  misc_feature (730)..(730): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
tcagtagtgtagatcacgaccggtgctcgatttagtagtgtagattttgggtttgggctcaactctcttgtccgccaggctccaggcatggggctgcagtgggtctcaagtactagtgctcctggtaatagagcagactacgcagactccgtgaagggccgttcacatctccagagacaattccaaagaaccacgctctatctagacaaatgaacagcctgagacgaccgaaagaccacggccgttatactttacgtggtaggtaggaaaggcgtagggggaggtaggggggaacttacggtcgggggaccgtaacggggtaaccccgtcgggttaccctaccccggttccgtcccgtcgaccggtccccgtacccgaacccggaaccgggtcccctaacggttcccggttccccgttcccccgtacggccccctaaccccgtccctaccgaaacgacgtacccgaccgttccgggtacggggaccaaccggccgggaccccgggttacccggttcggggcccttccgggtacccgttacgggtaaccggtaacgggttaaccctttaccctttccgtaaccttaacccgttaacccgaaccttaaccgggacgggtaaccgggtccggggtacccggtacgggacccgggtaaacgggcccggtaagtaacgtacgcgtagacgcgtagcgtancnacgcgngcnagagcnacncncgcagcgactacnctgngng

SEQ ID NO: 223101 - DNA, 851 bp, Homo sapiens
  misc_feature: GYAE6OF01C80PD.37.25.C03.1.454.CMB.1.raw
  modified_base (162)..(162): a, c, t, g, unknown or other
  misc_feature (162)..(162): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
tcagtagtgtagatcacgaccggtgctcgatttagtagtgtagatttgggtttgggctgagctggtctttttcttgtggctattttaaaggttccagtgtgaggtgcagttgttggagtcgtggggagcctggtagcagcgtgggggccctgagactctccngtgcagcctcaggtattaatgttancaactntggacatcgactcgggtccncgacgctcgagcagtgggcctagccaggtcgggtacacgtaacgtactaggtcacgttccggtagttaagtagaacgcgtaacgacgtaccgcgacgtacgtccggtacggaacgggttccgttaccacaccgttaccgacgaagacgtaaactacgttaaccgaaacgaacctaccggcttaacgtacttcgtaacgaaaccgtaaaggtacgaaaccgttcggacttaacggaacggaacgtaaccgggacgtaaccccggaacgggtaacccttaagtttaccgttacgttacggtaacggtaacgggtaacggtcggggtaaacggggttaacggggtacgggggttaaaaccgtcgggggttaaccgggaacccgggtaaaccgggggtaacccgttaccgggtcccggtttaaccctacccggttaccgtaccggtaaccccggtaacccgtaacccggaacccgggtaccgggtacccttacgggtttacccgtttcccccggtaccggtcccgtaacccgtaccccggttcccgtaacggtaaccggtacctacccggtaaacccggggtccgggtaccggggaacctaccggaacccggggtccgtaaccccgggcgttcgggtacccg

SEQ ID NO: 223102 - DNA, 733 bp, Homo sapiens
  misc_feature: GYAE6OF01EVEHQ.37.25.C03.1.454.CMB.1.raw
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
tcagtagtgtagatcacgaccggtgctcgattttagtagtgtagatttgggtttgggattcacgttgcagactccgtgaagggccggttcaccatctccagagacaattccaagaacacgctctatctgcaaatgaacagcctgagagccgaagtacacggccgtatattactgtgtagaaggcgtggggatgggggactacgtggggcagggaaccctggtcaccgtctcctcgacgcctaccaccgaacggtccctagttccggtaccttcccccgtggaccctacccttacctaccgtaaacgacggtcctaaccgtcggttgggggaccaaccgaacggccggtaccccgtggggccttcggcccgttaggggttaaccaaacggggtacccttaaccgttttacccgaattacccgttaaaccgtaccgtttaacccggtacggtaacggtaccggggtaccgttagggaaccgtaaacgggcccgtaacgtaagttaaccgganaacgngtacgtacgtacgactacgtactacgtacgtagacgtacgacgacgtagtacgtcgtagtacgagttacgtactacgtacgtacgtacgtacgtacgtactacgtacgtacgtacgtacgtacgtacgtagtagtacgtacgtacgtacgacgtacgtaacgtacgtacgtacgtacgtacgtacgtacgtacgtacgacgtagtacgtcgtcgtacg

SEQ ID NO: 223103 - DNA, 493 bp, Homo sapiens
  misc_feature: GYAE6OF01EGCS4.37.25.C03.1.454.CMB.1.raw
  modified_base (458)..(461): a, c, t, g, unknown or other
  misc_feature (458)..(461): n is a, c, g, or t
  modified_base (463)..(493): a, c, t, g, unknown or other
  misc_feature (463)..(493): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgacaaatgaacagcctgagagccgaagacacggccgtaattattactgtgtagaaaggcgtggggagtgggggactacggtggggccaacgggacccgtgtccgaccgtctcctcacgcctaccaaccgaacggccctacgtccggtcccttcccccgtggaccctacccctccgtaccaaaggacgccctaccgtcggtcgggggaccacgacggcccggccggtcgggccgttcggtccgtcggtaaccgaaacggtaccttaaccgttccaacttaccctaacacgtacgtgggacggccgggtcgtggaacgaacggcgtacatagnnnnannnnnnnnnnnnnnnnnnnnnnnnnnnnnnn

SEQ ID NO: 223104 - DNA, 747 bp, Homo sapiens
  misc_feature: GYAE6OF01CKYB9.37.25.C03.1.454.CMB.1.raw
  modified_base (253)..(253): a, c, t, g, unknown or other
  misc_feature (253)..(253): n is a, c, g, or t
  modified_base (744)..(744): a, c, t, g, unknown or other
  misc_feature (744)..(744): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaacgtggggtcccgccaggcctccgaggcagtggggctgcaggtgggtctcaagtactagtgctccgtaggtaatagagcagactacgcagactcgaggaacgggccgttacaccatcnccagagacaataccaagaacacgctctatctagacaaatagaacacgcctaggacggacgaccgaaacggaccgacggtaccgttataagttacgtaggtagtaaggaaagggcgggtaggggtagggtcgggggacttacgggtaccgggggaccggaacggggtaaccccgtcggtaccgacccgttacctacccgtccgaccgtcccgtaccccgaacccgaaccgggaccctaccggttccggttaccccctttcccccgccggtaccctaccccctcccgtaaccccgaacgacccgtccgtacccgttccgggtaccgggggtacccaaccggaccgggcccgggtaccccggtcgggtccgtccggtacccggtacggtaccgtaacggtaccttacccgttacctacgttacctaacgtaaccgtaccgtagggacccggtcggggtacccggtcgggaaccgaacggggccacgtacgtcgngcg

SEQ ID NO: 223105 - DNA, 1018 bp, Homo sapiens
  misc_feature: GYAE6OF01CU9UG.37.25.C03.1.454.CMB.1.raw
  modified_base (143)..(143): a, c, t, g, unknown or other
  misc_feature (143)..(143): n is a, c, g, or t
  modified_base (981)..(981): a, c, t, g, unknown or other
  misc_feature (981)..(981): n is a, c, g, or t
tcagtagtgtagatcacgaccggtgctcgatttagtagtgtagatttgggtttgggggaggcctggtgcagcctggggggtccctgagactctcctgtgcagcctctggattaatgttagcaactctggcatgaactgggccncgaggctccagcagtgggctgcaggtggtctacgaagtacgtagtgaccttccgtaggtaaactagaggacaacggtacctacggacaacggtaaccgttacccggtagggaaaccgggggtccgtttaaccaaccgtacttacccgtaccgaaaggaaacaaccgtaaaactttaacccgaaaaaacggtaaccgtaaccggtcctttaaccttaagtttaccccgttaggaaaaccttaaaagtacggaaaacccgtaacggaccccgtttaaggaaacggttaacggggtaaccgggaaaccggtaaaccggttaaacccgggtttaaacccttttaaaagttttaaacggtttaaaacccgtttggtttacggggaaaccggtaaaaccgggttaccccttacgttaaccccggttacccctttaaaaggacggtaagtaacggtccgggtttacccgtacggtttacccgtttaggggtttaactttaaccgggaacggttaccgggtacgggggtaacccgtaaacgggtaaccccgtcggttacccgacccgtttaccctacctacgaccgtacccggtaacccgaaaccggtaaccgggcccttacccggtacccggtttcccccttcccccggtaccgggtcccacccccgtttacgacccgggttaccgaaacgggtacccgttaccccgaacccggttaccgggaacgtacccggaaccgaacgggtacccggtaccccggggtacccgggtcggggtaaacccttcccgggaacggttaaccggaacgttaaaacccgggaaccccttttaaccggttaaaccccncggtttaaaaccctaaccggttaccgttaaaccgggg

SEQ ID NO: 223106 - DNA, 863 bp, Homo sapiens
  misc_feature: GYAE6OF01DHGPH.37.25.C03.1.454.CMB.1.raw
  modified_base (379)..(379): a, c, t, g, unknown or other
  misc_feature (379)..(379): n is a, c, g, or t
  modified_base (858)..(858): a, c, t, g, unknown or other
  misc_feature (858)..(858): n is a, c, g, or t
tcagtagtgtagatcacgaccggtgctcgatttagtagtgtagatttgggtttgggggaggcctggtgcagccgtggggggtccctgagactctcctgtgcagcctctggattaattgtttagcaactctggcatgaacgtgggtccgccgaggctccgaggctaggtcgggggctggacgtaggttgggtactacgtaaggttacttaggtcgtaccgttccgtagggttaaagtagacgacgaacgaccgtacgcgaacggtaccgtccgggtagggaaccgggtcccggttaccaacctctcctacgaggaactaactaacttaccgaaacgaaccaccgtacgttactactacgtacgaactaaagtacgaaacncggtccgtaggaacggaccggaaccggaacgaccgtacggtaccttagttaacgttcgtaggtacggaaggtaagggtcgggtaggggtagggtacggggaactacggggaccggggtaccggaaccggggtaaccgtcgggtaccacccgttccctaccggtaccgtacccgtccccgttaacccggacccggtacccggtacccgttacccggtttacccgggttccccctttacccccggccggtacccctaaccccgtcctaacccggaacggaccgtacccgtaccgggtaccgggcccggggaacctacccgggaccgggtcccggttccggtacgggtccggtccgggtacggttacggtaaccgtaaccgttaccgtttaccgtaccgtaaccgttacgtaacccgtaaccggttaccggtagggtaccgggtccgggtaccggtacggacggtacggacgtactagtcgntacgg

SEQ ID NO: 223107 - DNA, 817 bp, Homo sapiens
  misc_feature: GYAE6OF01B0DR2.37.25.C03.1.454.CMB.1.raw
  modified_base (149)..(149): a, c, t, g, unknown or other
  misc_feature (149)..(149): n is a, c, g, or t
  modified_base (813)..(813): a, c, t, g, unknown or other
  misc_feature (813)..(813): n is a, c, g, or t
tcagtagtgtagatcacgaccggtgctcgatttagtagtgtagatttgggtttgggggaggcctggtgcagccgtggggggtccctgagactctcctgtgcagcctctggattaatgtttagcaactcgtggcagtgaacgtgggtccncaggctccgaggcaggtggggctgcgaggttcgggtcctacgaaagttactagtcgtccttcggtaaggtaaataggacgacaacgtaccgtacgacgacgtaccgtcggtaggaacgggtcccgttacaccgatccgtacgagactaacgtaactaccgaacgaaccacgtcttactacgtactacgacgtaaagtacgaacacgttccgaaggacggtacggaacgaacggtaccgaccggtactaattacgttacgtggtacgaaggtaaccggtggggtagggtaacgggtcggggtaaccgtacgggtaccgggaccggtaccgggtaccgttacggaccgtacccgttcctacccgtagacccgtacccgaacccgaacggtacccggtacccttaccgttcccggttaacccccttccggaccccggtacccctccccggttaacgtaacccggaacgtaacccgcccggttaccggtcccgggtacgggaaccggtccgtaaccggggcccgttaccggtaccggtaccggtcggtcccggttaaggtacccgtacgggttaccctttccgaacgttaccctaaccttacggtaacgttaccgggacggtaccgggtccggtaacggacgaacggtaccggacgttacgacacgtntaag

SEQ ID NO: 223108 - DNA, 822 bp, Homo sapiens
  misc_feature: GYAE6OF01CA7F1.37.25.C03.1.454.CMB.1.raw
  modified_base (130)..(130): a, c, t, g, unknown or other
  misc_feature (130)..(130): n is a, c, g, or t
tcagtagtgtagatcacgaccggtgctcgatttagtagtgtagatttgggttgggggaggcctggtgcagccgtggggggtccctgagactctcctgtgcagcctcgtggattaatgtttacgcaactcnggacatgaacgtgggtcccgcaggctccgaggcagtggggctgcaggtggtactacaagttactagtgtctccgtaggtaaataggagccaagacctacgctagaccgtccggtaggaaccgggtcccgttacaacctctaccgaccgaaggacaacctaactaaccgaaacgaaccgacgtactactactacgtacgaacgtaaagtacgaacgacgcgtaaggaacgacgaccgaacgtaccgtacgtaacttattaagttacgtaggtaggtaaggtaacggtgggtacggggtacggggtacgggtacggtaccggggtacgggaaccggtaaccggtaccggtacggtaccgtccgtaccgtccgtacgtaccgtacccgtacccgaaccggtacccgtaccgtaccggttccccgttccccgtccccggtcccgtacccgtaccccgtaccgtaaccgaacgaccgtaccgtaccggtaccgggtaccggaaccgtaccggaccgggtccggttaccgggtccggtaccggtaccgggtacccggttaaccggtaaccggtaaccggttacccgttaaccgttaacccgtacgtaccgttaacccgtaaccggttaccggtaccgggtaacgggtccgggtacggtacccgggaaccggtacggaacgttaagtaccgagtcgacg

SEQ ID NO: 223109 - DNA, 741 bp, Homo sapiens
  misc_feature: GYAE6OF01A11ZA.37.25.C03.1.454.CMB.1.raw
  modified_base (144)..(144): a, c, t, g, unknown or other
  misc_feature (144)..(144): n is a, c, g, or t
  modified_base (730)..(730): a, c, t, g, unknown or other
  misc_feature (730)..(730): n is a, c, g, or t
tcagtagtgtagatcacgaccggtgctcgatttagtagtgtagatttgggtttgggggaggcctggtgcagcctgggggtccctgagactctcctgtgcagcctctggattaatgtttagcaactctgcatgaacgtgggtccncaggctcaggcagtgggctgctagtcggtctacaagttactagtcgctaccgtggtaaatgacgcagactacgctaagaccttccggaggaacggtccgttacaccgtatcctacgaagacgaacctaattaccaacggaactacgctacgtacttacgtaggacaaagtacgaactacgtcctaaggaacgtacggaccgaaacggaaccgacggtaccgtattagttaactgtcgtaggaaaggtcggtaggaacggtcggggtaacgtaacggtcggaccgtaacgggtacccgtcggtaccgccgttaccgtaccgtacgaaccgtccctacgaaccggaacggacccgtacggttccgtaccccgtttacccgtcggacccgttaaccctacccgttaacccgagtaccgtacctacccgtcggacgggtacccgacgaccggcccggtccggtaccgggcttacccggaccgttacggtaccggtaacggttacctaacccgttcgaaccttaccgtaacccgtaacggtccgtaacggaggtcccgggtcgttacggaccggaagtacccgaagttaanccgggtatacc

SEQ ID NO: 223110 - DNA, 229 bp, Homo sapiens
  misc_feature: GYAE6OF02H7XTN.37.25.C03.1.454.CMB.1.raw
  modified_base (229)..(229): a, c, t, g, unknown or other
  misc_feature (229)..(229): n is a, c, g, or t
tcagtagtgtagatcacgaccggtgctcgatttagtagtgtagatttgggtttggggactactggggccacggaaccctggtcaccgtctcctcagcctccaccaagggcccatcggtcttcccctggcaccctcctccaagagcacctctggggcacagcggccctgggctgcctggtcaaggactacttccatctacactactgagcgggctggcaaggcgcatagn

SEQ ID NO: 223111 - DNA, 176 bp, Homo sapiens
  misc_feature: GYAE6OF02IPZO5.37.25.C03.1.454.CMB.1.raw
  modified_base (171)..(176): a, c, t, g, unknown or other
  misc_feature (171)..(176): n is a, c, g, or t
tcagtagtgtagatcacgaccggtgctcgatttagtagtgtagatttgggtttggggaagaggaagactgacggtccccaggagttcaggtgctgggcacagcggccctgggctgcctggtcaaggactacttccatctacactactgagcgggctggcaaggcgcatagnnnnnn

SEQ ID NO: 223112 - DNA, 170 bp, Homo sapiens
  misc_feature: GYAE6OF02JTAIS.37.25.C03.1.454.CMB.1.raw
  modified_base (168)..(170): a, c, t, g, unknown or other
  misc_feature (168)..(170): n is a, c, g, or t
tcagtagtgtagatcacgaccggtgctcgatttagtagtgtagattggttggggaagaggaagactgacggtccccaggagttcaggtgctgggcacagcggccctgggctgcctggtcaaggactacttccatctacactactgagcgggctggcaaggcgcatagnnn

SEQ ID NO: 223113 - DNA, 173 bp, Homo sapiens; identical to SEQ ID NO: 222839
  misc_feature: GYAE6OF02H5CVH.37.25.C03.1.454.CMB.1.raw
  modified_base (173)..(173): a, c, t, g, unknown or other
  misc_feature (173)..(173): n is a, c, g, or t

SEQ ID NO: 223114 - DNA, 174 bp, Homo sapiens; identical to SEQ ID NO: 222843
  misc_feature: GYAE6OF02GVU7X.37.25.C03.1.454.CMB.1.raw
  modified_base (173)..(174): a, c, t, g, unknown or other
  misc_feature (173)..(174): n is a, c, g, or t

SEQ ID NO: 223115 - DNA, 374 bp, Homo sapiens
  misc_feature: GYAE6OF02IXDTP.37.25.C03.1.454.CMB.1.raw
  modified_base (369)..(374): a, c, t, g, unknown or other
  misc_feature (369)..(374): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttcccctggcgccctgctccaggagcacctccgagagcacagcggccctgggctgcctgggtcaagggctacttccatctacactactgagcgggctggcaaggcgcatagnnnnnn

SEQ ID NO: 223116 - DNA, 518 bp, Homo sapiens
  misc_feature: GYAE6OF02IJNUX.37.25.C03.1.454.CMB.1.raw
  modified_base (516)..(518): a, c, t, g, unknown or other
  misc_feature (516)..(518): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccaggggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnn

SEQ ID NO: 223117 - DNA, 174 bp, Homo sapiens; identical to SEQ ID NO: 222843
  misc_feature: GYAE6OF02I9G4W.37.25.C03.1.454.CMB.1.raw
  modified_base (173)..(174): a, c, t, g, unknown or other
  misc_feature (173)..(174): n is a, c, g, or t

SEQ ID NO: 223118 - DNA, 230 bp, Homo sapiens
  misc_feature: GYAE6OF02GW40Q.37.25.C03.1.454.CMB.1.raw
  modified_base (230)..(230): a, c, t, g, unknown or other
  misc_feature (230)..(230): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttcccctggcaccctcctccaagagcacctctggggcacagcggccctgggctgcctggtcaaggactacttccatctacactactgagcgggctggcaaggcgcatagn

SEQ ID NO: 223119 - DNA, 173 bp, Homo sapiens; identical to SEQ ID NO: 222839
  misc_feature: GYAE6OF02I494B.37.25.C03.1.454.CMB.1.raw
  modified_base (173)..(173): a, c, t, g, unknown or other
  misc_feature (173)..(173): n is a, c, g, or t

SEQ ID NO: 223120 - DNA, 372 bp, Homo sapiens
  misc_feature: GYAE6OF02J155J.37.25.C03.1.454.CMB.1.raw
  modified_base (370)..(372): a, c, t, g, unknown or other
  misc_feature (370)..(372): n is a, c, g, or t
tcagtagtgtagatcacgaccggtgctcgatttagtagtgtagatttgggtttgggtagttcacgttgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctccaccaagggcccatcggtcttccccctggccaccctcctccaagagcacctctggggcacagcggccctgggctgccctggtcaaggctacttccatctacactactgagcggctggcaaggcgcatagnnn

SEQ ID NO: 223121 - DNA, 175 bp, Homo sapiens; identical to SEQ ID NO: 222899
  misc_feature: GYAE6OF02H1QT4.37.25.C03.1.454.CMB.1.raw
  modified_base (173)..(175): a, c, t, g, unknown or other
  misc_feature (173)..(175): n is a, c, g, or t

SEQ ID NO: 223122 - DNA, 172 bp, Homo sapiens
  misc_feature: GYAE6OF02G5JAJ.37.25.C03.1.454.CMB.1.raw
  modified_base (172)..(172): a, c, t, g, unknown or other
  misc_feature (172)..(172): n is a, c, g, or t
tcagtagtgtagatcacgaccggtgctcgatttagtagtgtagatttgggtttggggaagaggaagactgacggtcccccaggagttcaggtgctgggcacagcggccctgggctgcctggtcaaggactacttccatctacactactgagcgggctggcaaggcgcatagn

SEQ ID NO: 223123 - DNA, 174 bp, Homo sapiens; identical to SEQ ID NO: 222843
  misc_feature: GYAE6OF02I5V65.37.25.C03.1.454.CMB.1.raw
  modified_base (173)..(174): a, c, t, g, unknown or other
  misc_feature (173)..(174): n is a, c, g, or t

SEQ ID NO: 223124 - DNA, 232 bp, Homo sapiens
  misc_feature: GYAE6OF02GEH7Y.37.25.C03.1.454.CMB.1.raw
  modified_base (230)..(232): a, c, t, g, unknown or other
  misc_feature (230)..(232): n is a, c, g, or t
tcagtagtgtagatcacgaccggtgctcgatttagtagtgtagatttgggtttggggacgtactggggccagggaaccctggtcaccgtctcctcagcctccaccaagggcccatcggtcttcccctggcaccctcctccaagagcacctctggggcacagcggccctgggctgcctggtcaaggactacttccatctacactactgagcgggctggcaaggcgcatagnnn

SEQ ID NO: 223125 - DNA, 181 bp, Homo sapiens
  misc_feature: GYAE6OF02FZE42.37.25.C03.1.454.CMB.1.raw
  modified_base (174)..(181): a, c, t, g, unknown or other
  misc_feature (174)..(181): n is a, c, g, or t
tcagtagtgtagatcacgaccggtgctcgatttagtagtgtagatttgggtttgggggaaggaggaagactgacggtcccccaggagttcaggtgctgggcacagcggccctgggctgcctggtcaaggactacttccatctacactactgagcgggctggcaaggcgcatagnnnnnnnn

SEQ ID NO: 223126 - DNA, 173 bp, Homo sapiens; identical to SEQ ID NO: 222839
  misc_feature: GYAE6OF02G9HRZ.37.25.C03.1.454.CMB.1.raw
  modified_base (173)..(173): a, c, t, g, unknown or other
  misc_feature (173)..(173): n is a, c, g, or t

SEQ ID NO: 223127 - DNA, 193 bp, Homo sapiens
  misc_feature: GYAE6OF02JJIAO.37.25.C03.1.454.CMB.1.raw
  modified_base (172)..(193): a, c, t, g, unknown or other
  misc_feature (172)..(193): n is a, c, g, or t
tcagtagtgtagatcacgaccggtgctcgatttagtagtgtagatttgggttggggaagaggaagactgacggtccccaggagttcaggtgctgggcacagcggccctgggctgcctggtcgaaggactacttccatcgtacactactgagcgggctggcaaggcgcatagnnnnnnnnnnnnnnnnnnnnnn

SEQ ID NO: 223128 - DNA, 173 bp, Homo sapiens; identical to SEQ ID NO: 222839
  misc_feature: GYAE6OF02H0ELT.37.25.C03.1.454.CMB.1.raw
  modified_base (173)..(173): a, c, t, g, unknown or other
  misc_feature (173)..(173): n is a, c, g, or t

SEQ ID NO: 223129 - DNA, 373 bp, Homo sapiens
  misc_feature: GYAE6OF02ILE08.37.25.C03.1.454.CMB.1.raw
  modified_base (369)..(373): a, c, t, g, unknown or other
  misc_feature (369)..(373): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctgaccaccctcctccaagagcacctctggggcacagcggccctgggctgccctggtcaaggctacttccatctacactactgagcgggctggcaaggcgcatagnnnnn

SEQ ID NO: 223130 - DNA, 485 bp, Homo sapiens
  misc_feature: GYAE6OF02GMH8V.37.25.C03.1.454.CMB.1.raw
  modified_base (456)..(461): a, c, t, g, unknown or other
  misc_feature (456)..(461): n is a, c, g, or t
  modified_base (463)..(485): a, c, t, g, unknown or other
  misc_feature (463)..(485): n is a, c, g, or t
tcagtagtgtagatcacgaccggtgctcgatttagtagtgtagatttggggtttgggcgtcgaactctcttgtccgccaggctccagggcatggggctgcagtgggtctcaagtactagtgctcctggtaatagagcagactacggcaggacctccgtgaagggcccggttcaccatctccagagacaattccaaggaacacgctctatctgcaaatgaacagcctgagagccgaagacacggccgtatattactgtgtgaaaggctggggatggggggactactggggccagggaaccctggtccaaccgtctcctcagcctccacaagggccatcggtcttccccctggcaccctcctccaagagcacctctgggggcacagcggaccctgggcctgcctggtcaaggactacgttccatctacactactgagcgggctggcaaggcgcatagnnnnnncnnnnnnnnnnnnnnnnnnnnnnn

SEQ ID NO: 223131 - DNA, 516 bp, Homo sapiens
  misc_feature: GYAE6OF02HPJFU.37.25.C03.1.454.CMB.1.raw
  modified_base (514)..(515): a, c, t, g, unknown or other
  misc_feature (514)..(515): n is a, c, g, or t
tcagtagtgtagatcacgaccggtgctcgatttagtagtgtagatttgggtttggggaggcctggtgcagcctgggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactaacgtggggccaggggaaccctggtcaccgtctcctcagcctccaccaagggcccatcggtcttcccctggcaccctcctccaagagccacctctggggcacagcggccctgggctgcctggtcaaggactactccatctacactactgagcgggctggcaaggcgcatagnng

SEQ ID NO: 223132 - DNA, 371 bp, Homo sapiens
  misc_feature: GYAE6OF02I7T1K.37.25.C03.1.454.CMB.1.raw
  modified_base (368)..(371): a, c, t, g, unknown or other
  misc_feature (368)..(371): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnnn

SEQ ID NO: 223133 - DNA, 171 bp, Homo sapiens
  misc_feature: GYAE6OF02HHYNX.37.25.C03.1.454.CMB.1.raw
  modified_base (170)..(171): a, c, t, g, unknown or other
  misc_feature (170)..(171): n is a, c, g, or t
tcagtagtgtagatcacgaccggtgctcgatttagtagtgtagatttgggttggggaagaggaagactgacggtccccaggagttcaggtgctgggcacagcggccctgggctgcctggtcaaggactacttccatctacactactgagcgggctggcaaggcgcatagnn

SEQ ID NO: 223134 - DNA, 370 bp, Homo sapiens
  misc_feature: GYAE6OF02F4TNZ.37.25.C03.1.454.CMB.1.raw
  modified_base (366)..(370): a, c, t, g, unknown or other
  misc_feature (366)..(370): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttcccctggcaccctctccaagagcacctctgggggcacagcggccctgggctgcctggtcaaggactacttccatctacactactgagcggctggcaaggcgcatagnnnnn

SEQ ID NO: 223135 - DNA, 191 bp, Homo sapiens
  misc_feature: GYAE6OF02GRCJ2.37.25.C03.1.454.CMB.1.raw
  modified_base (175)..(191): a, c, t, g, unknown or other
  misc_feature (175)..(191): n is a, c, g, or t
tcagtagtgtagatcacgaccggtgctcgatttagtagtgtagatttgggtttggggggaagagggaagactgacggtcccccaggagttcaggtgctgggcacagcggccctgggctgcctggtcaaggactacttccatctacactactgagcgggctggcaaggcgcatagnnnnnnnnnnnnnnnnn

SEQ ID NO: 223136 - DNA, 512 bp, Homo sapiens
  misc_feature: GYAE6OF02H5HEW.37.25.C03.1.454.CMB.1.raw
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagtagtgtagatcacgaccggtgctcgatttagtagtgtagatttgggtttggggaggcctggtgcagcctgggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcgccctgctccaggagcacctccgagagcacagcggccctgggctgcctggtcaaggctacttccatctacnctactgagcggctggcaaggcgcatagn

SEQ ID NO: 223137 - DNA, 174 bp, Homo sapiens; identical to SEQ ID NO: 222845
  misc_feature: GYAE6OF02IDDF1.37.25.C03.1.454.CMB.1.raw
  modified_base (174)..(174): a, c, t, g, unknown or other
  misc_feature (174)..(174): n is a, c, g, or t

SEQ ID NO: 223138 - DNA, 513 bp, Homo sapiens
  misc_feature: GYAE6OF02G7ALY.37.25.C03.1.454.CMB.1.raw
  modified_base (484)..(484): a, c, t, g, unknown or other
  misc_feature (484)..(484): n is a, c, g, or t
  modified_base (513)..(513): a, c, t, g, unknown or other
  misc_feature (513)..(513): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccaggggaaccctggtcaccgtctcctcagcctccaccaagggcccatcggtcttcccctggcaccatcctccaagacgcacctctggggcacagcggccctgggctgcctgtcagactacttccatctacnctactgagcgggctggcaaggcgcatagn

SEQ ID NO: 223139 - DNA, 520 bp, Homo sapiens
  misc_feature: GYAE6OF02IWD8Q.37.25.C03.1.454.CMB.1.raw
  modified_base (507)..(507): a, c, t, g, unknown or other
  misc_feature (507)..(507): n is a, c, g, or t
  modified_base (513)..(520): a, c, t, g, unknown or other
  misc_feature (513)..(520): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctggagtgggtctcaggtattactggtagtggtaataccgcatactacgcagactccgtgacgggccggttcaccgtctccagagacaattccaagaatacggtctatctggaaatgaacagcctgagagccgaggacacggccgtatattactgtgtgaaaggctggggatggggggactactggggccagggaaccctggtcaccgtctcctcagcctccaccaagggcccatcggtcttccccctggcaccctcctccaagagcacctctggggcacagcgccctgggctgcctggtcaaggactactccatctacactactgagcgggctggcaaggcncatagnnnnnnnn

SEQ ID NO: 223140 - DNA, 183 bp, Homo sapiens
  misc_feature: GYAE6OF02HCRGS.37.25.C03.1.454.CMB.1.raw
  modified_base (175)..(183): a, c, t, g, unknown or other
  misc_feature (175)..(183): n is a, c, g, or t
tcagtagtgtagatcacgaccggtgctcgatttagtagtgtagatttgggtttgggggggaagaggaagactgacggtcccccaggagttcaggtgctgggcacagcggccctgggctgcctggtcaaggactacttccatctacactactgagcgggctggcaaggcgcatagnnnnnnnnn

SEQ ID NO: 223141 - DNA, 174 bp, Homo sapiens; identical to SEQ ID NO: 222843
  misc_feature: GYAE6OF02HIBZG.37.25.C03.1.454.CMB.1.raw
  modified_base (173)..(174): a, c, t, g, unknown or other
  misc_feature (173)..(174): n is a, c, g, or t

SEQ ID NO: 223142 - DNA, 177 bp, Homo sapiens
  misc_feature: GYAE6OF02GK9XZ.37.25.C03.1.454.CMB.1.raw
  modified_base (174)..(177): a, c, t, g, unknown or other
  misc_feature (174)..(177): n is a, c, g, or t
tcagtagtgtagatcacgaccggtgctcgatttagtagtgtagatttgggtttgggggaaggaggaagactgacggtcccccaggagttcaggtgctgggcacagcggccctgggctgcctggtcaaggactacttccatctacactactgagcgggctggcaaggcgcatagnnnn

SEQ ID NO: 223143 - DNA, 549 bp, Homo sapiens
  misc_feature: GYAE6OF02I8DBC.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaggtattactggtagtggtaataccgcatactacgcagactccgtgacgggccggttcaccgtctccagagacaattccaagaatacggtctatctggaaatgaacagccctgagagccgaggacacggccctctattactgtgcgagagatcagacggagtatagcagcagctctgactactggggccacggaaccctggtcaccgtctcctcacgcctccaccgaacgggcccacgtccggtccttccccctggccacccctccctccaacgacgccacctcgtcgggggcaccgacgccggcccgtgggcctgccttggcaaggtcctacttccatcctacacctacgtgacgcgggctggcgaacgg

SEQ ID NO: 223144 - DNA, 371 bp, Homo sapiens
  misc_feature: GYAE6OF02FIJSV.37.25.C03.1.454.CMB.1.raw
  modified_base (369)..(371): a, c, t, g, unknown or other
  misc_feature (369)..(371): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnn

SEQ ID NO: 223145 - DNA, 174 bp, Homo sapiens; identical to SEQ ID NO: 222845
  misc_feature: GYAE6OF02FU4CS.37.25.C03.1.454.CMB.1.raw
  modified_base (174)..(174): a, c, t, g, unknown or other
  misc_feature (174)..(174): n is a, c, g, or t

SEQ ID NO: 223146 - DNA, 514 bp, Homo sapiens
  misc_feature: GYAE6OF02JQ3MQ.37.25.C03.1.454.CMB.1.raw
  modified_base (402)..(402): a, c, t, g, unknown or other
  misc_feature (402)..(402): n is a, c, g, or t
  modified_base (511)..(511): a, c, t, g, unknown or other
  misc_feature (511)..(511): n is a, c, g, or t
tcagtagtgtagatcacgaccggtgctcgatttagtagtgtagatttgggtttggggaggcctggtgcagcctgggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactactggggccagggaaccctggtcacgtctcctcagcctcaccaaggcccatcgtctcccngcacctcctccagagcacctctggggcacagcggccctgggcctgcctggtccaaggcctacgtccatctacacctactgaggcggactggacgaaggccacgactagnacg

SEQ ID NO: 223147 - DNA, 531 bp, Homo sapiens
  misc_feature: GYAE6OF02GB306.37.25.C03.1.454.CMB.1.raw
  modified_base (529)..(530): a, c, t, g, unknown or other
  misc_feature (529)..(530): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggagtggggggactacgtggggccagggaaccctggtcaccgtctcctcagcctccaccaagggcccatcgtctccccctggccaccctcctccaagcgccacctcgtcggggccacgacgccggccctcgggctcgcctggtcaaggacctacttccatcctacactacgtggacgcgggctggcaggcgcagtgnnc

SEQ ID NO: 223148 - DNA, 395 bp, Homo sapiens
  misc_feature: GYAE6OF02IRSMV.37.25.C03.1.454.CMB.1.raw
  modified_base (371)..(395): a, c, t, g, unknown or other
  misc_feature (371)..(395): n is a, c, g, or t
tcagtagtgtagatcacgaccggtgctcgatttagtagtgtagatttgggtttgggtagttcacgttgcagactccgtgaagggccggttcaccatctccagagacaattccaagaacacgctctatctgcaaatgaacagcctgagagccgaagacaacggccgtatattacctgtgtgaaaggctggggatggggggactactggggccagggaaccctggtcaccgtctcctcagcctccaccaagggcccatcggtcttccccctggcaccctcctccaagacgcacctctgggggcacagcgccctgggctgcctggtcaggactactccatctacactactgagcgggctggcaaggcgcatagnnnnnnnnnnnnnnnnnnnnnnnnn

SEQ ID NO: 223149 - DNA, 173 bp, Homo sapiens; identical to SEQ ID NO: 222839
  misc_feature: GYAE6OF02FMZ5E.37.25.C03.1.454.CMB.1.raw
  modified_base (173)..(173): a, c, t, g, unknown or other
  misc_feature (173)..(173): n is a, c, g, or t

SEQ ID NO: 223150 - DNA, 232 bp, Homo sapiens
  misc_feature: GYAE6OF02GXAIE.37.25.C03.1.454.CMB.1.raw
  modified_base (229)..(232): a, c, t, g, unknown or other
  misc_feature (229)..(232): n is a, c, g, or t
tcagtagtgtagatcacgaccggtgctcgatttagtagtgtagatttgggttgggggactactggggccagggaaccctggtcaccgtctcctcagcctccaccaagggcccatcggtcttcccctggcaccctcctccaagagcacctctggggcacagcggccctgggctgcctggtcaaggactacttccatctacactactgagcgggctggcaaggcgcatagnnnn

SEQ ID NO: 223151 - DNA, 175 bp, Homo sapiens
  misc_feature: GYAE6OF02IKUXD.37.25.C03.1.454.CMB.1.raw
  modified_base (175)..(175): a, c, t, g, unknown or other
  misc_feature (175)..(175): n is a, c, g, or t
tcagtagtgtagatcacgaccggtgctcgatttagtagtgtagatttgggtttggggggaagaggaagactgacggtccccccaggagttcaggtgctgggcacagcggccctgggctgcctggtcaaggactacttccatctacactactgagcgggctggcaaggcgcatagn

SEQ ID NO: 223152 - DNA, 517 bp, Homo sapiens
  misc_feature: GYAE6OF02GAUY5.37.25.C03.1.454.CMB.1.raw
  modified_base (515)..(517): a, c, t, g, unknown or other
  misc_feature (515)..(517): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccaggggaaccctggtcaccgtctcctcagcctccaccaagggcccatcggtcttccccctggcaccctcctccaagagcactctggggcacagcggccctgggctgcctggtcaaggactacttccatctacactactgacgcgggctggcaggcgcatagnnn

SEQ ID NO: 223153 - DNA, 225 bp, Homo sapiens
  misc_feature: GYAE6OF02I8OW2.37.25.C03.1.454.CMB.1.raw
  modified_base (175)..(225): a, c, t, g, unknown or other
  misc_feature (175)..(225): n is a, c, g, or t
tcagtagtgtagatcacgaccggtgctcgatttagtagtgtagatttgggtttggggggaagaggaagactgacggtcccccaggagttcaggtgctgggcacagcggccctgggctgcctggtcaaggactacgttccatctacactactgagcgggctggcaaggcgcatagnnnnnnnnnnnnnnnnnnnnnnnnnnnnnnnnnnnnnnnnnnnnnnnnnnn

SEQ ID NO: 223154 - DNA, 180 bp, Homo sapiens
  misc_feature: GYAE6OF02G5315.37.25.C03.1.454.CMB.1.raw
  modified_base (172)..(180): a, c, t, g, unknown or other
  misc_feature (172)..(180): n is a, c, g, or t
tcagtagtgtagatcacgaccggtgctcgatttagtagtgtagatttgggtttgggggaagaggaagactgacggtccccaggagttcaggtgctgggcacagcggccctgggctgcctggtcaaggactacttccatctacactactgagcgggctggcaaggcgcatagnnnnnnnnn

SEQ ID NO: 223155 - DNA, 383 bp, Homo sapiens
  misc_feature: GYAE6OF02JA6PY.37.25.C03.1.454.CMB.1.raw
  modified_base (374)..(383): a, c, t, g, unknown or other
  misc_feature (374)..(383): n is a, c, g, or t
tcagtagtgtagatcacgaccggtgctcgatttagtagtgtagatttgggtttgggagttcaccgttgcagactccgtgaagggccggttcaccatctccagagacaattccaagaacacgctctatctgcaaatgaacagcctgagagccgaagacacggccgtatattactgtgtgaaaggctggggatggggggactacgtggggccaggggaaccctggtcaccgtctcctcgagcctccaccaagggcccatcggtcttcccctggcaccctcctccaagacgcacctctgggggcacacgcggccctgggctgcctggtcaaggctacgtccagtctacactactgagcgggctggcaaggcgcatgnnnnnnnnnn

SEQ ID NO: 223156 - DNA, 374 bp, Homo sapiens
  misc_feature: GYAE6OF02F2NPX.37.25.C03.1.454.CMB.1.raw
  modified_base (370)..(374): a, c, t, g, unknown or other
  misc_feature (370)..(374): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggccaccctcctccaagagcacctctgggggcacagcggccctgggctgcctggtcaaggactacttccatctacactactgagcgggctggcaaggcgcatagnnnnn

SEQ ID NO: 223157 - DNA, 577 bp, Homo sapiens
  misc_feature: GYAE6OF02HBGTN.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgagagatcagacggagtatagcagcagctctgactactggggccacggaaccctggtcaccgtctcctcacgcctccaccaacgggcccagtccggtccttccccctcggccacccctccctcccaacgacgccaccctccgtcgggggccacgacggccggcccgtcgggcctcggcccgtgggtccgaacggtaccgttaacttcccacttcctaacctaccttactcggacggcgggcgtcgggcgaacggg

SEQ ID NO: 223158 - DNA, 372 bp, Homo sapiens
  misc_feature: GYAE6OF02F07DC.37.25.C03.1.454.CMB.1.raw
  modified_base (369)..(372): a, c, t, g, unknown or other
  misc_feature (369)..(372): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 223159 - DNA, 390 bp, Homo sapiens
  misc_feature: GYAE6OF02JZ5HI.37.25.C03.1.454.CMB.1.raw
  modified_base (381)..(390): a, c, t, g, unknown or other
  misc_feature (381)..(390): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctgggtcaccggtctcctcagcctccaccaagggccccatcggtcttccccctggccacccctcctccaagacgccacctcgtcgggggccacgagccggccctgggctgcctggtcaaggctacttccatctacactactgacgcggctggcaaggcgcatagnnnnnnnnnn

SEQ ID NO: 223160 - DNA, 370 bp, Homo sapiens
  misc_feature: GYAE6OF02H442T.37.25.C03.1.454.CMB.1.raw
  modified_base (367)..(370): a, c, t, g, unknown or other
  misc_feature (367)..(370): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctggggcacagcggccctgggctgcctggtcaaggacacttccatctacactactgagcgggctggcaaggcgcatagnnnn

SEQ ID NO: 223161 - DNA, 174 bp, Homo sapiens; identical to SEQ ID NO: 222843
  misc_feature: GYAE6OF02G1X5C.37.25.C03.1.454.CMB.1.raw
  modified_base (173)..(174): a, c, t, g, unknown or other
  misc_feature (173)..(174): n is a, c, g, or t

SEQ ID NO: 223162 - DNA, 423 bp, Homo sapiens
  misc_feature: GYAE6OF02I745B.37.25.C03.1.454.CMB.1.raw
  modified_base (389)..(394): a, c, t, g, unknown or other
  misc_feature (389)..(394): n is a, c, g, or t
  modified_base (397)..(423): a, c, t, g, unknown or other
  misc_feature (397)..(423): n is a, c, g, or t
tcagtagtgtagatcacgaccggtgctcgatttagtagtgtagatttgggtttggggagttcacgttgcagactcccgtgaagggccggttcaccatcctccagagacaattccaagaacacgctctatctgcaaatgaacagcctgagagccgtaagacacggccgtatattactgtcgtgaaaggctggggatggggggactacgtggggccaggggaacccctggtcaccggtctccgtcagcctccgaccaagggcccatcggtcttcccctggccaccctcctccaagagcacctctgggggccacgacgcggccctgggctgcctggtcacggcctacttccgatctcactcctgacgcgggtctggccgaaggcgcagtagnnnnnnctnnnnnnnnnnnnnnnnnnnnnnnnnnn

SEQ ID NO: 223163 - DNA, 181 bp, Homo sapiens
  misc_feature: GYAE6OF02GVZ21.37.25.C03.1.454.CMB.1.raw
  modified_base (173)..(181): a, c, t, g, unknown or other
  misc_feature (173)..(181): n is a, c, g, or t
tcagtagtgtagatcacgaccggtgctcgatttagtagtgtagatttgggtttgggggaagaggaagactgacggtcccccaggagttcaggtgctgggcacagcggccctgggctgcctggtcaaggactacttccatctacactactgagcgggctggcaaggcgcatagnnnnnnnnn

SEQ ID NO: 223164 - DNA, 525 bp, Homo sapiens
  misc_feature: GYAE6OF02I1I1Z.37.25.C03.1.454.CMB.1.raw
  modified_base (519)..(519): a, c, t, g, unknown or other
  misc_feature (519)..(519): n is a, c, g, or t
tcagtagtgtagatcacgaccggtgctcgatttagtagtgtagatttgggtttgggggaggcctggtgcagcctggggggtccctgatactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaggaagggtctagcagtgcctggtactcccactactatatggacgtctggggcaaggatcgcggtcaccgtctcctcagcctccaccaagggcccagtcggtcttcccccgtggccaccctccccaagacgccaccgtctcggggcacgacgcgccctgggctgcctggtcaacggctacgttcatctacactacngtacgg

SEQ ID NO: 223165 - DNA, 531 bp, Homo sapiens
  misc_feature: GYAE6OF02J2ISQ.37.25.C03.1.454.CMB.1.raw
  modified_base (529)..(529): a, c, t, g, unknown or other
  misc_feature (529)..(529): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaaggcccatcggtctcccctggccaccctcctccaagcgcaccctctcgggggcacacgcggccctgggcctcgcctgggttccaacgggacctacttccactctacactactgacgcgggctggcaacggcgcatagncg

SEQ ID NO: 223166 - DNA, 174 bp, Homo sapiens
  misc_feature: GYAE6OF02ISP2G.37.25.C03.1.454.CMB.1.raw
  modified_base (174)..(174): a, c, t, g, unknown or other
  misc_feature (174)..(174): n is a, c, g, or t
tcagtagtgtagatcacgaccggtgctcgatttagtagtgtagatttgggtttgggggaagaggaagactgacggtccccccaggagttcaggtgctgggcacagcggccctgggctgcctggtcaaggactacttccatctacactactgagcgggctggcaaggcgcatagn

SEQ ID NO: 223167 - DNA, 568 bp, Homo sapiens
  misc_feature: GYAE6OF02G2P65.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctccaccaagggcccatcggtcttccccctggccacctcctcctaccaagacgcctacctcggtcggggaccacgacggcccggccgtcggcctcgtccgtggtacgaacggtaccttacctacctactacctaacctacctacgtcggaacgggccggcgtcggacgaacggccgactagtagcg

SEQ ID NO: 223168 - DNA, 491 bp, Homo sapiens
  misc_feature: GYAE6OF02G6QSV.37.25.C03.1.454.CMB.1.raw
  modified_base (378)..(378): a, c, t, g, unknown or other
  misc_feature (378)..(378): n is a, c, g, or t
  modified_base (459)..(459): a, c, t, g, unknown or other
  misc_feature (459)..(459): n is a, c, g, or t
  modified_base (465)..(491): a, c, t, g, unknown or other
  misc_feature (465)..(491): n is a, c, g, or t
tcagtagtgtagatcacgaccggtgctcgatttagtagtgtagatttgggtttgggctcaaacgtctacttgtcccgccagggctccacggcatgggggctgcagtgggtctcaagtactagtgctcctggtaattagaggcagactacgcagactccgtgaagggccggttcaccatctccagagacaattccaagaacacgctctatctgcaaatgaacagcctgagagccgaagacacggccgtatattactgtgtgaaaggctggggatggggggactacgttgggggccaggggaaaccctgggtccaccggtcgtcctcgagcctccaccgaaggcccatccggtcttccccctggccaccctcctccaagngcactctggggcacgacgcgcccgtggctcgccgtggtcaaggactacttccatctacactactgagcggctggcaaggcncatagnnnnnnnnnnnnnnnnnnnnnnnnnnn

SEQ ID NO: 223169 - DNA, 570 bp, Homo sapiens
  misc_feature: GYAE6OF02IXDZV.37.25.C03.1.454.CMB.1.raw
  modified_base (537)..(537): a, c, t, g, unknown or other
  misc_feature (537)..(537): n is a, c, g, or t
  modified_base (569)..(570): a, c, t, g, unknown or other
  misc_feature (569)..(570): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccgttcaccatctccagagacaattccaagaacacgctctatctgcaaatgaacagcctgagagccgaagaccacggccgtatattactgtgtagaaaggcgtggggagtggggggactacgtgggggccagggaaccctggtcaccgtctcctcacgcctcccaccgaacgggcccacgttcggtcccgttcccccgtggccctacccgtccctaccgaaacgacgacctacctccgtcggggccacgacgccggcccgtgggcctcgccgtggtcaacggtactaccgttcactctacacttacgngacggcggctcggcgtaacggcgagagagcgnn

SEQ ID NO: 223170 - DNA, 582 bp, Homo sapiens
  misc_feature: GYAE6OF02HLCUJ.37.25.C03.1.454.CMB.1.raw
tcagtagtgtagatcacgaccggtgctcgatttagtagtgtagatttgggtttgggctgagcgtggcgttttctagtggctattttaaaaggtttccagtgtgaggtgcagttgttggagtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaaaacgctctatctgacaaatgaacagcctgagagaccgaagacgacggccgtatacttactgtcgtagaaaggcgtaggggagtggggggactacggtggggaccgacgggaacccgtgggtaccgaccgtctcctcgacgcctaccaccgaacgggcccacgttccggtccttccccgcgccaccctcctccgaacgacgccaccgtccgtcggggccaccgacggccggacccgtcgggctcgtcccgg

SEQ ID NO: 223171 - DNA, 446 bp, Homo sapiens
  misc_feature: GYAE6OF02IG5RT.37.25.C03.1.454.CMB.1.raw
  modified_base (437)..(437): a, c, t, g, unknown or other
  misc_feature (437)..(437): n is a, c, g, or t
  modified_base (441)..(446): a, c, t, g, unknown or other
  misc_feature (441)..(446): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactgggggccagggaaccctggtcaccgtctcctcagcctccaccaagggcccatcggtcttcccctggcaccctcctccaagagaacctctgggggcacagcggcctgggctgcctggtcaggactactccatctacactactgagcgggctggcaaggcgcntagnnnnnn

SEQ ID NO: 223172 - DNA, 555 bp, Homo sapiens
  misc_feature: GYAE6OF02IGKYS.37.25.C03.1.454.CMB.1.raw
  modified_base (553)..(555): a, c, t, g, unknown or other
  misc_feature (553)..(555): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccgggcatggggctgcagtgggtctcaagtactagtgctcctggtaatagagcagactacgcagactccgtgaagggccggttcaccatctccagagacaaattccaagaacacgctctatctgacaaaatgaaacagcctgagagccgaagacacggccgtatattactgtgtgaaaggctggggagtggggggactacgtggggccgagggaaccctggtcaccgtctcctcacgcctcaccaagggcccatcgtccttccccctcggcaccctcctaccaagacgccaccgtcgtcgggggccacgacgccggcccgtcggggctcgccgttggtaccaaacggacctacttccatcctacactacgtgacgcgggctcggacgacggcgacagtagnnn

SEQ ID NO: 223173 - DNA, 481 bp, Homo sapiens
  misc_feature: GYAE6OF02FGWEB.37.25.C03.1.454.CMB.1.raw
  modified_base (453)..(453): a, c, t, g, unknown or other
  misc_feature (453)..(453): n is a, c, g, or t
  modified_base (458)..(481): a, c, t, g, unknown or other
  misc_feature (458)..(481): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagcccggaagacacggcctatatttactgtgtgaaaggctggggatgggggactactggggccagggaacccctggtcaccggtctcctcagcctccaccaagggcccatcggtcttcccccgtggccaccctcctccaacgagaccacctcgtcgggggacacgagccggccctggggcctggcctggtcaaggctacttccatctacactactgagcgggctggcaaggcnatagnnnnnnnnnnnnnnnnnnnnnnnn

SEQ ID NO: 223174 - DNA, 606 bp, Homo sapiens
  misc_feature: GYAE6OF02H94ZY.37.25.C03.1.454.CMB.1.raw
  modified_base (605)..(605): a, c, t, g, unknown or other
  misc_feature (605)..(605): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtagaaaggctggggagtgggggactacgtggggccaggaacccgtggtcaccgtctcctcagccctaccaccgaacgggcccagtccggtccttcccccgtggccacccctccctacccaaacgacgccacccttcgtacgggggccaaccgacggccggcccgtcgggccgtcgcccgttcgggtaccaaacggaccttaaccttccgtaacttacctaacctaaccgtaacgtcggaacggtccggggacttcgggaccgtaacgggccgtacgacgtaggnc

SEQ ID NO: 223175 - DNA, 174 bp, Homo sapiens; identical to SEQ ID NO: 222843
  misc_feature: GYAE6OF02GKBEX.37.25.C03.1.454.CMB.1.raw
  modified_base (173)..(174): a, c, t, g, unknown or other
  misc_feature (173)..(174): n is a, c, g, or t

SEQ ID NO: 223176 - DNA, 374 bp, Homo sapiens
  misc_feature: GYAE6OF02GFA0Z.37.25.C03.1.454.CMB.1.raw
  modified_base (369)..(374): a, c, t, g, unknown or other
  misc_feature (369)..(374): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnnn

SEQ ID NO: 223177 - DNA, 378 bp, Homo sapiens
  misc_feature: GYAE6OF02IXVVK.37.25.C03.1.454.CMB.1.raw
  modified_base (369)..(378): a, c, t, g, unknown or other
  misc_feature (369)..(378): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccaggggaaccctggtcaccgtctcctcagcctccaccaagggcccatcggtcttcccctggcaccctcctccaagagcacctctgggggcacagcggccctgggctgcctggtcaaggactacttccatctacactactgagcgggctggcaaggcgcatagnnnnnnnnnn

SEQ ID NO: 223178 - DNA, 524 bp, Homo sapiens
  misc_feature: GYAE6OF02JIJI2.37.25.C03.1.454.CMB.1.raw
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (523)..(523): a, c, t, g, unknown or other
  misc_feature (523)..(523): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccaggggaaccctggtcaccgtctcctcagcctccaccaagggcccagtcggtcttccccctggccaccctcctccaacgagccacctctcgggggcacagcggccctgggctgcctggtcaaggactacttccatctacactacngtagcggntggcaaggccgcatagnc

SEQ ID NO: 223179 - DNA, 623 bp, Homo sapiens
  misc_feature: GYAE6OF02GT7P3.37.25.C03.1.454.CMB.1.raw
  modified_base (219)..(219): a, c, t, g, unknown or other
  misc_feature (219)..(219): n is a, c, g, or t
tcagtagtgtagatcacgaccggtgctcgatttagtagtgtagatttgggtttgggggagggcctggtgcgagcctggggggtcccctgacgactctcctcgtgctagccttctggtttcatctttagcaactacgccatgagctgggtccgccagggtctccagggaaggggcttgggtagtgggtctcaggttaattactggtagtggtaataccgnatactacgcagactccgtggacgggccggttcaccgtctccaggacgacaattccaagaactacggtctatctggaaatggaactagccttagagagtccgaggaccacggcccttctattactgtcggcgagagatcgagacggagtatagcagcagctctgacttactgggccacggaaccctggtccaccgtctccgtcacgccctccaccaacgggcccacgtccggtaccttccccgtaggcctaccctcctaccaacgacgaccaccctacgtcggggacaccgacgccggaccgtcgggcctcgccgtacggtacgacggttacctacgttccgtacttccgtaacctaacttaccgtacgacggtacgggcgtaccggacgaacgggcgacgtacg

SEQ ID NO: 223180 - DNA, 547 bp, Homo sapiens
  misc_feature: GYAE6OF02HL2W7.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgacgggccggttcaccgtctccagagacaattccaagaatacggtctaatctggaaatgaacagcctgagagccgaggacacggccctctattactgtgcgagagatcagacggagtatagcagcagctctgactactggggccacggaaccctggtcaccgtctcctcagcctccaccaacgggcccatccggtccttcccccgtcggccacccctccctacccaacgacgccaccctcgtcgggggccacgacgccggcccgtgggcctcgcctggtaccgaacggacctacttccactctacactactggacgcggctcgg

SEQ ID NO: 223181 - DNA, 449 bp, Homo sapiens
  misc_feature: GYAE6OF02F3Z3M.37.25.C03.1.454.CMB.1.raw
  modified_base (445)..(449): a, c, t, g, unknown or other
  misc_feature (445)..(449): n is a, c, g, or t
tcagtagtgtagatcacgaccggtgctcgatttagtagtgtagatttgggtttgggctcaactctcttgtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctgggggatgggggggactactgggggccaggggaaccctggtcaccgtctcctcagcctccaccaagggcccatcggtcttccccctggcaccctcctccaagagcacctctgggggcacagcgccctgggctgcctggtcaaggctacttcatctacactactgagcgggctggcaaggcgcatagnnnnn

SEQ ID NO: 223182 - DNA, 533 bp, Homo sapiens
  misc_feature: GYAE6OF02JB29V.37.25.C03.1.454.CMB.1.raw
  modified_base (505)..(505): a, c, t, g, unknown or other
  misc_feature (505)..(505): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacacagactccgtgaagggccgttcaccatctccagagacaattccaagaacacgctctatctgcaaatgaacagcctgagagccgaagacacggccgtatattactgtgtgaaaggctgggatgggggactacgtggggccagggaaccctggccaccgtctcctcacgcctcaccaagggcccaatcggtccttccccctggccacccgtcctccgaagtacgccaccctcgtcggggcacgacgccggcccgtgggcctgcctcggtcaacggctactccatctacactacncgagcggctggcaaggccgnactagncg

SEQ ID NO: 223183 - DNA, 525 bp, Homo sapiens
  misc_feature: GYAE6OF02FU2OG.37.25.C03.1.454.CMB.1.raw
  modified_base (524)..(525): a, c, t, g, unknown or other
  misc_feature (524)..(525): n is a, c, g, or t
tcagtagtgtagatcacgaccggtgctcgatttagtagtgtagatttgggtttggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctgggtcaccgtctcctcagcctccaccaagggcccatccggtcttccccctggccaccctccctcccaacgacgcacctctcgggggcaccgagcggccctgggcctgcctggtcaaggactactcactctacactactgagcgggctggcaggcgcatagnn

SEQ ID NO: 223184 - DNA, 373 bp, Homo sapiens
  misc_feature: GYAE6OF02HARH0.37.25.C03.1.454.CMB.1.raw
  modified_base (368)..(373): a, c, t, g, unknown or other
  misc_feature (368)..(373): n is a, c, g, or t
tcagtagtgtagatcacgaccggtgctcgatttagtagtgtagatttgggtttgggattcacgttgcagactccatgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatagnnnnnn

SEQ ID NO: 223185 - DNA, 621 bp, Homo sapiens
  misc_feature: GYAE6OF02IVB9F.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccagggaaggggctggagtgggtctcaggtattactggtagtggtaataccgcatactacgcagactccgtgacgggccggttcaccgtctccagagacaattccaaagaatacggtctatctggaaatgaacagcctgagagccgaggacacggccctctattactgtgcgagagatcagacggagtatagcagcagctctgactactggggccacggaaccctggtcaccgtctcctcacgcctccaccaacgggcccacgtccggtccttccccgtcggcctacccctcctaccaacgacgccacctcgtcggggcacgacgccggcccgtcgggcctcggcccgtcggtaccgaaacgggtaccttaccgtttccctaacgttacccttaacctaacccgttaccgttacgggaacgggtcccggggtaccgttccgggaccgaacggggtacccgacgtaacgg

SEQ ID NO: 223186 - DNA, 173 bp, Homo sapiens; identical to SEQ ID NO: 223003
  misc_feature: GYAE6OF02FPJ71.37.25.C03.1.454.CMB.1.raw

SEQ ID NO: 223187 - DNA, 452 bp, Homo sapiens
  misc_feature: GYAE6OF02F43EJ.37.25.C03.1.454.CMB.1.raw
  modified_base (416)..(416): a, c, t, g, unknown or other
  misc_feature (416)..(416): n is a, c, g, or t
  modified_base (441)..(441): a, c, t, g, unknown or other
  misc_feature (441)..(441): n is a, c, g, or t
  modified_base (446)..(452): a, c, t, g, unknown or other
  misc_feature (446)..(452): n is a, c, g, or t
tcagtagtgtagatcacgaccggtgctcgatttagtagtgtagatttgggtttgggctcaactctcttgtccgccaggctccaggcatgggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactgggggccagggaaccctggtcaccgtctcctcagcctccaccaagggcccatcggtcttccccctggcaccctcctccaagagcacctctgggggcacagcggccctgggctgcctggtcaaggctacttccatctacnctactgagcgggctggcaaggccgnatagnnnnnnn

SEQ ID NO: 223188 - DNA, 173 bp, Homo sapiens; identical to SEQ ID NO: 222839
  misc_feature: GYAE6OF02FKV5E.37.25.C03.1.454.CMB.1.raw
  modified_base (173)..(173): a, c, t, g, unknown or other
  misc_feature (173)..(173): n is a, c, g, or t

SEQ ID NO: 223189 - DNA, 371 bp, Homo sapiens
  misc_feature: GYAE6OF02FX0P1.37.25.C03.1.454.CMB.1.raw
  modified_base (367)..(371): a, c, t, g, unknown or other
  misc_feature (367)..(371): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttcccctggcaccctcctccaagagcacctctgggggcacagcggccctgggctgcctggtcaaggactacttccatctacactactgagcggctggcaaggcgcatagnnnnn

SEQ ID NO: 223190 - DNA, 232 bp, Homo sapiens
  misc_feature: GYAE6OF02GHIJV.37.25.C03.1.454.CMB.1.raw
  modified_base (231)..(232): a, c, t, g, unknown or other
  misc_feature (231)..(232): n is a, c, g, or t
tcagtagtgtagatcacgaccggtgctcgatttagtagtgtagatttggggttgggggactactggggccagggaaccctggtcaccgtctcctcagcctccaccaagggcccatcggtcttccccctggcaccctcctccaagagcacctctgggggcacagcggccctgggctgcctggtcaaggactacttccatctaactactgagcgggctggcaaggcgcatagnn

SEQ ID NO: 223191 - DNA, 515 bp, Homo sapiens
  misc_feature: GYAE6OF02GT9MA.37.25.C03.1.454.CMB.1.raw
  modified_base (514)..(515): a, c, t, g, unknown or other
  misc_feature (514)..(515): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctcaccaagggcccatcggtccttcccctcggccaccctcctccaagagcacctcgtcggggcacagcggcctgggctgcctggtcaaggctacttccatctacactactgagcggctggcaggcgcatagnn

SEQ ID NO: 223192 - DNA, 554 bp, Homo sapiens
  misc_feature: GYAE6OF02FTVTQ.37.25.C03.1.454.CMB.1.raw
  modified_base (550)..(550): a, c, t, g, unknown or other
  misc_feature (550)..(550): n is a, c, g, or t
tcagtagtgtagatcacgaccggtgctcgatttagtagtgtagatttgggtttgggggaggcctggtgcagcctggggggtccctgagactctcctgtgcagcctctggtttcatctttagcaactacgccatgagctgggtccgccaggctccagggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacgggcccatccggtccttcccccgtcggcccacccctcctcccaacgacgccaccctcgtcgggggcacgacggccggcccgtgggcctcgccgtggtcaacggacctacttccactctaccactactgagcggctggcacggcgntacg

SEQ ID NO: 223193 - DNA, 600 bp, Homo sapiens
  misc_feature: GYAE6OF02JXROF.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacattccaagaacacgctctatctgcaaatgaacagcctgagagccgaagacacggccgtatatactgtgtgaaaggcgtggggagtgggggactacgtggggccgacgggaacccgtggtcaccgtcgtcctcacgcctccgaccaacgggcccagtccggtaccgttcccccctgggcccacccctcctcccgaacggacgtccaacccgtccgtcgggggaccacgtacggccggtcccgtgggcctcggccgtgggtccaaacggaccgttaccgttccacgttcctacctactaccgtacggacggccgggtctacgggccgtaacgggccgcgaacgtcggatcg

SEQ ID NO: 223194 - DNA, 174 bp, Homo sapiens; identical to SEQ ID NO: 222845
  misc_feature: GYAE6OF02GXD5W.37.25.C03.1.454.CMB.1.raw
  modified_base (174)..(174): a, c, t, g, unknown or other
  misc_feature (174)..(174): n is a, c, g, or t

SEQ ID NO: 223195 - DNA, 516 bp, Homo sapiens
  misc_feature: GYAE6OF02I6Q0I.37.25.C03.1.454.CMB.1.raw
  modified_base (493)..(493): a, c, t, g, unknown or other
  misc_feature (493)..(493): n is a, c, g, or t
  modified_base (510)..(510): a, c, t, g, unknown or other
  misc_feature (510)..(510): n is a, c, g, or t
  modified_base (515)..(516): a, c, t, g, unknown or other
  misc_feature (515)..(516): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatgggggactacgtggggccagggaaccctggtcaccgtctcctcagcctcaccagggcccatcggtcttcccctggcaccctcctccaacgacgccacctctcggggcacacgcggccctgggcctgcctggtcaaggactacttccatctacactcngagcggactggcaggcncatgnn

SEQ ID NO: 223196 - DNA, 231 bp, Homo sapiens
  misc_feature: GYAE6OF02FL6MQ.37.25.C03.1.454.CMB.1.raw
  modified_base (231)..(231): a, c, t, g, unknown or other
  misc_feature (231)..(231): n is a, c, g, or t
tcagtagtgtagatcacgaccggtgctcgatttagtagtgtagatttgggtttgggggactactggggccagggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagn

SEQ ID NO: 223197 - DNA, 546 bp, Homo sapiens
  misc_feature: GYAE6OF02HQ1NO.37.25.C03.1.454.CMB.1.raw
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagtagtgtagatcacgaccggtgctcgatttagtagtgtagatttggggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggccgtatattactgtgtgaaaggctggggatgggggactacgtggggccaggggaacccctggtcaccgtctcctcacgcctccaccgaagggccccagtccggtccttcccccgtggccacccctccctcccaagacgccaccctcgtcgggggccacgacggcgcccgtcgggcctcgcctggtcaagggacctacttccattcctacacctactgacgcggctggcaaggcncatagn

SEQ ID NO: 223198 - DNA, 175 bp, Homo sapiens; identical to SEQ ID NO: 223151
  misc_feature: GYAE6OF02FL9AB.37.25.C03.1.454.CMB.1.raw
  modified_base (175)..(175): a, c, t, g, unknown or other
  misc_feature (175)..(175): n is a, c, g, or t

SEQ ID NO: 223199 - DNA, 374 bp, Homo sapiens
  misc_feature: GYAE6OF02HNLUO.37.25.C03.1.454.CMB.1.raw
  modified_base (372)..(374): a, c, t, g, unknown or other
  misc_feature (372)..(374): n is a, c, g, or t
tcagtagtgtagatcacgaccggtgctcgatttagtagtgtagatttgggtttgggattcacgttgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatcggtccttccccctggccaccctcctccaagagcacctctgggggcacagcggccctgggctgcctggtcaaggactacttccatctacactactgagcgggctggcaaggcgcatagnnn

SEQ ID NO: 223200 - DNA, 563 bp, Homo sapiens
  misc_feature: GYAE6OF02HXMHQ.37.25.C03.1.454.CMB.1.raw
  modified_base (281)..(281): a, c, t, g, unknown or other
  misc_feature (281)..(281): n is a, c, g, or t
  modified_base (364)..(364): a, c, t, g, unknown or other
  misc_feature (364)..(364): n is a, c, g, or t
tcagtagtgtagatcacgaccggtgctcgatttagtagtgtagatttgggtttgggctgagcgtgcttttctagtggctattttaaaaggttccagtgtgaggtgcagttgttggagtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgnagactccgtggaacggcccggttcaccatctccagagacaattccaaagaacacactgtctctgcaaatgaacagcctagagngtacgaggacaccggcctttatattactgtgtgaaggacctactacgcccttatcgcacgcggctcggtccgttgtacttgacgacggtcgggaccgacgggaacccgtcggtaccaccgtctccctcacgccctccacgaaccggccctacgtccgtcccttaccccgtcggcccgtcccgtcgcctccgaggacccg

SEQ ID NO: 223201 - DNA, 174 bp, Homo sapiens; identical to SEQ ID NO: 222843
  misc_feature: GYAE6OF02HM4C7.37.25.C03.1.454.CMB.1.raw
  modified_base (173)..(174): a, c, t, g, unknown or other
  misc_feature (173)..(174): n is a, c, g, or t

SEQ ID NO: 223202 - DNA, 563 bp, Homo sapiens
  misc_feature: GYAE6OF02GI1II.37.25.C03.1.454.CMB.1.raw
  modified_base (453)..(453): a, c, t, g, unknown or other
  misc_feature (453)..(453): n is a, c, g, or t
  modified_base (561)..(561): a, c, t, g, unknown or other
  misc_feature (561)..(561): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtggtctcaagtactagtgctcctggtaatagagcagactacgcagactccgtgaagggccgttcaccatctccagagacaattccaagaacacgctctatctgacaaatgaacagcctgagagccgaagacacggccgtatatactgtgtgaaggcgtggggagtggggactacgtcggggaccgacggggtaaccctggtcgaccgtcgtcctcacgccctaccaccgaacggcccacgtccggtcccttccccgtcgcccaccctcctaccaagacgaccnccgtcgcggggaccacgacggccggcccgtggcctcgccgtcgtacgaacgtactacctcactcctacaccgtactacgacggccggcgtggacgacggcgacagtgncg

SEQ ID NO: 223203 - DNA, 582 bp, Homo sapiens
  misc_feature: GYAE6OF02FZGRO.37.25.C03.1.454.CMB.1.raw
  modified_base (312)..(312): a, c, t, g, unknown or other
  misc_feature (312)..(312): n is a, c, g, or t
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaggtattactggtagtggtaataccgcatactacgcagactccgtgacgggccggttcaccgtctccagagacaattccaagaatacggtctatctggaaatgaacagcctgagagccgaggacaccggccctntattactgtgcgagagatcaggacggagtatagcagcagctctgactacgtggggccacggaaccctggtccacccgtctcctcacgcctcccaaccgaacgggcccactccggtcccttcccccgtggccctacccctcctacccaacgacgccacccgtcgtcggggaccaccgaggccggcccgtcgggctcgccgtggtacgaacggaccgttacctcctacttcctaacaccgttacgtcggacggcgggcgtagggccaacggg

SEQ ID NO: 223204 - DNA, 615 bp, Homo sapiens
  misc_feature: GYAE6OF02I9AZJ.37.25.C03.1.454.CMB.1.raw
tcagtagtgtagatcacgaccggtgctcgatttagtagtgtagatttgggtttgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactcgtgaagggccgttcaccatctccagagacaattccaagaacacgctctatctgcaaatgaacagcctgagagccgaagacacggccgtatatactgtgtagaaggctggggatgggggactacgtggggccagggaccctggtcaccgtctcctcacgcctccaccgaagggccccatcggtccttccccgtggccaccactccctaccaagacgccacctcgtcggggctacgacggccggcccgtcggggcctcggcccgttcgggtacccgaaacgggtaccgttaaccgtttcccgactttcccgtaaccctacccgttaacccgttcggaaccgggtccggggtacctttacggggaccgtaaacggggccggaccctaaggttaggacg

SEQ ID NO: 223205 - DNA, 188 bp, Homo sapiens
  misc_feature: GYAE6OF02ICIK8.37.25.C03.1.454.CMB.1.raw
  modified_base (175)..(188): a, c, t, g, unknown or other
  misc_feature (175)..(188): n is a, c, g, or t
tcagtagtgtagatcacgaccggtgctcgatttagtagtgtagatttgggtttgggggaaggaggaagactgacggtccccccaggagttcaggtgctgggcacagcggccctgggctgcctggtcaaggactacttccatctacactactgagcgggctggcaaggcgcatagnnnnnnnnnnnnnn
